United States Patent 6,812,339 (POLYMORPHISMS IN KNOWN GENES ASSOCIATED WITH HUMAN DISEASE, METHODS OF DETECTION AND USES THEREOF) - sequence listing, part 107

SEQ ID NO: 177050 - DNA, 601 bp, Human
agcaggatcgtctccccacgtgcccacctccgtcaccaggctccatccccacaggccctctccctgtatgcccaccttgtgaccaggcaccatccccccagggccctctcctggcgtgcccacctcggtccctgggctccatgccccctggtcctctccccacatgcccaccttggtcaccaggctccatcctcctgcagccctctccccgcatgcccacctcagtcaccaagctccgtacaccccaagctccgtacacccccaccccagccctctccccacatgcccacctcggtcaccrggctccattccccccagccctctccctgcatgcccacgttggtcaccaagctccatcgtcccgcggccctctccctgcatgcccacctcggtcaccgggctccatccccccctgggccctctccccacatgcccacctcggtcactgggctccatcccccctcccccagtcctctccccgcatgaccacctcggtcaccaggctccgtcccccaactccaagctgcagcatctgcactgtgcctccactggcaccacccaccagccccatcatggctgctggttctccaggtgcagcagt

SEQ ID NO: 177051 - DNA, 601 bp, Human
gctcccactctcatgcaacacaaacccactgcacttccagggtcctcgtgtggggccacacctctgttaagcaggatcgtctccccacgtgcccacctccgtcaccaggctccatccccacaggccctctccctgtatgcccaccttgtgaccaggcaccatccccccagggccctctcctggcgtgcccacctcggtccctgggctccatgccccctggtcctctccccacatgcccaccttggtcaccaggctccatcctcctgcagccctctccccgcatgcccacctcagtcaccargctccgtacaccccaagctccgtacacccccaccccagccctctccccacatgcccacctcggtcaccgggctccattccccccagccctctccctgcatgcccacgttggtcaccaagctccatcgtcccgcggccctctccctgcatgcccacctcggtcaccgggctccatccccccctgggccctctccccacatgcccacctcggtcactgggctccatcccccctcccccagtcctctccccgcatgaccacctcggtcaccaggctccgtcccccaactccaagctgcagcat

SEQ ID NO: 177052 - DNA, 601 bp, Human
gctctaccctcttccctctacagcgagaccctccccacccccgcacaagaaaggggcgctgagaagagtaagtccacaggcaagtgaagaccccatcacatgcacaacaggccacactcaggacagcgctagaggcaccatcacactggaaatagcataaaaagagatggaaacggtggcggaagatgctgcagcctctgcctctgccgtgagcgcagagcgcaccgtcaagcccaggtgatgcaacatgcttcagcaccaaccagacttcgccatgagaagagtcgcccctggctcccaycacaggaacacggcagaatacaaacgcacgctatccaatgtcaatcataccaaaaaggacacagccatggaagccgcaggtctatttttataaacaccagcacccgggattcctcgccgagatgttcaaacacgggcgctgcctgacaccggcaaccctgccccgggaccgccccacatcagggccatcccagacctagctccccagcacccaaaccctcactggaccaccccctcatcaagatgcctggtcccccacccagagtcacaatacggggaagggtgtgtagaagaaatcaag

SEQ ID NO: 177053 - DNA, 601 bp, Human
agagatcacacagtctcagggcacctgctctaccctcttccctctacagcgagaccctccccacccccgcacaagaaaggggcgctgagaagagtaagtccacaggcaagtgaagaccccatcacatgcacaacaggccacactcaggacagcgctagaggcaccatcacactggaaatagcataaaaagagatggaaacggtggcggaagatgctgcagcctctgcctctgccgtgagcgcagagcgcaccgtcaagcccaggtgatgcaacatgcttcagcaccaaccagacttcgccrtgagaagagtcgcccctggctcccatcacaggaacacggcagaatacaaacgcacgctatccaatgtcaatcataccaaaaaggacacagccatggaagccgcaggtctatttttataaacaccagcacccgggattcctcgccgagatgttcaaacacgggcgctgcctgacaccggcaaccctgccccgggaccgccccacatcagggccatcccagacctagctccccagcacccaaaccctcactggaccaccccctcatcaagatgcctggtcccccacccagagtcacaatacg

SEQ ID NO: 177054 - DNA, 601 bp, Human
ccttttcattgtcttaacaacgtctgtcaaccagcaaaagttttcctttaattttgaagtcctatgtatcgactttctgccctattagttcatgctacttgtatcctaggaaatctttctccagccacagtcataaagaccatcactgtattttactcatctattcttcgacaattactctcttttcagaaggacaacttcagtgtcactatgagcgggacacactcttactagcatggggctatggtagctaccactgcaatcccaaagctgaccaggctccctccttaccccgagaggycacaccaccagcctgcactgacacccctgaaacactgaccttctagaaacattctttttttctgagagagtcacaccaaggtctggttaacgaggcactcagagcatggacttctcttaaagctgatgaatattcgtgagctcctttagaaggaagagatcacacagtctcagggcacctgctctaccctcttccctctacagcgagaccctccccacccccgcacaagaaaggggcgctgagaagagtaagtccacaggcaagtgaagaccccatcacatgcacaacaggccacactca

SEQ ID NO: 177055 - DNA, 601 bp, Human
cagcgttgagggtcccaggacctccacacccaccgacacacgggatggctgtcagtttaactccagctgtttttaggtgggtgtgttatcagccgcagcatcccactggggtttcatgtcctggagtctaactatgtgagcaccttttcgtacacctgctagccatttgtgtaccttcttttgggtctattcaaaccttctgcccatttttaaccgttgtttgtcgtcttgttatttagtcgtgagagttctttacatactctggacaccagttctttgttagatataaatattttctccmagtcgacggcttgccttttcattgtcttaacaacgtctgtcaaccagcaaaagttttcctttaattttgaagtcctatgtatcgactttctgccctattagttcatgctacttgtatcctaggaaatctttctccagccacagtcataaagaccatcactgtattttactcatctattcttcgacaattactctcttttcagaaggacaacttcagtgtcactatgagcgggacacactcttactagcatggggctatggtagctaccactgcaatcccaaagctgaccaggctccctcc

SEQ ID NO: 177056 - DNA, 601 bp, Human
acacggtcaatcagtacttaactttttacgcttctcctaactgtcagcgttgagggtcccaggacctccacacccaccgacacacgggatggctgtcagtttaactccagctgtttttaggtgggtgtgttatcagccgcagcatcccactggggtttcatgtcctggagtctaactatgtgagcaccttttcgtacacctgctagccatttgtgtaccttcttttgggtctattcaaaccttctgcccatttttaaccgttgtttgtcgtcttgttatttagtcgtgagagttctttacrtactctggacaccagttctttgttagatataaatattttctcccagtcgacggcttgccttttcattgtcttaacaacgtctgtcaaccagcaaaagttttcctttaattttgaagtcctatgtatcgactttctgccctattagttcatgctacttgtatcctaggaaatctttctccagccacagtcataaagaccatcactgtattttactcatctattcttcgacaattactctcttttcagaaggacaacttcagtgtcactatgagcgggacacactcttactagcatggggct

SEQ ID NO: 177057 - DNA, 601 bp, Human
gacaggtcccaaacacacagctcctcatttgtgtcctctgcaggaatagcagtaacctctttttcacaactataacgaacaaattttccttctctcacgcaaacacttccaaatactgattctctcctaaagaaatgcaaagttccacagccagcatcagatttaagaggcagttaactaggctgtttcccgccaggccgctgaaagccctcgctctgcggtgcccccgtgcagcagacggcagacattgggattgggattctgtgccaacaaatgagacacaaatgacaaccacagccayaactgcctttccttccccgaaacaccacgctacaggcaacaggaaggaacatggccccagggacttggtacggctttactgaaatacagtttacataaaacaaaatccacctattttaagtgtgcaatttgaaaagtttgggcaaatgtatacagttgtgtaaccactaccacaatcaagatttaaaacgtttctattcgcttaaaacatgtcctaatgccacactacgtcaccctcaatccaggcaaccacaactgttccagcttagctttttctagaatttcatacaaatgaaattgt

SEQ ID NO: 177058 - DNA, 601 bp, Human
tgcctgccgtgcctgcccgctcctctctacccttgactcgcttcaggtgcttggtggagacgatggcggtgaaactttcaacagcgcgcctgtttgggtttaagcttcagagaacaggcgcagaatccctgcacgtgcaagcactccgtgagtgctgtgggatgaaccagcgatgctgcctgagccacacacccgtggtctcggttctacagttctcccttggtgacaggaatacagactagcatgcgtttcttttccatacttttttgcctttatcaaattttctaggatgagtacgtaytactcagaaagaaaataactatttaaaagccagaaaactgccttgtttgtgagtgtaaggctacataagctattgccacacacctgctcctggaaagggtgaacgctgaggagagcgcaacagatctgtggcgaaagagcaggcgggcatgaaaactctttctcgtctaatccagagcagacgctcctgcttggacgaagggaagacagaactgacgctcggggtacagacaggtcccaaacacacagctcctcatttgtgtcctctgcaggaatagcagtaacctctttttcacaacta

SEQ ID NO: 177059 - DNA, 601 bp, Human
ccggccacacaaggtctggaatgttcttccctgcccttcctgggaaagccctgcctgccgtgcctgcccgctcctctctacccttgactcgcttcaggtgcttggtggagacgatggcggtgaaactttcaacagcgcgcctgtttgggtttaagcttcagagaacaggcgcagaatccctgcacgtgcaagcactccgtgagtgctgtgggatgaaccagcgatgctgcctgagccacacacccgtggtctcggttctacagttctcccttggtgacaggaatacagactagcatgcgtytcttttccatacttttttgcctttatcaaattttctaggatgagtacgtactactcagaaagaaaataactatttaaaagccagaaaactgccttgtttgtgagtgtaaggctacataagctattgccacacacctgctcctggaaagggtgaacgctgaggagagcgcaacagatctgtggcgaaagagcaggcgggcatgaaaactctttctcgtctaatccagagcagacgctcctgcttggacgaagggaagacagaactgacgctcggggtacagacaggtcccaaacacacagc

SEQ ID NO: 177060 - DNA, 601 bp, Human
aagaataaattctaaagacaaagagtgcaaagaaaccttaaactttactctcatgttattgttgtaattctgaatctgtgtttaagtatagggtagcagaagccaagtaagtaaatatgtttatgttactaggatctaagcttttctgtgcaagagaagagataaaaatacaatttcacagaatttacaggagggggagaatgtgctgtgttaaaaatgtgaccagcatgaccagcacccccagcgctgccgaaactgctcgagagtcattttcctctaaatgccattccaaggctcctcsgggaagagacaggcctgggacaggaaatacaggatgaggctgatgtcttgcaccagaggcaccaaacaggatggagcgaaggccaggaggagacccatgggcacagggagcagtcccacatggcaatggacaagccactcagcccagggggagaaaagaggccaccttgagtgacacatgaaaattaatcctggacagattagtgactacaaggaaaagaaaactcacaacgccgacatgaaaacacaggtgagtaggtaaataacctcaggtagggagagacagtctagccacactgca

SEQ ID NO: 177061 - DNA, 601 bp, Human
accatttttcatcttttatcccctagttttactgtaccttttctatgtttagatacacaaactcactatcgtgttacaactgtacacgtcacaagccatgcaggtttacagcccaggagccaggggccgcaccacacagcctaagagtgtagcaggctgtgccatccaggtttgtgttagtatattccacgatgctcgcacaacaatgacattgcctaatgatgcgtttctagaatgtatccccatcactaagtggcgcgcgactgtacctggtttacacataattccaggaagtatttcyaagcccactgcaggctggacgggaagacacagaggcagggcccgttagctaacccaggcttcagcctcccaccaatgcaaagaccaccctgcctggccttcccttaagactgagcctcccctgtctccagcccaatattcccaggcagagctaacttgtgcttattatatgctttttgccttggcagagaaaaatatatgtattttttaaactatttccttccaaaattattttttttaagttttagtgcttgaattatgcagaaaagcatcactattcagagtaatttcctgagtgtac

SEQ ID NO: 177062 - DNA, 601 bp, Human
agtcctgcaagcgccattcatggtgagtgccctacacagatgcaccatttttcatcttttatcccctagttttactgtaccttttctatgtttagatacacaaactcactatcgtgttacaactgtacacgtcacaagccatgcaggtttacagcccaggagccaggggccgcaccacacagcctaagagtgtagcaggctgtgccatccaggtttgtgttagtatattccacgatgctcgcacaacaatgacattgcctaatgatgcgtttctagaatgtatccccatcactaagtggcrcgcgactgtacctggtttacacataattccaggaagtatttccaagcccactgcaggctggacgggaagacacagaggcagggcccgttagctaacccaggcttcagcctcccaccaatgcaaagaccaccctgcctggccttcccttaagactgagcctcccctgtctccagcccaatattcccaggcagagctaacttgtgcttattatatgctttttgccttggcagagaaaaatatatgtattttttaaactatttccttccaaaattattttttttaagttttagtgcttgaatt

SEQ ID NO: 177063 - DNA, 601 bp, Human
tacagcagcacagtcatgtcccaggcctctcagactcccgcagagcaacacccagtcctgcaagcgccattcatggtgagtgccctacacagatgcaccatttttcatcttttatcccctagttttactgtaccttttctatgtttagatacacaaactcactatcgtgttacaactgtacacgtcacaagccatgcaggtttacagcccaggagccaggggccgcaccacacagcctaagagtgtagcaggctgtgccatccaggtttgtgttagtatattccacgatgctcgcacaacratgacattgcctaatgatgcgtttctagaatgtatccccatcactaagtggcgcgcgactgtacctggtttacacataattccaggaagtatttccaagcccactgcaggctggacgggaagacacagaggcagggcccgttagctaacccaggcttcagcctcccaccaatgcaaagaccaccctgcctggccttcccttaagactgagcctcccctgtctccagcccaatattcccaggcagagctaacttgtgcttattatatgctttttgccttggcagagaaaaatatatgtatt

SEQ ID NO: 177064 - DNA, 601 bp, Human
ctgtggggcgggagcccaaaagggctcacccgggctcctgcacctgcccgtctgcacgctcccctgcacgctccccttccagcaaatgagccacagcccctgttgcaagtacccagagcgggtcagggaactctcctgtttcaatgataattagcaacaatgttactggtttacatattcactacattctacttcccatcactgtttcagaaatatactgcatctacttattaaaacttacagttaactgtaaagcagcctcaggcaggtccttcaggaagagtccagaagaaggtactgwtatcatagggatgacggctccatgtgtgttactgcccctgaagactgcagggagacgggacttggaggtggagggcagtgatgtggatgatcctgactctgtaggcctaggctaacgtgtgcttgtgtcttgtttctaacaagtaagtttaaaaagtaataaataattttaaaaatggaaaaaagctcgctgggcgtggtggcacacgtctgtaaacccagcatttctggaggctaagacaggcagatcgctagagcccaggagtccaagaccagtctgggcaacacggtgaaacctaca

SEQ ID NO: 177065 - DNA, 601 bp, Human
ggcggcccagagaacaccttcccgtccagggctgtgggccgacagcagagggcacaagcagaccctctggggggctgaacgaaatgggggtagacatcctcaatctgtgcacttacaagggggacattttattgtatataaattatgtcccctccaagaatttttatgcatgttaacctctatttaaaggagagcccctaccctcaaactgtcagcctccacgtacagccacgcctcacatcatgatgctcctggcaataacagacggcatacatgacgctggtcccatcaagaccatcckggctaacagggtgaaaccccatctctactaaaaatacaaaaaatcagccaggcgtggtagcatacgcctgcagtcccagctacttgggaggctgagacaggagaattgcttgaacccgggaggcagaggttgcagtgagccgaaattgcgccactgcactccagcctgggcaacagagcgagaatccatctcaaaaaaaaaagaaaaaagaaaagtatggcacactgaccaggtgcagtagctcaccactttgagcgggtgagatgggaagactgcctcaggccaggagtttaagaccag

SEQ ID NO: 177066 - DNA, 601 bp, Human
cctccaagtactctgagtaggaagccggacaccagggagcacacaactggggtttcagcgacctgagcgctccaaaggacagatccacaccgacggcgagaggcggcccagagaacaccttcccgtccagggctgtgggccgacagcagagggcacaagcagaccctctggggggctgaacgaaatgggggtagacatcctcaatctgtgcacttacaagggggacattttattgtatataaattatgtcccctccaagaatttttatgcatgttaacctctatttaaaggagagcccctrccctcaaactgtcagcctccacgtacagccacgcctcacatcatgatgctcctggcaataacagacggcatacatgacgctggtcccatcaagaccatcctggctaacagggtgaaaccccatctctactaaaaatacaaaaaatcagccaggcgtggtagcatacgcctgcagtcccagctacttgggaggctgagacaggagaattgcttgaacccgggaggcagaggttgcagtgagccgaaattgcgccactgcactccagcctgggcaacagagcgagaatccatctcaaaaaaa

SEQ ID NO: 177067 - DNA, 601 bp, Human
gcattagtcactagggaaatgcaaatcaaagccacaacataatggcacggcacccatcgaaaaggctaaaattcaagactgaccataccagctttccgcaaggatgtcaacctttatgcgctgctggtgagacacaatgcaaaacaggacagccactttggagttccttcagaaattaatattcatttgccatattcagcaatcccacccctagttatctacccaagacaaagaaaaacttatgttcatataaagatttataggaaacattcatagaagcattgctcataataatcaaaarctagaaacaacccaaatacccatcaactggtaaccagatcacctgcggtccagccgcacaccaggatgctgctcagcaacgcaaaggaaccagctactggcacgcacacgacacaccacttgggcaccacgcagaagtatcccgccaagggaaagggccagatgtgaggctcccactacataatctcatttatacaaaattctagaagaggcaaaatcacagtgacagcagcagctcagtggctgccggggaggaagctggagcaggggctcacccccaggggcacgaggctacagaatg

SEQ ID NO: 177068 - DNA, 601 bp, Human
ggcctaggtacacctgccagctccacccctgccaagtcggaatggcatacactgtttctataaagggacgtctttcagacacttggtgacttctcacgtatgcatacccttgatggcctgggcagtttcacgagcgttcttaaagtgatcaagaagacctgaacctctggatttgcacgattttgtggggatttctgggtcaagtgactaatgaaccattttcacagatcatctcaggccgcttggggaagagctataaagtcactatttttaaaagcaatttttttgttgttttttttttggttttttgagacggagtctcactctgtcgcccaggctggagtgcagtggcgcgatctcggctcacagcaagctccgcctcccaggttcatgccattctcctgcctcagcctccaggtggctgggactacaggagcccaccactacgcccggctaattttttgtatttttactagagacagggtttcacagtgttagccaggatggtgtcgatctcctgacctcgtgatccaccagcttcggcctcccaaagtgctgggactacaggcgtgtgccaccatgcccagctaattttttgtat

SEQ ID NO: 177069 - DNA, 601 bp, Human
aattgcatttattgtatgctgagtttattcccatgccacaagtttttgtttcttcagtttcttctggtacagttttcctctgtgcaacttcctcacctggcttgggaacaagtgtctttaccgtgaggatcgtctcaatgtgacggggcgccctgtatggatgaacccgaccaccagccctggaagtcccacagcgcatcctgggtgctcaaacaccagagagcctacatctacaccctcacattcagtgtgactctccacatttttaattgtgtgcagcaaaaattcagcgctcttttcrggtcaccaaccctgtgtccagccccactgtttggcctaggtacacctgccagctccacccctgccaagtcggaatggcatacactgtttctataaagggacgtctttcagacacttggtgacttctcacgtatgcatacccttgatggcctgggcagtttcacgagcgttcttaaagtgatcaagaagacctgaacctctggatttgcacgattttgtggggatttctgggtcaagtgactaatgaaccattttcacagatcatctcaggccgcttggggaagagctataaagtcactat

SEQ ID NO: 177070 - DNA, 601 bp, Human
ccaggactgtgagaaatgaatttccggtgtctagaagcctcccagtctatggtattttgttacagcagccagaatggcctatgacagaaggggattcctcaacctaacacagggcctctatgaaaaacctgcagctgacatcatgtgcgtcatgagagaagacagctgcctcccccaagatcagaaacaaggcaaaatgtcccttctcaacgcttctgtttgtcatattacactggaggttgtggccagtgcaatgagacaagaacaagaaataaaaggtgcacagaccagaaaaaaagayatgaaccactctttactgcagatcacgcctatctttgaagaaaatcctaagaaatccacaggatataaagtcaattttttttattttaattgcatttattgtatgctgagtttattcccatgccacaagtttttgtttcttcagtttcttctggtacagttttcctctgtgcaacttcctcacctggcttgggaacaagtgtctttaccgtgaggatcgtctcaatgtgacggggcgccctgtatggatgaacccgaccaccagccctggaagtcccacagcgcatcctgggtgctcaaa

SEQ ID NO: 177071 - DNA, 601 bp, Human
gaagatactggccatatacagatgacctataaaggaacagtaaccagaatatgcacagaactcctataattaatatgaaataatttaaagaaaacggggcaaaaagacacaaacagacatttcacagaaggttacccacaaacaataaacatagaaaattaatttcctctatattaaaggaaaagaagttaaatgaaattaattttcattaaggaattaaaggaaattaatcaaatttctttttttttttaaaaaaaaaaaagagttttgctcttgttgccctgcctcgagtgcagtggcrcaatctcagctcactgcaacctcccgctcacgggttcaagcgattctcctgcctcagcctcctgagtagctgggattacaggtacccgccatcacaaccggctaattttttgtatttttagtagagatggagtttcaccatgttggccaggctggtctcgaactcctgacctcaggtgatccacccgcctcggcctcccgaagtgctgggatgacaggcgtgagccaccgcgcctggctcattaattaatttttaagtgaaaattaagacaacactatcagagcattttacacccccaga

SEQ ID NO: 177072 - DNA, 601 bp, Human
cgtcagaagacaccataaagaaagtgaaaagatcagatataaactggaagaagatactggccatatacagatgacctataaaggaacagtaaccagaatatgcacagaactcctataattaatatgaaataatttaaagaaaacggggcaaaaagacacaaacagacatttcacagaaggttacccacaaacaataaacatagaaaattaatttcctctatattaaaggaaaagaagttaaatgaaattaattttcattaaggaattaaaggaaattaatcaaatttctttttttttttawaaaaaaaaaagagttttgctcttgttgccctgcctcgagtgcagtggcgcaatctcagctcactgcaacctcccgctcacgggttcaagcgattctcctgcctcagcctcctgagtagctgggattacaggtacccgccatcacaaccggctaattttttgtatttttagtagagatggagtttcaccatgttggccaggctggtctcgaactcctgacctcaggtgatccacccgcctcggcctcccgaagtgctgggatgacaggcgtgagccaccgcgcctggctcattaattaatt

SEQ ID NO: 177073 - DNA, 601 bp, Human
tcgtcagaagacaccataaagaaagtgaaaagatcagatataaactggaagaagatactggccatatacagatgacctataaaggaacagtaaccagaatatgcacagaactcctataattaatatgaaataatttaaagaaaacggggcaaaaagacacaaacagacatttcacagaaggttacccacaaacaataaacatagaaaattaatttcctctatattaaaggaaaagaagttaaatgaaattaattttcattaaggaattaaaggaaattaatcaaatttctttttttttttwaaaaaaaaaaagagttttgctcttgttgccctgcctcgagtgcagtggcgcaatctcagctcactgcaacctcccgctcacgggttcaagcgattctcctgcctcagcctcctgagtagctgggattacaggtacccgccatcacaaccggctaattttttgtatttttagtagagatggagtttcaccatgttggccaggctggtctcgaactcctgacctcaggtgatccacccgcctcggcctcccgaagtgctgggatgacaggcgtgagccaccgcgcctggctcattaattaat

SEQ ID NO: 177074 - DNA, 601 bp, Human
cccatgccaggaggattacatacttaaaagcaaaagctatcattttagaagaaaatacagaagactattcctattaccttcgggttagaaaggacttcttaaagatgacttgaaaaagcttaccaaaaaggagacaatagatacattcaactacagtaaaatcaaggagtcctattcgtcagaagacaccataaagaaagtgaaaagatcagatataaactggaagaagatactggccatatacagatgacctataaaggaacagtaaccagaatatgcacagaactcctataattaataygaaataatttaaagaaaacggggcaaaaagacacaaacagacatttcacagaaggttacccacaaacaataaacatagaaaattaatttcctctatattaaaggaaaagaagttaaatgaaattaattttcattaaggaattaaaggaaattaatcaaatttctttttttttttaaaaaaaaaaaagagttttgctcttgttgccctgcctcgagtgcagtggcgcaatctcagctcactgcaacctcccgctcacgggttcaagcgattctcctgcctcagcctcctgagtagctggga

SEQ ID NO: 177075 - DNA, 601 bp, Human
taggaggcaaatgaaaatggagctctaactcacaccacacacaaaccccatgccaggaggattacatacttaaaagcaaaagctatcattttagaagaaaatacagaagactattcctattaccttcgggttagaaaggacttcttaaagatgacttgaaaaagcttaccaaaaaggagacaatagatacattcaactacagtaaaatcaaggagtcctattcgtcagaagacaccataaagaaagtgaaaagatcagatataaactggaagaagatactggccatatacagatgacctayaaaggaacagtaaccagaatatgcacagaactcctataattaatatgaaataatttaaagaaaacggggcaaaaagacacaaacagacatttcacagaaggttacccacaaacaataaacatagaaaattaatttcctctatattaaaggaaaagaagttaaatgaaattaattttcattaaggaattaaaggaaattaatcaaatttctttttttttttaaaaaaaaaaaagagttttgctcttgttgccctgcctcgagtgcagtggcgcaatctcagctcactgcaacctcccgctc

SEQ ID NO: 177076 - DNA, 601 bp, Human
cggctcactgcaagctccgcctcccgggttcacgccattctcctgcctcagcctcccgagtagctgggactacaggcacccgccaccatgcccagctaattttttgtatttttagtagagacggggtttcaccatgttagccaggatggtctcgatcccctgacctcatgatccgcctgcctgggcctcccaaagtgctaggattacaggcgtgagccaccgcacccggcccatagatttcagttctcccaaaattgacccacagattgatacaacttcaattaaaataacctacaaggayttttatgggccccgaagagttgattctaaaatttataaggaagatcaaagtgccaagagttgcacagacaattctcaaaagcaacagaatggagtattacctctagtagatatcaagaattagtatggagctaaattatttaaggacaggatgctactgatgaaaggacagacagataaaccaagagaaaacaaccgacaggctagaaacggatgccacataatataaaacctgaaatgttacagacgggccatggagaccacagaggtgaggaaggaccattcaaataaataacaccag

SEQ ID NO: 177077 - DNA, 601 bp, Human
atgacttgcacttggtctcaggcaggtttttctccacggctttaggtgaaaggcttctgttgaaaacactgagcacctggtatcacttctgccttcgtgaagccttcccttatattctcagccattcctggtttctaattttctcaggtttctaaaatctctgaaacccacaagcctcatgtgacttcactgactccctctttcagggagcctgggtccaaggtcggaacgtggccaggctgctccaggctgggcgtccaagccctcgtcctccaggcaccgcacaccttgaggcccagcrtgtgcagaatcaggctgtgctcgcttccgccgacagcagtgagcatgctggctgggcccagggtgccttctcgacactttgctaaacctcaggataaagcatattcatctgcacatatttaactcccaagactctaaaaatcctgcactaacagagagccttcacttctgcacaattttaacatgtgctctttcatctgcagattctgaattcattcaaatgacactttgggcattccctttgccttgactgagagctcagttccaactctgtgcccacctcccagcctccccctaccct

SEQ ID NO: 177078 - DNA, 601 bp, Human
cacctgctctgggatgctggaggtgctaaggggggccggtcagagtgaccaacagggacagacccacccaacacacgggttctggcctttttgcctaccagggcttctggaaactcaaacataccccccaaaaaaatgctacctccttgaattgaattctctttaagttaactttaaatggctgaggtattttggtaaaaatacttcaggatattacagttgacctttgaaaaacatgggtcaaacttccagggtccacttacatgcagatttttttcaaccaagcaaggactgaagatayggcattgacaggacatgaaacccacgtacacagagggctgacgttttgctcgcttgggttccacagggaacttgtatgtgcgtacggggccctggaaccatcccgagaacactgcggggcgactgtatctggcgccatcactttaggaaattcttagcacatggacacacctccgtgaacaggtacagtgcacatgcgtgtctgtcaagccacagcctgggagcagagccctgctgcaaacttcaacccaaagctgcttctaaaaagctcgtgagcagccttcagtgaggctggcatcca

SEQ ID NO: 177079 - DNA, 601 bp, Human
tctccatggtgcagggtcccacacgtgctctgctcctgcagctgagcctccctaaagcactgagcagaggcctggacacccaggagccgcacctgctctgggatgctggaggtgctaaggggggccggtcagagtgaccaacagggacagacccacccaacacacgggttctggcctttttgcctaccagggcttctggaaactcaaacataccccccaaaaaaatgctacctccttgaattgaattctctttaagttaactttaaatggctgaggtattttggtaaaaatacttcaggayattacagttgacctttgaaaaacatgggtcaaacttccagggtccacttacatgcagatttttttcaaccaagcaaggactgaagatacggcattgacaggacatgaaacccacgtacacagagggctgacgttttgctcgcttgggttccacagggaacttgtatgtgcgtacggggccctggaaccatcccgagaacactgcggggcgactgtatctggcgccatcactttaggaaattcttagcacatggacacacctccgtgaacaggtacagtgcacatgcgtgtctgtcaagcc

SEQ ID NO: 177080 - DNA, 601 bp, Human
ctcagtaagaaaataacccaggttgggcgtggtggctcatgcctgtaatcccagcactttgggaggccgaggaggacagatcacttgaggtcaggagttcgagaccagcttggccaacatggcgaaaccccatctctactaaaaatacaaaaaattagcagggcgtggtggtgcacacctctagtcctagctacttgggaggctgaggcacgaaaatcgcgtgaacccaggaggcggagcttacagtgagccgagatcatgccactgcactccagcccaggcaacactgagagactccgcrtctcaaaaaaaaaaaaagtgggcaattgaatagacccttcgccaaaggtggcagacggatgcaaatgagcacacggagagagccccaacatcattagtcattagggagacataaattaaatccttaaagcgacaccactacacactcactaaaatagctaaaactaaaaagatcaggtgctctccaggatgtggagcaaccagagctcctgggcaccactggtgggagcctctctgacaacagccctgcagttttgtagaaagttaaacatactcctcatgtaggacctgccattccacc

SEQ ID NO: 177081 - DNA, 601 bp, Human
cacaactgtaaaaaaaggtcaggctggccgcagtggctcacgcctgtcatcccagcacttcaggaggccaaggcgggcagatcatttgagcccaggagttcgagaccagccaggccaacatggtgaatccctgtctctactaaaaacacaaaaaattagttgggcatggtggtgcacccctgtagtggaggctgaggcacgagaatcgcttgaaccagagaggcgaaggttgcagtgagccaagagcacaccactgcagtccagcctgggtaacagaatgagactccctctcaaaccaaasaaaccagaaaaagtcagagagctgacacgagctgatctcaagatgcattagaaagctcagcacttcggaaggccgaggcggggagactgcttgggctcaggagttcgagaccagcctggccaacatggtgaaaccctgtctctactaaaaatacaaaaattagctgggcgtggtggcgcacacctgtaatcccagctactcgccaggctgaggcaggagaatcgcttgaagccgggaggtggaggttgcagtgagccgagaccatgccactgcactccagcctgggcaacagagcaagac

SEQ ID NO: 177082 - DNA, 601 bp, Human
ccagatgtggaaagggcccctccagaatccagcgtgcgctccttacacaggctggctttctctctaagcgggtgctgtgctgtgacagatgcacagcctcatcttccttctaacctgttctggctaaagcaagtgttctctcccacctctcggggtttggcaggcataagggacggcgcaaagcagcacaggggaacatgtgctgcccggcgcaggcgctaccaccactgtaacccgaatattttgctaaaaattaaacttctgacgcagctcctggtccagcacttgcagccccccccccgcacattgcagatactattgtaaaatcatgaactttgattcatcctcccctaaaactacaaaatgctgattaaaacaaaaatgcgagcaagtgaagggacgtgcactgtgttcatgggtcaggagactcacaatagttaagatgtcaactcctcccaaactgatctgcagaagcaatgcatcccaaagtcccagcagcctcctgtgtagaaactgacaaggtgattctgaaattcatacagaaatgcaaaagtcttagattaaccaacacaactgtaaaaaaaggtcaggctggccgcag

SEQ ID NO: 177083 - DNA, 601 bp, Human
ataagtgaagaaaacaaaagacaggatccaggaaacatgggactgaaccccaaggaaacaaggggactctcaaggatgaagcagaagggaggaacaggcatggccaggcacagggtccggagggccagggcgctggggctggccacagggcagtaagcacctgggaacccacagcccttctagctgctgagacacagctgcctgcacagggagcagaagcagcacagcacttggctcgactcaaacagcgtgttcacagccaagggccgtgcgcgcccaacgcggagtcggccagggctgygtgggctgggccggggctctgcggactgcggctgggcagccagacggtcgctagctgacactcactcggcaacctcaggaggtggctgtacaggcagggccatgtggatacacgttccaaagtggtcccctctgagaggcagttaaaagggggtgggtgggccagcagagtttgtttctcactgaaagctctgctcttcaaaacaggcatatgattaaagttctatacttttttttttgaaacagagtctcacttaaagttttacatttttaaatatttaaaaaaagaaaaaaaaagaca

SEQ ID NO: 177084 - DNA, 601 bp, Human
gcagccctgagagctccacagaaacgggaagagatggccagcaccttcgaaaccccccgggaaattaccttccacctggaactcaacgccaggccaaaccacccaccaaggctcagaggcaaaaaaaggcatttcagacacactaggtctcaaaaaaggtatattctgtaagaagggagaagccacttaaacaagggaataagtgaagaaaacaaaagacaggatccaggaaacatgggactgaaccccaaggaaacaaggggactctcaaggatgaagcagaagggaggaacaggcatgrccaggcacagggtccggagggccagggcgctggggctggccacagggcagtaagcacctgggaacccacagcccttctagctgctgagacacagctgcctgcacagggagcagaagcagcacagcacttggctcgactcaaacagcgtgttcacagccaagggccgtgcgcgcccaacgcggagtcggccagggctgcgtgggctgggccggggctctgcggactgcggctgggcagccagacggtcgctagctgacactcactcggcaacctcaggaggtggctgtacaggcagggcca

SEQ ID NO: 177085 - DNA, 601 bp, Human
gcctgaaaacctcctgttggtcatgatgacaaatgagcgtggggcttcctcctcctgcgctatgacgctggggcactctcagggctgtcggctccagctctttcgaaactcagcatggtatcaagaataatggtgatgcctctcctgggctaacatctaaaattcttgatccaaaaagccacatttatgcccattaagaaaacttccccccaaaacgcccctttcaaaataaaccatgctgaaatcaaacaaaaaccaaacacccagctgcagcaaataacctgctggaatctccaagccyggagctcgggaacgaagtaacaggaaaggcctccaaggctccgtctccgagtctgtgcccacagtgcccaaggacagccttcaaagccaggtgggcactcatcagccatgtggccgccagagctgctgcgcgtaacgagggagagttccactctcacccaagcacactcggcgcctggggaccccaaaacaagacacctggtaaatacccccatgtatgtggttattatggagtgtcaacttgattgaagaatgcaaagtattgttcctgggtgtgtttgtgagggtgttgccaaagaag

SEQ ID NO: 177086 - DNA, 601 bp, Human
ttatggagaatgggaaatgataacctcgaaaaagatgaagtaaggcctgaaaacctcctgttggtcatgatgacaaatgagcgtggggcttcctcctcctgcgctatgacgctggggcactctcagggctgtcggctccagctctttcgaaactcagcatggtatcaagaataatggtgatgcctctcctgggctaacatctaaaattcttgatccaaaaagccacatttatgcccattaagaaaacttccccccaaaacgcccctttcaaaataaaccatgctgaaatcaaacaaaaacyaaacacccagctgcagcaaataacctgctggaatctccaagcctggagctcgggaacgaagtaacaggaaaggcctccaaggctccgtctccgagtctgtgcccacagtgcccaaggacagccttcaaagccaggtgggcactcatcagccatgtggccgccagagctgctgcgcgtaacgagggagagttccactctcacccaagcacactcggcgcctggggaccccaaaacaagacacctggtaaatacccccatgtatgtggttattatggagtgtcaacttgattgaagaatgca

SEQ ID NO: 177087 - DNA, 601 bp, Human
aagtgagtgtcaacaagaagcctcccacagaggggagttttcagagcagattcgagcaatggaggatgggtcatcagtgtcaaactgtcagaaaggaggggctgctttgctaagcaaatgaacagccagacgccaaaaggtagctcagacaactcagtggcctgtactcgattcctaacatttccattctacatgaataatcagaatgcaaatgtttactgatattttaaactagtacttttccaatgtataaatctagcagtcaacattttctgtctccaattttttaaacactcctttrcaacttctgaaagcagggggcagtgtaagcctgagaatggctccggagcagcgagctctctcccggtgggtgcagccccgccagcacgtgggaagcaactctgaaccagccccgcttccagaggggtgcggatgggctgtgaggaggcagcagggtggagggactgtttctaagtctgtgtatcttttcacttgtaacaataagcatggattttttttttaactgaaaaacatcaaataaaaacctccagtgaagaaaacataaaaggacacaccaagctgctgcttctggaccctggga

SEQ ID NO: 177088 - DNA, 601 bp, Human
ctgctgggaggcctgccctgtgccctgacgatcgcagtcctgagcgggtgaggaaggcatgatttgcacctgcatcaaaaacggacgttcacaaagccaggcactgcagagaccccagtcctcagaagtccatggaaaaagtcacatagagaccagagtaaataatcctaacaggcaacccagatccccatctctcagaaatcaaaacaacaaacagaagaacggctcctgaaagctccatcctcccaggtgcagaggctggctacagggcggtcagggctccacagccgcagcctcccayaggggagggtccccagctccctgcaatcacccaaacccacctttctttactccccaaaagtgagtgtcaacaagaagcctcccacagaggggagttttcagagcagattcgagcaatggaggatgggtcatcagtgtcaaactgtcagaaaggaggggctgctttgctaagcaaatgaacagccagacgccaaaaggtagctcagacaactcagtggcctgtactcgattcctaacatttccattctacatgaataatcagaatgcaaatgtttactgatattttaaactagtacttttc

SEQ ID NO: 177089 - DNA, 601 bp, Human
caagcctccctgcggtggccaggacgcccaggaagccaaggaccccggccacctgccagcccgctggacacgggagtgctgctgggaggcctgccctgtgccctgacgatcgcagtcctgagcgggtgaggaaggcatgatttgcacctgcatcaaaaacggacgttcacaaagccaggcactgcagagaccccagtcctcagaagtccatggaaaaagtcacatagagaccagagtaaataatcctaacaggcaacccagatccccatctctcagaaatcaaaacaacaaacagaagaayggctcctgaaagctccatcctcccaggtgcagaggctggctacagggcggtcagggctccacagccgcagcctcccataggggagggtccccagctccctgcaatcacccaaacccacctttctttactccccaaaagtgagtgtcaacaagaagcctcccacagaggggagttttcagagcagattcgagcaatggaggatgggtcatcagtgtcaaactgtcagaaaggaggggctgctttgctaagcaaatgaacagccagacgccaaaaggtagctcagacaactcagtggcctgt

SEQ ID NO: 177090 - DNA, 601 bp, Human
aaggccacatctaggaatgcagctatgcaaataattaaaaaagtgaaaagagactctgcgaagatgcctgctacaatgttgctgaccataaggacaacctatgccaatccaaacggacacagaaggaaccaaataggatgcggtcactaaagcaacgaaaagtacgcagcaaagaaacaccaaaaaggcgtcaagtggggcccactgtttaaagatgtctatcgatacaggccgacactgtgtgtacaaacgggtggcgctgctgttttacacactgaacacaacagttcaccagtgactyttctgttttaataaagatgtgtatcgatacaggccgacactacgagtgtgtacaaacgggtggcgctgctgttttacatacaacgcgacagtgcaccagtgactttttcaaaggcaggtgtttgggcttttgctgtttgcagacttctgcggtctaaggccctcggagcccacctcacacagcacagcagcagagccccacgtgctcacgtgggccccagactgttcactgctttgtgaagcaagcagtgagcggtctgggacagaagccggcctgaggtctcaaggctgcattttctga

SEQ ID NO: 177091 - DNA, 601 bp, Human
atgcaacaggctttaggggaaagggaatgtaaagtcaaggtttctcaccagtaaattctgcacgagctctttcacattagctgctgtctctgtagactgcttgccagatgaagccagttttattaacgtagataggaaatttttacatttcttcacgttttccatagtttcctggattaaagtaaaaagatataagtgaaaaatcttaaaaggcagatttttgtcacagcctttggttactaaaatatgcatatgtacaaaagatacatatatttcttctctaaacttctttcaagaaaaygcaccacctcttggaaccctgggccatggggcaggccagccacatcagtcacatggccaccgaagtcagcatctccctcagccccgcaaggccacatctaggaatgcagctatgcaaataattaaaaaagtgaaaagagactctgcgaagatgcctgctacaatgttgctgaccataaggacaacctatgccaatccaaacggacacagaaggaaccaaataggatgcggtcactaaagcaacgaaaagtacgcagcaaagaaacaccaaaaaggcgtcaagtggggcccactgtttaaa

SEQ ID NO: 177092 - DNA, 601 bp, Human
cacaggtcacagcagcaacaggtgtctgtcctatgcaacaggctttaggggaaagggaatgtaaagtcaaggtttctcaccagtaaattctgcacgagctctttcacattagctgctgtctctgtagactgcttgccagatgaagccagttttattaacgtagataggaaatttttacatttcttcacgttttccatagtttcctggattaaagtaaaaagatataagtgaaaaatcttaaaaggcagatttttgtcacagcctttggttactaaaatatgcatatgtacaaaagatacawatatttcttctctaaacttctttcaagaaaacgcaccacctcttggaaccctgggccatggggcaggccagccacatcagtcacatggccaccgaagtcagcatctccctcagccccgcaaggccacatctaggaatgcagctatgcaaataattaaaaaagtgaaaagagactctgcgaagatgcctgctacaatgttgctgaccataaggacaacctatgccaatccaaacggacacagaaggaaccaaataggatgcggtcactaaagcaacgaaaagtacgcagcaaagaaacacc

SEQ ID NO: 177093 - DNA, 601 bp, Human
cttcgacacgtgtgcacccctccccttcgcctgcagccttccagaggagctctccctgctggcacaggcctcccgggcacaggtcacagcagcaacaggtgtctgtcctatgcaacaggctttaggggaaagggaatgtaaagtcaaggtttctcaccagtaaattctgcacgagctctttcacattagctgctgtctctgtagactgcttgccagatgaagccagttttattaacgtagataggaaatttttacatttcttcacgttttccatagtttcctggattaaagtaaaaagatrtaagtgaaaaatcttaaaaggcagatttttgtcacagcctttggttactaaaatatgcatatgtacaaaagatacatatatttcttctctaaacttctttcaagaaaacgcaccacctcttggaaccctgggccatggggcaggccagccacatcagtcacatggccaccgaagtcagcatctccctcagccccgcaaggccacatctaggaatgcagctatgcaaataattaaaaaagtgaaaagagactctgcgaagatgcctgctacaatgttgctgaccataaggacaacctatgc

SEQ ID NO: 177094 - DNA, 601 bp, Human
agaagggagttgctggagaccctgaccagagtgcagcatggttggggcagccagaggagaagagagccacagacaagggacgcaggcaccagaaaacggcaaagcccgggagacctccaggcgccggccccagaacacccagccccaggaaggagtctccttagctaggccacacacgccttcgacacgtgtgcacccctccccttcgcctgcagccttccagaggagctctccctgctggcacaggcctcccgggcacaggtcacagcagcaacaggtgtctgtcctatgcaacaggctktaggggaaagggaatgtaaagtcaaggtttctcaccagtaaattctgcacgagctctttcacattagctgctgtctctgtagactgcttgccagatgaagccagttttattaacgtagataggaaatttttacatttcttcacgttttccatagtttcctggattaaagtaaaaagatataagtgaaaaatcttaaaaggcagatttttgtcacagcctttggttactaaaatatgcatatgtacaaaagatacatatatttcttctctaaacttctttcaagaaaacgcaccacctctt

SEQ ID NO: 177095 - DNA, 601 bp, Human
ctcagctggtctgctccatggggagggggcttctggtggctcagggtgcagaatgcctgttccagccgggactgcggacacctgggaattttataagaggtcacacaggagtggggagagggccagaagggagttgctggagaccctgaccagagtgcagcatggttggggcagccagaggagaagagagccacagacaagggacgcaggcaccagaaaacggcaaagcccgggagacctccaggcgccggccccagaacacccagccccaggaaggagtctccttagctaggccacacamgccttcgacacgtgtgcacccctccccttcgcctgcagccttccagaggagctctccctgctggcacaggcctcccgggcacaggtcacagcagcaacaggtgtctgtcctatgcaacaggctttaggggaaagggaatgtaaagtcaaggtttctcaccagtaaattctgcacgagctctttcacattagctgctgtctctgtagactgcttgccagatgaagccagttttattaacgtagataggaaatttttacatttcttcacgttttccatagtttcctggattaaagtaaaaag

SEQ ID NO: 177096 - DNA, 601 bp, Human
caagagggccagatcctgtttcagaaacagaggccagtgtggaataaaggtcgggaagacaggcgacaaggcgggaaggcggtgcctggactgaaccctaagagactccggaagacatggtcaggcggacaaggagaaggcacggtaagaccagccactccagatccccaggccatcccactgacgccagcacagccctgagccacgagacagccatgaggctgaggaaggtggacagccgagagctcggccatgagtggagatctggagcttgggactgtgggttaaggagaggggaggytgccaggaatcctccctcccaccttccggccaggggacagagtgctgttctctgcgacagaggtttcgggaggggtgggggtgggggggacggctctgccactggagcgcgaatgtgcctcagctggtctgctccatggggagggggcttctggtggctcagggtgcagaatgcctgttccagccgggactgcggacacctgggaattttataagaggtcacacaggagtggggagagggccagaagggagttgctggagaccctgaccagagtgcagcatggttggggcagccagagga

SEQ ID NO: 177097 - DNA, 601 bp, Human
atgtgctgataccaatgattacccaacagagacagcctgacgctgttgaaacccttggtcctatccagttttgcaaacgctaccccattccccgtccccttcactttcaggaagcacacgcccttctcaccaccttgcgcacgacagaaccacaaggccacagtgtcaggggagctcctgctttacagaaaaaaaactaacattctgtccccaggcactgagtccccggccccacccccgtaggcagcacaagcgctgtgcaccctccgtgcctggagcatcctcgccctgcacacttggwgcatctgcgccccacccctccctggccctactgctcgcaggcaccggggcctttgaaattaccttcaggaaaggcacaaggtaaggttgaggtgaagaattaagttctcggtataacctgcttgtgaaatcttctgcttctatttttccatccttaaaaataaaatccatgttgaaattctggtgaatgagattccacacacacttctgaatcccgcatcactctggtctcgtattttacggctgattccgccccgagtttcactggacagaggagatgggaaagtctgcgtgctacacc

SEQ ID NO: 177098 - DNA, 601 bp, Human
gaagattctgaatgttcccaacacatggaaataagtactcaaggtgacagaccccaaatatcctgattctatctatgactgtaacaaaacatcacatacacctcataaatgtgtacaaatatacgtattgatttttaaaatgtgctgataccaatgattacccaacagagacagcctgacgctgttgaaacccttggtcctatccagttttgcaaacgctaccccattccccgtccccttcactttcaggaagcacacgcccttctcaccaccttgcgcacgacagaaccacaaggccacmgtgtcaggggagctcctgctttacagaaaaaaaactaacattctgtccccaggcactgagtccccggccccacccccgtaggcagcacaagcgctgtgcaccctccgtgcctggagcatcctcgccctgcacacttggtgcatctgcgccccacccctccctggccctactgctcgcaggcaccggggcctttgaaattaccttcaggaaaggcacaaggtaaggttgaggtgaagaattaagttctcggtataacctgcttgtgaaatcttctgcttctatttttccatccttaaaaat

SEQ ID NO: 177099 - DNA, 601 bp, Human
cctcgctattatcaagacaaaaacaaatgcaacttgaacagagcacaagagccagccccctaatggctactcctcacccagctggttctgatgtgtacaccatcacaacacataccagctcatgatgagggagcccgcaccattttgttgtttaagctgtctttagaggaagaaaacacctctgaaatttttttaaaactgcccctctacgtttggtgaatccctctgcccatgaaagggaatgtgctcaaaatgtaattcttctggcaaagacatcctttctctagctgcagagcaaacrtcatgactataaaaccaagaaagccagatccaaactgcacataagtgaaccgctatgagcagccgcggcttcgcctcccgggactcacctaaatccaccctgtgctgtgagctgctaccctgcctccagtctcctgcccacctgtcccacgcaggtgcccgtgtcttacgcttggaccgctgctcctaatccaagagaacatctatctacaagatcctctaaaagcacgctgcattcatttacaccagtaacatccccagacaaggcagggcggggacgtgccggtggttcaaagccaac

SEQ ID NO: 177100 - DNA, 601 bp, Human
ctccaacgaaacaggaacacccacactggacaggaagagcctcaggcagctcaggcaatgctcaggccaggccctgcggcgcagggaacctgccatcaaatgcccgggccaggccctgcggtgcagggagcctgtcatcgaatcagggagaagcctgggttctgcctccacaggcttcagggtgcaggcaatggattggatgccctggatcccactggctgtgctctgcagactcacacgtggtcaggaggagcccagggaagcagaatgcagaggtgatcctgctgccaaacacagcacytaattctaaaaacacccatgctgcttgtgtgtgactaagcaccagaggtcaaaacttggcaagaaaatgattgcccacaggctgtgcctgcttaaacagaacccacctttttgggtaaagtagctccactgactagtgaacagggaagttctgtccttacactaaagcaagaggcacggcacatctctttccctctggagtcaaaaggcaggcaaggaagccctctctttacacaggcgctcagcccttccctggcctttataagggacaccctccctccatgccatttcaccctgttct

SEQ ID NO: 177101 - DNA, 601 bp, Human
cactctcacctccggcacaaggcagagatccaaaacctggcagcactgaccatggcctatgctctggccctgtccccaggatgctggggcctagagacactggcatccttgtcaaaagccaatgctcaagtccataaggcctggcctcaaacctctgggcccaggtgtttcagaatttagtcgctaccattttgcaaaggtgccctggcaggtaaactctatgctgcagaacatgtgtggggacctggggaagcggcctataatgcaaacatgtctccaacgaaacaggaacacccacacyggacaggaagagcctcaggcagctcaggcaatgctcaggccaggccctgcggcgcagggaacctgccatcaaatgcccgggccaggccctgcggtgcagggagcctgtcatcgaatcagggagaagcctgggttctgcctccacaggcttcagggtgcaggcaatggattggatgccctggatcccactggctgtgctctgcagactcacacgtggtcaggaggagcccagggaagcagaatgcagaggtgatcctgctgccaaacacagcacctaattctaaaaacacccatgctgctt

SEQ ID NO: 177102 - DNA, 601 bp, Human
ttcctaagtcctgcctgaacttggccctcaagggcctccacccactgctcccagcatggccagctctgtccgcccagcccctgctgggcccctcgtggcagggtctgcccagctctgctgtcatcctgcctctcactctcacctccggcacaaggcagagatccaaaacctggcagcactgaccatggcctatgctctggccctgtccccaggatgctggggcctagagacactggcatccttgtcaaaagccaatgctcaagtccataaggcctggcctcaaacctctgggcccaggtgyttcagaatttagtcgctaccattttgcaaaggtgccctggcaggtaaactctatgctgcagaacatgtgtggggacctggggaagcggcctataatgcaaacatgtctccaacgaaacaggaacacccacactggacaggaagagcctcaggcagctcaggcaatgctcaggccaggccctgcggcgcagggaacctgccatcaaatgcccgggccaggccctgcggtgcagggagcctgtcatcgaatcagggagaagcctgggttctgcctccacaggcttcagggtgcaggcaatgg

SEQ ID NO: 177103 - DNA, 601 bp, Human
cttacacctcagcttcccgagcacctgggaccataggcacccaccatgtctggctaatttttgtaattttttttttgtagagatggggtttcaccacattggccaggttggtcttgaactcctaggctcaagcgatcctcccactttgacctcccaaagtgctgaattacaggcatgagctaccaaacccagctccctttctgaattttctgtaaggcggctgagggcttttctactggagtggggttagagttcctaagtcctgcctgaacttggccctcaagggcctccacccactgcycccagcatggccagctctgtccgcccagcccctgctgggcccctcgtggcagggtctgcccagctctgctgtcatcctgcctctcactctcacctccggcacaaggcagagatccaaaacctggcagcactgaccatggcctatgctctggccctgtccccaggatgctggggcctagagacactggcatccttgtcaaaagccaatgctcaagtccataaggcctggcctcaaacctctgggcccaggtgtttcagaatttagtcgctaccattttgcaaaggtgccctggcaggtaaa

SEQ ID NO: 177104 - DNA, 601 bp, Human
ctgctgacctcagcaacccaggatggagcagaccactgccccccaaatattagcagaggtgacattgttgcctggtggctacaggtcaagtggttctatctcatctgaattttcttttttcttttcttttctttttttttttttttttgagacaagtctcgctctgtcgcccaggctggagtgtagtggcatgatctcggttcactgcaacctctgccttccgggctcaagtgatcttacacctcagcttcccgagcacctgggaccataggcacccaccatgtctggctaatttttgtawttttttttttgtagagatggggtttcaccacattggccaggttggtcttgaactcctaggctcaagcgatcctcccactttgacctcccaaagtgctgaattacaggcatgagctaccaaacccagctccctttctgaattttctgtaaggcggctgagggcttttctactggagtggggttagagttcctaagtcctgcctgaacttggccctcaagggcctccacccactgctcccagcatggccagctctgtccgcccagcccctgctgggcccctcgtggcagggtctgcccagct

SEQ ID NO: 177105 - DNA, 601 bp, Human
tgctttccaggaggcccaggcaaagcacagcagttatttttctagaaacagggcctcactctgtcaccgacgctggcgtacactgctaaaaccatagctcactgtaacactgaactcctgggcagaagtgatcctcctgcctcagcctcccaagtagctaggcccacaggcacacaccaccaagcctggctaattttttattttttgttgttgttgagtaaggttttactatgttgtgcaggctggtctcaaactcccgggctcaagcgattctcccacttcagcctcctgtagtgctggsactgtaagcgtgagccactacgcctggagcagtacagcatttctgagggttctgaagttgaatacatggaaagtgaagcattctatactaggaatgcaatgaactcaaaatacgatgttatactaaaaaatgaatttcctattagttcatataaaaataatcagttgattcgctttctggctatgtgtatgaagcaaaacctctttgagccaactgtatgggaaaacacacttgtgtgaacgtgaggtcaaagtgagcgtgaagcaggagccttggagccccggccgccagggccacgtg

SEQ ID NO: 177106 - DNA, 601 bp, Human
tgggctgggactctggctcaggccacagccactccccaggcctgctatgccctgcctgatgcctttagggatgaagtgtctgggaaagggaaaattcacagtaagacttcctgaaatacacacaactccaccgccccttgatcacaacagagatcactccaagactctcccactgctcaggtcccataagcacctccctgactgaggtgatgctcagaccacctgctttccaggaggcccaggcaaagcacagcagttatttttctagaaacagggcctcactctgtcaccgacgctggcrtacactgctaaaaccatagctcactgtaacactgaactcctgggcagaagtgatcctcctgcctcagcctcccaagtagctaggcccacaggcacacaccaccaagcctggctaattttttattttttgttgttgttgagtaaggttttactatgttgtgcaggctggtctcaaactcccgggctcaagcgattctcccacttcagcctcctgtagtgctggcactgtaagcgtgagccactacgcctggagcagtacagcatttctgagggttctgaagttgaatacatggaaagtgaa

SEQ ID NO: 177107 - DNA, 601 bp, Human
gctccaggtgctcactcagggtcttggcatccctggtggtcacgggctgtggctgggctgcacagcttagggctccagctgaaggacccggccatgggagggaggctgctctgctgacatccacgtccacgtcatgcccatgtccactgctctctgacacaggacggtctccgctcatcttgtatttccttatcccagtcccgcaatcagccttttctctcaggagtccttgtcattttagtggaaaacggtttttagaagacaacatctgaacactaggtgtgctcagtgttactggggygttactgttcccaggaccctgcggtgaacaaagctagaaacttacggcaagacccatggttatccatgcctgccgacacactgaaacccaggggtttgcgtcagcattccaatcctgagccagcccacaggggtcactctcctttatcccttctgccaggccgctgactccttgacagcaaaataccaaggcttcctgcagccttgattaattctttcacccgtgtatgtccctaagtgccctcccttctcactgaagtatcagcatcacgctgggcccaggcatgctggccacctctcc

SEQ ID NO: 177108 - DNA, 601 bp, Human
tgaacgtgaggccgggggcctgcctggcgtctcctggggtcgttgtgtctcggggaagagctctacagcagttctcatgcccagtcctcctatgggctccaggtgctcactcagggtcttggcatccctggtggtcacgggctgtggctgggctgcacagcttagggctccagctgaaggacccggccatgggagggaggctgctctgctgacatccacgtccacgtcatgcccatgtccactgctctctgacacaggacggtctccgctcatcttgtatttccttatcccagtcccgcaatcagccttttctctcaggagtccttgtcattttagtggaaaacggtttttagaagacaacatctgaacactaggtgtgctcagtgttactggggcgttactgttcccaggaccctgcggtgaacaaagctagaaacttacggcaagacccatggttatccatgcctgccgacacactgaaacccaggggtttgcgtcagcattccaatcctgagccagcccacaggggtcactctcctttatcccttctgccaggccgctgactccttgacagcaaaataccaaggcttcctgcagcctt

SEQ ID NO: 177109 - DNA, 601 bp, Human
ttgagaccgggccatgatgaatggcccctccccaggccctcccccgtaggacccggtcccagcagcgcctctccctgcaggacagtctgcatcccaatcccagctgccacgtcttgtccggctcctcaagctggaaggttcctcagcctctcctgactcctgggctgcccctgacacctggaaggcacaggccagctgtgtgcaggacgtcctcttccaggctgacttcggccccctcgtgaggagatgtgagctaagagtcctgccgggaattccacatgcacgcagcctccacttgccrcctccagcagtgggctttgaacgtgaggccgggggcctgcctggcgtctcctggggtcgttgtgtctcggggaagagctctacagcagttctcatgcccagtcctcctatgggctccaggtgctcactcagggtcttggcatccctggtggtcacgggctgtggctgggctgcacagcttagggctccagctgaaggacccggccatgggagggaggctgctctgctgacatccacgtccacgtcatgcccatgtccactgctctctgacacaggacggtctccgctcatcttgtatttc

SEQ ID NO: 177110 - DNA, 601 bp, Human
cgcggggacttgtgggggtctgatctatgcaaagctttttaaagccagaggcagcattaaattctttttaaaggctcagaagttggaagaagagtacgcacaattttttcctgaatcacctgaaagttgctaacctgactttcctccacccggaacattctgcacgtgtttcctacagacaagggcatcccctccagaagcaggatgccattgagaccgggccatgatgaatggcccctccccaggccctcccccgtaggacccggtcccagcagcgcctctccctgcaggacagtctgcrtcccaatcccagctgccacgtcttgtccggctcctcaagctggaaggttcctcagcctctcctgactcctgggctgcccctgacacctggaaggcacaggccagctgtgtgcaggacgtcctcttccaggctgacttcggccccctcgtgaggagatgtgagctaagagtcctgccgggaattccacatgcacgcagcctccacttgccgcctccagcagtgggctttgaacgtgaggccgggggcctgcctggcgtctcctggggtcgttgtgtctcggggaagagctctacagcagtt

SEQ ID NO: 177111 - DNA, 601 bp, Human
tttgcttcaaggccagcccaaaacatgctctgaccacccaaaaccccactgtctcagtgagctcatcaggttgtggctgagacggaggtgcccagacggcagcagcagacacccagcactcgcctttgctgccctcatcaggatctcccgctcctgctcatccttcctctgcttttcgatttgatcaagctgttcaaaaaacttgagctgtgcccggacgtcactcgcctgctcatatctgtcgtcatcctatgaagaaagttaaaatactgcttgtcataaatctgagagcccagcaagyaaaggggttgtctagcaccactggaccatccgtgcacaacgccctccctccgtccagtctgaatgcggcgaggacccgatccctcccaccctgcaaatgctgcgcccgagagctctatcgatgctcacgtccacagaacgaagtctcgtgttggctgtctcaggggcacacttgtgggagagtgtcccttttatacactttgatgctgtcagatttcttaaagtaacatttaccttttttgctgcaacacagaactacttttacagcaagggctaagtgtgtttatttcagtgctgccct

SEQ ID NO: 177112 - DNA, 601 bp, Human
taatgagcagtgcctcgcctggctgtgaatgttctagaacaaggacaacgtgagtgtgaagagtccagtccagcgcacacagggggctctaggaacatgtgcttcacacctgggtgtgactgtgtggagcgtgaggtgctgggaatcttaagaagccccgcttttcaagcatctacgctagtgccaaatgaatgaggcttctctttgcagctccactgacagcacccatcacctttgcttcaaggccagcccaaaacatgctctgaccacccaaaaccccactgtctcagtgagctcatcrggttgtggctgagacggaggtgcccagacggcagcagcagacacccagcactcgcctttgctgccctcatcaggatctcccgctcctgctcatccttcctctgcttttcgatttgatcaagctgttcaaaaaacttgagctgtgcccggacgtcactcgcctgctcatatctgtcgtcatcctatgaagaaagttaaaatactgcttgtcataaatctgagagcccagcaagcaaaggggttgtctagcaccactggaccatccgtgcacaacgccctccctccgtccagtctgaatgcg

SEQ ID NO: 177113 - DNA, 601 bp, Human
ctaaacctcatcacagtaatcaaacttcctcacgaaaaagactttcagctcaagtgatagccacaaataagctgatttggatttaaaatgtcaaacgtaaaacaaatactccagaaaaggtgagacaaaatgtaaatggtaagaaagcaaattcccctatgtgtgtccgtcccctagaagagggtggctctaagatgttccccatgtttcccccaggacctcgatcccacaacactgccgtacctctgctcctgagcccggccccggacagtccactttcctctttttcctgggcccgatmgctgctagtgctgtgaggttggcgtcccgctgtctcatttgtgccagttcctgttgctgcatcttttattttgaaaaggagacaaggagcatcatttcttgcatgttttttacttactacaaaagtaatacatagatatgaaagggttttctgtagttttctaaatcataacttctttaatgttttgactttctcaatagtaagcatattctataatccaaaaaataagattttttttaatgcaacagatgtttgtcttaaaactctcagaaaatatacgcaagtcaaaagcacagagac

SEQ ID NO: 177114 - DNA, 601 bp, Human
tttacttaaaaaaaaacaactgacagttgaaagcaaaaataacatgtcaaggctgggtttataattattagactaaaagatacaaccacaaacatagacgagaaactaatggaatttggagaaacagcagcgggcagcaattcttccccttcattccacgaactgtccattctcctacagcagcttatcccacagacactgtgcaggaagcacaatcagcaagatccctattcagatcattcttctgacagttataacttccccacatccttttcaaatccagcctaaacctcatcacagyaatcaaacttcctcacgaaaaagactttcagctcaagtgatagccacaaataagctgatttggatttaaaatgtcaaacgtaaaacaaatactccagaaaaggtgagacaaaatgtaaatggtaagaaagcaaattcccctatgtgtgtccgtcccctagaagagggtggctctaagatgttccccatgtttcccccaggacctcgatcccacaacactgccgtacctctgctcctgagcccggccccggacagtccactttcctctttttcctgggcccgatcgctgctagtgctgtga

SEQ ID NO: 177115 - DNA, 601 bp, Human
aatgaagagtaccggagatggcaaataaggagggaaacataaaagaccgttttctttcttcctgtaatttacttaaaaaaaaacaactgacagttgaaagcaaaaataacatgtcaaggctgggtttataattattagactaaaagatacaaccacaaacatagacgagaaactaatggaatttggagaaacagcagcgggcagcaattcttccccttcattccacgaactgtccattctcctacagcagcttatcccacagacactgtgcaggaagcacaatcagcaagatccctattcrgatcattcttctgacagttataacttccccacatccttttcaaatccagcctaaacctcatcacagtaatcaaacttcctcacgaaaaagactttcagctcaagtgatagccacaaataagctgatttggatttaaaatgtcaaacgtaaaacaaatactccagaaaaggtgagacaaaatgtaaatggtaagaaagcaaattcccctatgtgtgtccgtcccctagaagagggtggctctaagatgttccccatgtttcccccaggacctcgatcccacaacactgccgtacctctgct

SEQ ID NO: 177116 - DNA, 601 bp, Human
aaaaaatcagcccagaattttgtaaccagtaaaaatatcctctgaaaatgagggtgaaggccaggcgtggtggctcatgcctgtaatcccagcactttgggaggccgaggtgggcagatcatgagatcaagagatcgagaccatcctggccaacatggtgaaaccccgtctctcctaaaaatacagaaattagcagggcgtggtggcacacgtctatagtcccagctactcgggaggctgaggcaggagaactgcttgaacctggcaggcggaggttgcagtgagccaacatcacgccacygcgctcccacctggcgacagagcaagactgtctcaaaaaaaaaaaaaaaaaagagaatgagggtgaaatacaatttttcaagtaaacaaaaccagagaatccatcaccagtagatctgcaccacaagaaatcccaacagctctccttcaagccaaaaggaaatggtggcagacggaaacagacccacgggaaggaatgaagagtaccggagatggcaaataaggagggaaacataaaagaccgttttctttcttcctgtaatttacttaaaaaaaaacaactgacagttgaaagcaaaaa

SEQ ID NO: 177117 - DNA, 601 bp, Human
cacccacagcactgcagtgagtgagtgaatgagggatcccggcacccacagcactgcagtgagtgagtgaatgagggatcccggcacccacagcactgcagtgagtgagtgaatgagggatcccggcacccacagcactgcagtgagtgagtgaatgagggatcccggcacccacagcactgcagtgagtgagtgaatgagggatcccggcacccacagcactgcagtgagtgagtgaatgagggatcccggcacccacagcactgcagtgagtgagtgaatgagggaccctggcatccayagcactgcagtgagtgaacgaatccatgagcgaacgaataaaccaacgaggaggggcgaagctctgcttcccagcagagggcaaccagcagtaacagaaggggtgcctgaagcatccccacgactgagcagccccaggggtggcgacacaggcaggcggttaataacattgaggctgtgggtggaggtgcgataagggtggggcatctgtgtgaggtgggaacgtgtgaaatgctaacacggccatgggaatcggccacgacgctgtggagaaacacagcccacagcaagtgctatgctg

SEQ ID NO: 177118 - DNA, 601 bp, Human
gacacatctgataatggactattatccaaaatataccaagaactcctgaaactcaacaatatcaacaataagctgctccgcatcctccgtcaccagggagatgcaaattaaaacaagatgcacacacctactagagcggccaaaacccagaacacggacagcaccgaacgctggcgaggatgtgaagaaacaggaccctcagccgtggctgctgggaaggcaacatggcgcggctgctggaagacagtctggcggtttcttacaaaactaaacgtgctcttaccacacggtccagcaatcrtgctccttggtatttacccaaaggggctgaaaatttatgtccacacgaaatcctgcgcacagatgtttataccagctttcttcataattgccaaaacttgcaagcagccacgatgtgcttcagtaggtgagtggataaaataaactgtggcacagccacacactggaatagtgctcagtgctgaaaagaaatgagccatcaagccatgaaaaaacacggaggaacctcaggtggatattcctaaatgagagaagccagtttgagaaggctgcataatttcaaccacatgatattctggaa

SEQ ID NO: 177119 - DNA, 601 bp, Human
ggagtaaccagccaaccccaccttaaccaagcttcaaagtcagcagcagcagcagcaacagccaggcgacaccacctgcctcccaatccagtgctctgaggacacgccagccggcccgcggcattctaactgagattctacagcctggacgtcatcacgaggagacaccagacaaacgcaaactaaggaaacgtccaccagacaaggaccagagctctccagcacgtcaaggccatcaaagaccaggaaagactgagcagctaccaccaagcagaggagaccaaggagccgaggagccgcragggtcccggggcaggaaaggacgtcgaggacactggtaagaatcgaataaggagaaaatatttgcaaaagacacatctgataatggactattatccaaaatataccaagaactcctgaaactcaacaatatcaacaataagctgctccgcatcctccgtcaccagggagatgcaaattaaaacaagatgcacacacctactagagcggccaaaacccagaacacggacagcaccgaacgctggcgaggatgtgaagaaacaggaccctcagccgtggctgctgggaaggcaacatggcg

SEQ ID NO: 177120 - DNA, 601 bp, Human
aatggagtaaccagccaaccccaccttaaccaagcttcaaagtcagcagcagcagcagcaacagccaggcgacaccacctgcctcccaatccagtgctctgaggacacgccagccggcccgcggcattctaactgagattctacagcctggacgtcatcacgaggagacaccagacaaacgcaaactaaggaaacgtccaccagacaaggaccagagctctccagcacgtcaaggccatcaaagaccaggaaagactgagcagctaccaccaagcagaggagaccaaggagccgaggagcygcaagggtcccggggcaggaaaggacgtcgaggacactggtaagaatcgaataaggagaaaatatttgcaaaagacacatctgataatggactattatccaaaatataccaagaactcctgaaactcaacaatatcaacaataagctgctccgcatcctccgtcaccagggagatgcaaattaaaacaagatgcacacacctactagagcggccaaaacccagaacacggacagcaccgaacgctggcgaggatgtgaagaaacaggaccctcagccgtggctgctgggaaggcaacatg

SEQ ID NO: 177121 - DNA, 601 bp, Human
ggcagctctctttacagaattccaattaataaatgtaaacagaaagacagaaatagaaagtcagcatcagacgccacagcagcctccactggcagcgtccttgcgaatgcccacgcaggggccaaaggcctgataagaaatggtatcagcagcctccaagtgtctccttgagatacctactaattacacagagaaaaagagtaactcgacaatggagtaaccagccaaccccaccttaaccaagcttcaaagtcagcagcagcagcagcaacagccaggcgacaccacctgcctcccaatmcagtgctctgaggacacgccagccggcccgcggcattctaactgagattctacagcctggacgtcatcacgaggagacaccagacaaacgcaaactaaggaaacgtccaccagacaaggaccagagctctccagcacgtcaaggccatcaaagaccaggaaagactgagcagctaccaccaagcagaggagaccaaggagccgaggagccgcaagggtcccggggcaggaaaggacgtcgaggacactggtaagaatcgaataaggagaaaatatttgcaaaagacacatctgataatgg

SEQ ID NO: 177122 - DNA, 601 bp, Human
aaacagaagatgtgctggaacattctgtggtgtcataaagtcaccaaatcctcttgtcgtgtcacaaggacatggaactaacctgaaggagctcatgatggccagagccgggctgctcaagcaacaaaataaataaactgtagcagcagcttgttacctacagaaaaaaataaatatccatgctaatataagtaagtaactgaatgaattaacaagtgggaaaaataagggagacggggcagctctctttacagaattccaattaataaatgtaaacagaaagacagaaatagaaagtcarcatcagacgccacagcagcctccactggcagcgtccttgcgaatgcccacgcaggggccaaaggcctgataagaaatggtatcagcagcctccaagtgtctccttgagatacctactaattacacagagaaaaagagtaactcgacaatggagtaaccagccaaccccaccttaaccaagcttcaaagtcagcagcagcagcagcaacagccaggcgacaccacctgcctcccaatccagtgctctgaggacacgccagccggcccgcggcattctaactgagattctacagcctggacg

SEQ ID NO: 177123 - DNA, 601 bp, Human
agcaatgcccctccaagaaatcatggaaaacagaagatgtgctggaacattctgtggtgtcataaagtcaccaaatcctcttgtcgtgtcacaaggacatggaactaacctgaaggagctcatgatggccagagccgggctgctcaagcaacaaaataaataaactgtagcagcagcttgttacctacagaaaaaaataaatatccatgctaatataagtaagtaactgaatgaattaacaagtgggaaaaataagggagacggggcagctctctttacagaattccaattaataaatgtmaacagaaagacagaaatagaaagtcagcatcagacgccacagcagcctccactggcagcgtccttgcgaatgcccacgcaggggccaaaggcctgataagaaatggtatcagcagcctccaagtgtctccttgagatacctactaattacacagagaaaaagagtaactcgacaatggagtaaccagccaaccccaccttaaccaagcttcaaagtcagcagcagcagcagcaacagccaggcgacaccacctgcctcccaatccagtgctctgaggacacgccagccggcccgcggcat

SEQ ID NO: 177124 - DNA, 601 bp, Human
gcctctctcacacgcaacagggggacttggcaaaacctaacacaagtgcacacgcaccaacccctcaattcagcaatcccatctctcggaactcagccccaacagcaggcctccaacagcacgaagacacacgtacaaggcgactcttgatggcatcacctgtcaccgtgtcgacagcccagatgtgcacacgagagagggtgaaaagctacgggacatcagcaggatgaagtgccacccagctgggaaagaggaagctcctgatgcagtgacacgagggcagtgcccgggacatcagcasgatgaagtgccacccagctgggaaagaggaagctcctgatgcagtgacacgagggcagtgcccgggacatcagcacccagctgggaaagaggaagctcctgatgcagtgacacgagggcagtgcccgggaactctgtcagctgcagagagcgagagactgtcactgacctgtgctgcactgccagggaaggaaaaagatgcaggagctcatctgtttgcatggtgagtagaaacgggatgcaaaaatggagggacggggacagggcaggaggagggaaggtgcagcaggactagggaggg

SEQ ID NO: 177125 - DNA, 601 bp, Human
acccagggtgacggtctgacgtgtgacaaagacagatactttctaatgcaaaaagtcacagctgccaatgaagatatgacacgtggatatttatgcaccaaacaacacagcagcccctaccaataaaaacgcaggagatgcgacgagacagaaacatgctagcagcagtcatggaacagcatgcctgccgcagaacaggtcaagtggacaaaactaagccagcagccggaagactgagcgacctcatcactgaggagcggctcggggatgtccacccgctcatcacgtgcctcagccctaygcacccacagcacacccacagacgctgactgcaccacccagaccagcaaacacaagaactatgacaacacacgtgggacacgtgtgaggctggggaaagagctgcctctctcacacgcaacagggggacttggcaaaacctaacacaagtgcacacgcaccaacccctcaattcagcaatcccatctctcggaactcagccccaacagcaggcctccaacagcacgaagacacacgtacaaggcgactcttgatggcatcacctgtcaccgtgtcgacagcccagatgtgcacacgagag

SEQ ID NO: 177126 - DNA, 601 bp, Human
ggatctcagggattgtaggctgggggacaagaaagacacccagggtgacggtctgacgtgtgacaaagacagatactttctaatgcaaaaagtcacagctgccaatgaagatatgacacgtggatatttatgcaccaaacaacacagcagcccctaccaataaaaacgcaggagatgcgacgagacagaaacatgctagcagcagtcatggaacagcatgcctgccgcagaacaggtcaagtggacaaaactaagccagcagccggaagactgagcgacctcatcactgaggagcggctcrgggatgtccacccgctcatcacgtgcctcagccctacgcacccacagcacacccacagacgctgactgcaccacccagaccagcaaacacaagaactatgacaacacacgtgggacacgtgtgaggctggggaaagagctgcctctctcacacgcaacagggggacttggcaaaacctaacacaagtgcacacgcaccaacccctcaattcagcaatcccatctctcggaactcagccccaacagcaggcctccaacagcacgaagacacacgtacaaggcgactcttgatggcatcacc

SEQ ID NO: 177127 - DNA, 601 bp, Human
acgccaccaaactccagcctgggtgacagtgaaaccatgtctcaaaagatagataaaaatttacataattataaaatattatgatagagtcaagacaaaacatgtcagtcctatcaataaaggtaaatgggcttaactcacctattaaaagagaaagattttcaattcagctcataaactgagaccaaaccatatgctacagagagacacggaaaacaaagtgattcagaaggtgaaaagtaaggatctcagggattgtaggctgggggacaagaaagacacccagggtgacggtctgacrtgtgacaaagacagatactttctaatgcaaaaagtcacagctgccaatgaagatatgacacgtggatatttatgcaccaaacaacacagcagcccctaccaataaaaacgcaggagatgcgacgagacagaaacatgctagcagcagtcatggaacagcatgcctgccgcagaacaggtcaagtggacaaaactaagccagcagccggaagactgagcgacctcatcactgaggagcggctcggggatgtccacccgctcatcacgtgcctcagccctacgcacccacagcacacccaca

SEQ ID NO: 177128 - DNA, 601 bp, Human
accttcctaaatacaaaaaaaaaaaaaaaatcaattaaaagagcaaagaataaacatctcacagaaaaagaaacacagcaaatatttaaaattcaggccaggtacggcaactcacacctgtaatctcaatgctttgaaaagggaggccaaggcaggaggattccctgaggctgggagtttaagaccagcctgggcaacataacgagaccccattcctacaaaatattttaaaaattagtcagatgcggtgctgtgtgcctgtagtcccaggctactggggcggctgaggcaggaggatccytcttaagcccagaaagtcaaagttgcagtgagctatgatcacgccaccaaactccagcctgggtgacagtgaaaccatgtctcaaaagatagataaaaatttacataattataaaatattatgatagagtcaagacaaaacatgtcagtcctatcaataaaggtaaatgggcttaactcacctattaaaagagaaagattttcaattcagctcataaactgagaccaaaccatatgctacagagagacacggaaaacaaagtgattcagaaggtgaaaagtaaggatctcagggattgta

SEQ ID NO: 177129 - DNA, 601 bp, Human
actagtttaagtacaaaagtaaccaggaagacacagatacaaaccttcctaaatacaaaaaaaaaaaaaaaatcaattaaaagagcaaagaataaacatctcacagaaaaagaaacacagcaaatatttaaaattcaggccaggtacggcaactcacacctgtaatctcaatgctttgaaaagggaggccaaggcaggaggattccctgaggctgggagtttaagaccagcctgggcaacataacgagaccccattcctacaaaatattttaaaaattagtcagatgcggtgctgtgtgcytgtagtcccaggctactggggcggctgaggcaggaggatccttcttaagcccagaaagtcaaagttgcagtgagctatgatcacgccaccaaactccagcctgggtgacagtgaaaccatgtctcaaaagatagataaaaatttacataattataaaatattatgatagagtcaagacaaaacatgtcagtcctatcaataaaggtaaatgggcttaactcacctattaaaagagaaagattttcaattcagctcataaactgagaccaaaccatatgctacagagagacacggaaaaca

SEQ ID NO: 177130 - DNA, 601 bp, Human
gtggtgaggcagaaaagaaggaaagggggaagttctgggtcctgcaggaaagggccgggagaactggaggacaacttccgtcctgcacaccagcaaggacccgctcaagacctggacttccccatgtggccagcagacggcaccaggaaaccacagatgtggcaaataccccaaggccaccagggcaaagggacagaggcggtaaagccacccagagccacgggaaagtcagagaagagtcaaaaaatgggggctccacacacatcagagaaaaacctaccctggaacaacaagaaaattmacaacactctcaatacaggaaaatctgcttaagtgtgcacttaaggatatgaaaatcatcacctcaaatcagaacctcaaaaactaggagacaaatttttataaaaaccataaaattacaaatgcaacaccaaaaggaaataagagttgactggacttaagaaagtaatggaaggaagagacaaaattatctcagaaatgaataaactgcaaacagtctgagggaggggaggcggtgaaaatgcagtaaggaacctacgaaaggcaggaagccaagaggacagaatcgagacacagaaag

SEQ ID NO: 177131 - DNA, 601 bp, Human
aggcagggactggtcatggagcctgcttggagaagagtgcttagtgggggcttccagctccatgggactcctgagaaagaagggcctgtggggaccagggtcaaggcacccatggccactctagagggactgcggcccgtgcaggcgcaatggccactccagagggactgcggcccgtgcaggcgccatggccactccagagggactgcggcccgtgcaggcgccatggccactccagagggactgcggcccgtgcaggcgccatggccactccagagggactgcggcccatgcaggcgckacggcctctagagggactgtggcatgtgcaggcgccatggccactccagagggactgcggcccgtgcaggcgccatggccactccagagggactgcggcccgtgcaggcgcgatggccactccagagggactgtggcccgtgcaggcgcggtggccactccagaggtactgcggcatgtgcaggcgccgtggccactccagagggactgcggcatgtgcaggcgccgtggccactccagagggactgcggcccgtgcaggcgccgtggccactccagagggactgcggcccgtgcaggcg

SEQ ID NO: 177132 - DNA, 601 bp, Human
accaagggagggcgcgagaccaaccaagggagggcgcgagaccaaccaagggagggcgcgacaccaaccaagggagggcgcgacaccaaccaagggagggcgcgacaccaaccaagggagggcgcgacaccaaccaagggagggcgcgacaccaaccaagggagggggcgagaccaaccaagggagggcgcgacaccaaccaagggagggcgcgacaccaaccaagggagggcgcgacaccaaccaagggagggcgcgagaccaaccaaggccgggggcgagaccaaccaaaggagggggygagaccaaccaaggccgggggcgagaccaaccaaaggagggggcgagaccaaccaaggccgggggcaagacgaaccaaggccgagggcgagaccaaccaaggccgggggcgagaccaaccaaggccgggggcgagaccaaccaagggagggggcgagaccaaccaaggccagacggtgcctccttggggctgaggccacccccagggcccagcacgctgagaaactgatgccaggccctgcttctgcaccaagctctgaaggtgcactatgaatgaacaatataacttctccagattctg

SEQ ID NO: 177133 - DNA, 601 bp, Human
tgctcaatttaaaggctgccgagggtaagaaatcaagatattctaacgcaagtgtcagcaccaaccaagggagggcacgagaccaaccaagggagggcgcgagaccaaccaagggagggcgcgagaccaaccaagggagggcgcgagaccaaccaagggagggcgcgagaccaaccaagggagggcgcgacaccaaccaagggagggcgcgacaccaaccaagggagggcgcgacaccaaccaagggagggcgcgacaccaaccaagggagggcgcgacaccaaccaagggagggggcgasaccaaccaagggagggcgcgacaccaaccaagggagggcgcgacaccaaccaagggagggcgcgacaccaaccaagggagggcgcgagaccaaccaaggccgggggcgagaccaaccaaaggagggggtgagaccaaccaaggccgggggcgagaccaaccaaaggagggggcgagaccaaccaaggccgggggcaagacgaaccaaggccgagggcgagaccaaccaaggccgggggcgagaccaaccaaggccgggggcgagaccaaccaagggagggggcgagaccaaccaaggcca

SEQ ID NO: 177134 - DNA, 601 bp, Human
tcaggtgctcaatttaaaggctgccgagggtaagaaatcaagatattctaacgcaagtgtcagcaccaaccaagggagggcacgagaccaaccaagggagggcgcgagaccaaccaagggagggcgcgagaccaaccaagggagggcgcgagaccaaccaagggagggcgcgagaccaaccaagggagggcgcgacaccaaccaagggagggcgcgacaccaaccaagggagggcgcgacaccaaccaagggagggcgcgacaccaaccaagggagggcgcgacaccaaccaagggagggsgcgagaccaaccaagggagggcgcgacaccaaccaagggagggcgcgacaccaaccaagggagggcgcgacaccaaccaagggagggcgcgagaccaaccaaggccgggggcgagaccaaccaaaggagggggtgagaccaaccaaggccgggggcgagaccaaccaaaggagggggcgagaccaaccaaggccgggggcaagacgaaccaaggccgagggcgagaccaaccaaggccgggggcgagaccaaccaaggccgggggcgagaccaaccaagggagggggcgagaccaaccaa

SEQ ID NO: 177135 - DNA, 601 bp, Human
aaggagagacgctcatctcaggtgctcaatttaaaggctgccgagggtaagaaatcaagatattctaacgcaagtgtcagcaccaaccaagggagggcacgagaccaaccaagggagggcgcgagaccaaccaagggagggcgcgagaccaaccaagggagggcgcgagaccaaccaagggagggcgcgagaccaaccaagggagggcgcgacaccaaccaagggagggcgcgacaccaaccaagggagggcgcgacaccaaccaagggagggcgcgacaccaaccaagggagggcgcgasaccaaccaagggagggggcgagaccaaccaagggagggcgcgacaccaaccaagggagggcgcgacaccaaccaagggagggcgcgacaccaaccaagggagggcgcgagaccaaccaaggccgggggcgagaccaaccaaaggagggggtgagaccaaccaaggccgggggcgagaccaaccaaaggagggggcgagaccaaccaaggccgggggcaagacgaaccaaggccgagggcgagaccaaccaaggccgggggcgagaccaaccaaggccgggggcgagaccaaccaagggag

SEQ ID NO: 177136 - DNA, 601 bp, Human
ggggcgcgcgccacacacacacaacaccgcccagcggggcgcgcaccacacacacacgacaccgcccagcggggcacgtgccacacaactcccaacagctgtcatttcccccagctggcatgaaaactaagttctgctccgatggtgaaagctgctcacatatatttaagtacaaagattacgatggcatctttacagcacattctcaaccaaagttaagatgctggaaggagcggattctgctgtgtgtgccagtgggagccttgctgtgaacagccctgacatggccccgcccctcatsccgtccttcctccccccttccccgttctgccactttcagttcaggctgggagcatggctgccttgtgtgatggcatgcaagtgtgtctctgacccactgcattttctttattcctgtgagattcaaacagatgagggcacctgtctccgttcagacgccctgcgctgtgagggcccttcttcagacctgcccggggtccctttgctactgaagcctccgcactccacactagctcattataaagtgatccgcacctgagggccaggcctcccaaaagagaactcaggcgaggtgagtgac

SEQ ID NO: 177137 - DNA, 601 bp, Human
tgaggctgacagagggaagccacacagctgaggcagaggagaggggcgttgactacaggctggccctttactcacgagacgggggtaataagcccccacagaggagacagatctgagagggggcctgtggcccccagccacgcagcatgggcaggctgtgggggggtggtctgaggttcacagggcacctggagcctcccctgccagaacggcaaaatctcagctggggacactcagccaggccctctgtggtgaggtgtggcagcaggtaaggagacagtcacaggccctccgtcctgaracccggcccctctgagttgaccagataagggggcagccaggaggcacccaggttcccacagctaacccccgctggaccctgttctggctggggggctccaagcaggtgtcagcagctttccagggctcagatcccccatctgaagtgtgggcttgagacctcctatctcagaggactgtgctgggcttaaggagagaacggtgagcccagaagcctggggaggctccttccccctccaccagggccaagggggtggggcaggcagagggggcgggcccagcccaggctcctccattcatc

SEQ ID NO: 177138 - DNA, 601 bp, Human
agaccggccggcaaggacttctcacacgcccaatccgcggccagggcggtcagcagacccgcggctctcagatgaaggaggcatccaaggtcatacccgtccagctcacgtctaccagctgatctttctacatatctggcagcctcagcgggcactcactgctcagagctcgagactttggaagcgaagggttcacctctattgctagacatgagctgggcgaggccggctggtttctcatccaagctggctctgaggcatggagcaccacagcccacagctgccactgaaactgtggccrcttcccaggctcctcgggccaagctcacagtctcaggtgaggcgggccagcacgctgtgcccattttaaagacagcttgaggctgacagagggaagccacacagctgaggcagaggagaggggcgttgactacaggctggccctttactcacgagacgggggtaataagcccccacagaggagacagatctgagagggggcctgtggcccccagccacgcagcatgggcaggctgtgggggggtggtctgaggttcacagggcacctggagcctcccctgccagaacggcaaaatctcag

SEQ ID NO: 177139 - DNA, 601 bp, Human
ctgcccagtccccaccttcccaggctgggccggccagggatcccctgatgcccacctggggctgtgagggccacaacctccccctgccctctgcctgctccagctgcccagcagggttcaccccgacccccatctgggatgcccagctaatgtgcatctcctacagagggtccctgagagcccctggcctgcagccttgagaacacactgcccagccccaggccccatagccttagtgagccccctcagatggagctgcggcttcatcgcctgggcacctcctgtgcctgcctgccttgcyccaaccgcagctccactccagaccggccggcaaggacttctcacacgcccaatccgcggccagggcggtcagcagacccgcggctctcagatgaaggaggcatccaaggtcatacccgtccagctcacgtctaccagctgatctttctacatatctggcagcctcagcgggcactcactgctcagagctcgagactttggaagcgaagggttcacctctattgctagacatgagctgggcgaggccggctggtttctcatccaagctggctctgaggcatggagcaccacagcccacagc

SEQ ID NO: 177140 - DNA, 601 bp, Human
ggatcaatgtgtctagagccaaagggagcaagaaggggcaggagtaaggcaaagcatggctacccctccctgctggccctgccaggggctccagagaggcttggacaaaatgcagcaagccagggggcggaagggggagctgcagacagaaggaccgtcagggccgggatccaggcggccagaccccgccccacctccagatcttgcccacagccttctggattagggtctccagagagacagaattaagctgttccggaggcctgtggggaccggccccagagtggacgtgtggacagcrgcaggtgggcctgggcctcctggctgctgcttccgagtcctgggaagaggccaagtcacagtaactgctgagcctcaatgtccccatccaaagagtggggataaggctgcacctgcctggggccaccgtgaggagtaatggctcacacacacagcctggcagccgcttctgtcccgggcctgccatctgctgggggcctgtcctgcatgggtgagtggggaagagaggaggctcccagcagaatcctggcctgcatcctggcaggggaggggtagtgctgggagccggggcagggatgag

SEQ ID NO: 177141 - DNA, 601 bp, Human
gcggggtggcgtctgagcactacgtggtaagggggggggtgtgctctaggcagagggggtgccagtgcaacgagccctgggggcaggaagagtctcacagtaaaccacaaggtggatcaatgtgtctagagccaaagggagcaagaaggggcaggagtaaggcaaagcatggctacccctccctgctggccctgccaggggctccagagaggcttggacaaaatgcagcaagccagggggcggaagggggagctgcagacagaaggaccgtcagggccgggatccaggcggccagaccccsccccacctccagatcttgcccacagccttctggattagggtctccagagagacagaattaagctgttccggaggcctgtggggaccggccccagagtggacgtgtggacagcggcaggtgggcctgggcctcctggctgctgcttccgagtcctgggaagaggccaagtcacagtaactgctgagcctcaatgtccccatccaaagagtggggataaggctgcacctgcctggggccaccgtgaggagtaatggctcacacacacagcctggcagccgcttctgtcccgggcctgccatc

SEQ ID NO: 177142 - DNA, 601 bp, Human
ctgtggggactccccccaccaagtccttcgtgtccagcctcccaggccccaggtctcgctcacggtggagacctcgccttctggtcctgtggcccaaggtaggcccgacgggcacagacacagagatgggggctgcagcacgcaaagaagggtccctacctggcccaggtccagggtgacgttgacctcgttgtactccaggccgcgggacagcggtggactctgccaccagcgctccgtgccatcgatggcattgctcgcggggtgtgccttgttgctgttggcagccgtgcagatgtcrcagtactggccctgcagagggaacgggagggtcagatagccgagaagggccggggcccccttcctcctccacagtcaccctgctgccccgagacaagtcctggtcccactgagctggttccacgcccagcctctgcgcccctcatccacttgctcagcaaacatgcgccaagcacctgctgctcctccgactcaggggatgtggctcatgtgagctgctcacggcgctaaggacaagaggaagaccagggtggagaggggcatctgccttgggtgggaaaatctcggtgggcctctctag

SEQ ID NO: 177143 - DNA, 601 bp, Human
aggcctctgggtcagccctggggcccccactccaggcactggctgctctcaggcccagcctcctccacctgccccaccactgtccctgacctaagaagcaccaggattactggcccattttacaggccaggacctcaaggctgggtacccgggccaagtcgcccccaatctgggggtgctcagggctggcagccaggcaggcccaccttgggggtttcactcttcgcttggaggcacccagctgcagcctcctgcttgtgcaggggcctccaaggccaaggagagcccagagctggggacyggagagcaggcacccgaccccacctaaccctcagtggccgccacctcggcacaggtatcccaggaatgtccacttgcgccagcctcctctgcattcctgcagcccctcccgcacctgccaggaattccttaaacagcagggcgcctgacgcagggggcaccaccgcactgctcacagcacctccgccctcccagccccaagctgtctactcagcacccgcaaccaaactctgtggcctttggaaacacccccatgagcacccgctttccctgtgtcatggggacgctgaaagcacaaaca

SEQ ID NO: 177144 - DNA, 601 bp, Human
ccccctagaaggaccccctggggaaggtcacgtctggaactcggaaactgccccctgagtcaccagtgaccagcgctggagcctcttcctgaggccccacccttggagagagaacccctccacggctgggcgcagcgggacccaggccaggagcccagctggcactcccgggggcccaggctcagctgcttctgggtggacaccacagggactagtctcccctcccctgcgccagcccctgccccaccgcacaccaggggtatgagatccgaaccgtgatgcagcccaccccgccctcctyagccttccaggagcaggaagccttcccgatgcccagtgccagccgcccccacccccgtcccagggcatccgctccagatcccagaacaaaggctgctggcagcccgctgcagggggagtgcccggacccacccgccgctcagcctggcttcctgatggaggccccagccccgccccaggatcagccctgaagcccaggaaggacatttccccaccccactccagggagtccctgcccccaccctgaccaaggctggcagccccctggcctaggccgagacaggggccttggtagatacat

SEQ ID NO: 177145 - DNA, 601 bp, Human
cgcaagaaccccctagaaggaccccctggggaaggtcacgtctggaactcggaaactgccccctgagtcaccagtgaccagcgctggagcctcttcctgaggccccacccttggagagagaacccctccacggctgggcgcagcgggacccaggccaggagcccagctggcactcccgggggcccaggctcagctgcttctgggtggacaccacagggactagtctcccctcccctgcgccagcccctgccccaccgcacaccaggggtatgagatccgaaccgtgatgcagcccaccccrccctcctcagccttccaggagcaggaagccttcccgatgcccagtgccagccgcccccacccccgtcccagggcatccgctccagatcccagaacaaaggctgctggcagcccgctgcagggggagtgcccggacccacccgccgctcagcctggcttcctgatggaggccccagccccgccccaggatcagccctgaagcccaggaaggacatttccccaccccactccagggagtccctgcccccaccctgaccaaggctggcagccccctggcctaggccgagacaggggccttggt

SEQ ID NO: 177146 - DNA, 601 bp, Human
gctggtgtagtggggcaagggcctggaccctgcggcagagccagggggtgggggagctcaagccaggacccgctggccatgtgcctgggcagtcatgaacgcgctcacccttccctgggcctggggcctggggcctgggtgtggttctcggaagaaggagcctgaggccagtgatgtggccgctcagttccagaagcttccggaggatgcaaggagatacgcaagaaccccctagaaggaccccctggggaaggtcacgtctggaactcggaaactgccccctgagtcaccagtgaccagygctggagcctcttcctgaggccccacccttggagagagaacccctccacggctgggcgcagcgggacccaggccaggagcccagctggcactcccgggggcccaggctcagctgcttctgggtggacaccacagggactagtctcccctcccctgcgccagcccctgccccaccgcacaccaggggtatgagatccgaaccgtgatgcagcccaccccgccctcctcagccttccaggagcaggaagccttcccgatgcccagtgccagccgcccccacccccgtcccagggcatccgct

SEQ ID NO: 177147 - DNA, 601 bp, Human
cctggcttcgggaccgcccttccccctccacgccccgctcagctcagctgccagtgctgacctttccgctgctacatggttctgtgcagaaagaaaaaaaaaagtcttttaaagcaaaagccaaacaaaagctgcctgagttatttttaaaaatcggctattttggggcaggcacgtctccaggacggcagccggacccgcctctcagccactgcaccctccagtccccactacccagcttgccctgggagggccacggttcccagaggaggcctctgcccggtgaccactgcctcacagsgggtgggcaagagccccaggagtacggggcccaggacccagggcccaggccggctccaggcttcaggggttgtgtggccctggagcggacacttccccttcctgggcacagggcagtgggaagagctgcagagaggggcatcaggataaaatgcctttcatgagggcatgaaggtttgagcgccctgggagggaggacgccagctgctcctggagggcagcagccaccccgcagagacgctgagaggcccccactggagctgccccactcactggcgctccgaaggcaaagctgcggagg

SEQ ID NO: 177148 - DNA, 601 bp, Human
gggggcggtgcccaagcagcaccccgccttcacactcatgcaagccagggctcagcccctgctgcagccaagtgctcccacccgccatagcctctgaggggagccctaggctccccctacctgggggcaaaggagggaagttgtctccaggccctgtcacaagcctggaggctccaagggagggtgagcccctccccagcccctctcaaacaaaggggaaagggctctcccaggcagaggctccacagggacctggcagggaggcggaggaaacacgaacctctcccccgcctgtgcgagkaggcccgggtgccgggggagagaggcaactcatggacccacagcacaggtgtggcctgcctgtcccggcccacacctcccctgacgggcccacagggtccacgatggagaccttgggagacctcagtactcagcccaactctttgtgggcggcagtggggaccagcccctcctctgctcacaggtgggcccccaggtgggccctaaaaaggccagcaggcctccgagggtcatgccacaccccagggccacccaccacacctcctcgggaccctgacccgccagtgcccactcctccgga

SEQ ID NO: 177149 - DNA, 601 bp, Human
accgtgggcctccatgcctgcacctgggggtgcacacacacccgcccaacagtgaaacaccgtgggggtggctcctccatggacccaggccacaggccccctctgaaaaggtctctggtccctaaaaacagcccatggcctcaatggcaagaggctgcacccaggagcagggggggtcccgaggcacacaggagggggcggtgcccaagcagcaccccgccttcacactcatgcaagccagggctcagcccctgctgcagccaagtgctcccacccgccatagcctctgaggggagccctrggctccccctacctgggggcaaaggagggaagttgtctccaggccctgtcacaagcctggaggctccaagggagggtgagcccctccccagcccctctcaaacaaaggggaaagggctctcccaggcagaggctccacagggacctggcagggaggcggaggaaacacgaacctctcccccgcctgtgcgaggaggcccgggtgccgggggagagaggcaactcatggacccacagcacaggtgtggcctgcctgtcccggcccacacctcccctgacgggcccacagggtccacgatgg

SEQ ID NO: 177150 - DNA, 601 bp, Human
cccccagggactgggctgcagggagcaagcggggctcagccttgcaggctgggggccctcttgaagctgagtctgcctcggagactccaccagcccaggcactggggcagtagcactgctgtggcccggtgcacgtcagggcagccctgcccagggcagaggaaagctgctccttcccaggcccccgaaaccccaagcccctgccccagccccaccttggctctgcctactttctccccgtgtgtcagcctgacctccacccagggacagcccatgtgtctgtgcctcggggctgggggasagcctggctcagtcttcacaggacgctttgtacacctcctcagagaagccttccctgactgcagcccctccccctaaccctcagctgcggacatctccccaggcccaggcccttctctccgcacaggccaggcctgctgactcccctcaggcctctgatcagcctgggcttccctccctccctccctccctccctacccatcccctgacaccctgccctcaggactccaggcctgagcctctcctgcccccagcagtcagtgctacccagcctcatatctgcacccacccgacatgaccg

SEQ ID NO: 177151 - DNA, 601 bp, Human
ctctgacaggtcagcagctcctaagatggggcccctgcccccacctcacaccgggcacccctccccaggctctgctcactcccatgctgaccagcccacagccaggggcccactgagcccccagggactgggctgcagggagcaagcggggctcagccttgcaggctgggggccctcttgaagctgagtctgcctcggagactccaccagcccaggcactggggcagtagcactgctgtggcccggtgcacgtcagggcagccctgcccagggcagaggaaagctgctccttcccaggccyccgaaaccccaagcccctgccccagccccaccttggctctgcctactttctccccgtgtgtcagcctgacctccacccagggacagcccatgtgtctgtgcctcggggctgggggagagcctggctcagtcttcacaggacgctttgtacacctcctcagagaagccttccctgactgcagcccctccccctaaccctcagctgcggacatctccccaggcccaggcccttctctccgcacaggccaggcctgctgactcccctcaggcctctgatcagcctgggcttccctccctccct

SEQ ID NO: 177152 - DNA, 601 bp, Human
aggcaggtccaaaggtccaaccccctagtccctctgacaggtcagcagctcctaagatggggcccctgcccccacctcacaccgggcacccctccccaggctctgctcactcccatgctgaccagcccacagccaggggcccactgagcccccagggactgggctgcagggagcaagcggggctcagccttgcaggctgggggccctcttgaagctgagtctgcctcggagactccaccagcccaggcactggggcagtagcactgctgtggcccggtgcacgtcagggcagccctgcccmgggcagaggaaagctgctccttcccaggcccccgaaaccccaagcccctgccccagccccaccttggctctgcctactttctccccgtgtgtcagcctgacctccacccagggacagcccatgtgtctgtgcctcggggctgggggagagcctggctcagtcttcacaggacgctttgtacacctcctcagagaagccttccctgactgcagcccctccccctaaccctcagctgcggacatctccccaggcccaggcccttctctccgcacaggccaggcctgctgactcccctcaggc

SEQ ID NO: 177153 - DNA, 601 bp, Human
tccctgccgcaggagtttggggttcccccatggtcctgcaagctctgtggctgcagatggagcaagctagggagaggcctacctgcggcccaggcagggactggccagggtggaggcaggaacacaccccagtgtccccacagccctcacgtccagccaggcctggtggccagacagtggtccctgccaccaggcaggtccaaaggtccaaccccctagtccctctgacaggtcagcagctcctaagatggggcccctgcccccacctcacaccgggcacccctccccaggctctgctcastcccatgctgaccagcccacagccaggggcccactgagcccccagggactgggctgcagggagcaagcggggctcagccttgcaggctgggggccctcttgaagctgagtctgcctcggagactccaccagcccaggcactggggcagtagcactgctgtggcccggtgcacgtcagggcagccctgcccagggcagaggaaagctgctccttcccaggcccccgaaaccccaagcccctgccccagccccaccttggctctgcctactttctccccgtgtgtcagcctgacctccaccc

SEQ ID NO: 177154 - DNA, 601 bp, Human
ccgcacagggggcacctctgggtttgcctgtgtggggcagacgaacccaggggagagggctccccagggatggagatgagcccccgggaaccagccctcctggaagggctccccgcctgggctcgggaccaacgcgctgcctcctccccttccctgccgcaggagtttggggttcccccatggtcctgcaagctctgtggctgcagatggagcaagctagggagaggcctacctgcggcccaggcagggactggccagggtggaggcaggaacacaccccagtgtccccacagccctcacrtccagccaggcctggtggccagacagtggtccctgccaccaggcaggtccaaaggtccaaccccctagtccctctgacaggtcagcagctcctaagatggggcccctgcccccacctcacaccgggcacccctccccaggctctgctcactcccatgctgaccagcccacagccaggggcccactgagcccccagggactgggctgcagggagcaagcggggctcagccttgcaggctgggggccctcttgaagctgagtctgcctcggagactccaccagcccaggcactggggcagta

SEQ ID NO: 177155 - DNA, 601 bp, Human
ctctccgttctccagcccccgtaccgccctgcccctccccggcccacctctccgttctccaggggcacgatgcgtgagtactcggtggtgcagatggctgcgtcgtcccgtgtgatgcgctccagcgtctgtggcccgaaccgctccagacagtccctcttggaggctgcggggaatggcgggaggggagggcgctggatcaccagaaaagcctgggtccccgcggtgcccgggccccttgacgtctccgggccttgccactgaggctcccacaggccaagaggccgcgtgacagagaccrcagctcactggctgaaggggcctggcccgttggactgcactgccccccaccgctctcccttgcacgctttgagtgcgagtgacccccctcgacgaccatcctcacccccttccttggggacagacgcctactgcccatcactgacccgcccctcccccattctcaggccagggaattttgggggacacgtgaccaggcctgccctattggggaggagcacccactcccaccagcatgactggtcagggtggcacggggccagggacggccagcatccgggctaggactccagtactcttg

SEQ ID NO: 177156 - DNA, 601 bp, Human
acggcccagcgtgtgttaggcgctcaacatacagctgctggctgaaagaaccaacgaagggagggaggaaaggacggacgtgccctggggttgcttctccgcagaatgagcccggccctaccttactgaggactctgggtgaggcccaggaatgtgccggtgccagcaccagggctgctgcccatcctgtgaggggctcccgggaggtggatgctctgcagtgccctcggctgcccccgaaagcaggcacacagggcacagcagatgtggggtgttggctgcccccaccctgccatccccrtcctgggccttggtccctgcttgactggagtgaaggtcagggctggggcagcagggaagttgtctgttgtgtcctgaaaggttgggggagctgggcgggcacccccaaagtgaattagggctgcctcggcaggtagtgggcacctgtccattccgggggatgcagtcttggagtcggggatcaatcatccccattgctgactcccctccacagggccccaggtgtccactatggtgggaaggccagctggcctgggggtccggagagccccacctctgctggcagtagggcaaggccccc

SEQ ID NO: 177157 - DNA, 601 bp, Human
tacaccctccgggcaccacgctgagtactggtttgcgtgtttcccagctgccttccccggaacaggtgctcctgaggccgggctggggtcccaccctgtgttcccattcccaggaaaacggcccagcgtgtgttaggcgctcaacatacagctgctggctgaaagaaccaacgaagggagggaggaaaggacggacgtgccctggggttgcttctccgcagaatgagcccggccctaccttactgaggactctgggtgaggcccaggaatgtgccggtgccagcaccagggctgctgcccrtcctgtgaggggctcccgggaggtggatgctctgcagtgccctcggctgcccccgaaagcaggcacacagggcacagcagatgtggggtgttggctgcccccaccctgccatccccgtcctgggccttggtccctgcttgactggagtgaaggtcagggctggggcagcagggaagttgtctgttgtgtcctgaaaggttgggggagctgggcgggcacccccaaagtgaattagggctgcctcggcaggtagtgggcacctgtccattccgggggatgcagtcttggagtcggggatca

SEQ ID NO: 177158 - DNA, 601 bp, Human
gagctccacccgcctccccacctcccctgtaaactggagcgtggacagagcagtaaggccccacagaaggcaagggcgggtcccaaatccaagcgcatgaaagttgggctgctcggttgcaggcactagatgagccctgccagctccctgctgggggtccaggagcctcgtcacacactcagcctcagctgcaccactctgagtggcttctgtccagccccatgcctgcactgccaccctagggtgttacaccctccgggcaccacgctgagtactggtttgcgtgtttcccagctgcctyccccggaacaggtgctcctgaggccgggctggggtcccaccctgtgttcccattcccaggaaaacggcccagcgtgtgttaggcgctcaacatacagctgctggctgaaagaaccaacgaagggagggaggaaaggacggacgtgccctggggttgcttctccgcagaatgagcccggccctaccttactgaggactctgggtgaggcccaggaatgtgccggtgccagcaccagggctgctgcccatcctgtgaggggctcccgggaggtggatgctctgcagtgccctcggctgcccc

SEQ ID NO: 177159 - DNA, 601 bp, Human
tgctgtttctccagctgtccggcagcaagcgctcgcccagactcagcgtccccgagcctgtggctctgacgcaacttccccaggctcagggaatggacacaaggaaagaggcggtggaggacagggtctcacagggcctttgtggaggcgggactggggagcaggtgtgcactgaccgggtggggcctaggacagggcacctcaggggtcagtagagtcccccttgcctgcaggtcaggatggagacctgcgttctccaaaactgagttatgccctttccacttcggccaggactcgagcrtaagcccaaaacctccctgagccagaagggaaaggggtccatttgcaccccccaaggctcagatttcgcttagcaggcaggactcctaggcatcctggtcacctccctagggccaagtggccaagaactgcttccttcttccagctggggtggacactaagtcacagggctggaatcttgccttacgtcccgtgggcagggtgacagctggagagagacaaggcctgaggttggaagcacctactgctcagtattagccagaccacagcgggagtccctgccccagatcaggctctgccg

SEQ ID NO: 177160 - DNA, 601 bp, Human
gccccgtggcctgggaggctccttcctgggctggcctggaagctcaggacatcccctccaaagcagccccaaaggcccaagaacacctctttccaggcagaccctgagacccaggacacccgcccagctgagcccactcacggcggcagacgtggggcgagtcgagagggtggttgggagagcggtagaagccgggcaggcagcgctcacagttgacgccggcggtgtggtgctgggagtgcaatggccgttgagtctggggaggtccctgccccacctcggggccagcccattcccagcmctctagcccagcccacctggcagtcgatacagacacccccaccctgataggtgccatccaggctctggctggcgcggcgccggtccacctcagggtcgtagtaacagtcggtggcatggccgtagcagttacaggctagagagaggggagcgcagctgttggcacgccctccacgggcccgggcaccggggccctctcatgggccagggtgtgggcaggacacacgtgtgtgggaggaggcactcacactggcactcgttggcactgttggcagtcgcaggcttccacggctgctgattg

SEQ ID NO: 177161 - DNA, 601 bp, Human
tgcataaaaagaaataagccaaaaataaagtgaccaaatgaaaatcctccctttctccaggaactttctgtgaagccgcccccatggctccagggcaggccggggacctgggggcctcaaggacacttactcacaatctggccggctggcagcacctgctccctggtgtcattggaggacgagggcgtcgctgaggggaagagacacgcatgttggccaggtctgctcagaaccctagcaccctacaccccctgccacccttggtctctcagcacaatcggagatgcaggcaggataacayggtccatcccggggaacccctccaccccctgcagggctcccggagtccagcaggcagtggtgtctgtttggatgcccctggcaggtgctcacggtagcagcttgggaagcccgtgaagccctcggcacacacgtcacaccgctccccagagaagttgggccggcagtagcatcgacccgtcaggtcctcgcaggtgccatccgtgaagtcggactcgcagttgcagcctgggcaggggcaggagccgggtaagcctggagctaccaggactcaaggggtgggctccaagatgtggcagtc

SEQ ID NO: 177162 - DNA, 601 bp, Human
ggagtagctcgaactacaggcacacatcactacacccagctaatttttgtatttgctgtagagacagggttttaccatgttgcctgggctaacttttttctttggctttatgccgacctatatttccgaaggttttccagtgtgaataggcataatttgcataaaaagaaataagccaaaaataaagtgaccaaatgaaaatcctccctttctccaggaactttctgtgaagccgcccccatggctccagggcaggccggggacctgggggcctcaaggacacttactcacaatctggccrgctggcagcacctgctccctggtgtcattggaggacgagggcgtcgctgaggggaagagacacgcatgttggccaggtctgctcagaaccctagcaccctacaccccctgccacccttggtctctcagcacaatcggagatgcaggcaggataacatggtccatcccggggaacccctccaccccctgcagggctcccggagtccagcaggcagtggtgtctgtttggatgcccctggcaggtgctcacggtagcagcttgggaagcccgtgaagccctcggcacacacgtcacaccgct

SEQ ID NO: 177163 - DNA, 601 bp, Human
actttaagttttagggtacatgtgcacattgtgcaggttagttacatatgtatacatgtgccatgcccagttttcttttttgaaacaaggtctcactctgttgcccaggctggagtgctgtggtgtgatcatggctcactgcagcttcggccttccaggctcaagcaatccttccacctcagcctccggagtagctcgaactacaggcacacatcactacacccagctaatttttgtatttgctgtagagacagggttttaccatgttgcctgggctaacttttttctttggctttatgcygacctatatttccgaaggttttccagtgtgaataggcataatttgcataaaaagaaataagccaaaaataaagtgaccaaatgaaaatcctccctttctccaggaactttctgtgaagccgcccccatggctccagggcaggccggggacctgggggcctcaaggacacttactcacaatctggccggctggcagcacctgctccctggtgtcattggaggacgagggcgtcgctgaggggaagagacacgcatgttggccaggtctgctcagaaccctagcaccctacaccccctgcca

SEQ ID NO: 177164 - DNA, 601 bp, Human
gctgggattacaggcgtgagccactgtgcccaaccaattttcttttttttttttttttctattttttttttattatactttaagttttagggtacatgtgcacattgtgcaggttagttacatatgtatacatgtgccatgcccagttttcttttttgaaacaaggtctcactctgttgcccaggctggagtgctgtggtgtgatcatggctcactgcagcttcggccttccaggctcaagcaatccttccacctcagcctccggagtagctcgaactacaggcacacatcactacacccrgctaatttttgtatttgctgtagagacagggttttaccatgttgcctgggctaacttttttctttggctttatgccgacctatatttccgaaggttttccagtgtgaataggcataatttgcataaaaagaaataagccaaaaataaagtgaccaaatgaaaatcctccctttctccaggaactttctgtgaagccgcccccatggctccagggcaggccggggacctgggggcctcaaggacacttactcacaatctggccggctggcagcacctgctccctggtgtcattggaggacg

SEQ ID NO: 177165 - DNA, 601 bp, Human
gacggggtttcaccatgttagccaggctggccttgaactcctgacctcaggtgatccacctgccttggcctcctgaagtgctgggattacaggcgtgagccactgtgcccaaccaattttcttttttttttttttttctattttttttttattatactttaagttttagggtacatgtgcacattgtgcaggttagttacatatgtatacatgtgccatgcccagttttcttttttgaaacaaggtctcactctgttgcccaggctggagtgctgtggtgtgatcatggctcactgcagcytcggccttccaggctcaagcaatccttccacctcagcctccggagtagctcgaactacaggcacacatcactacacccagctaatttttgtatttgctgtagagacagggttttaccatgttgcctgggctaacttttttctttggctttatgccgacctatatttccgaaggttttccagtgtgaataggcataatttgcataaaaagaaataagccaaaaataaagtgaccaaatgaaaatcctccctttctccaggaactttctgtgaagccgcccccatggctccagggcaggccg

SEQ ID NO: 177166 - DNA, 601 bp, Human
taaagggttttgtaagtttgaccagacttttaacaagtaaataatttctgtgatttttaaactgattgggagcataaaaaagtgtggatgatttcccaagtattttacaaaaccaaaacaatctcacttgtgaatttagacaaaataaaatattgatgttcaacactgtgtccccattaggaaagacaatacaattcattgtaatgaacacattgaaagtgaatactgtacagccacaggtaattactgagtgcttactatggcccagtagcgaaaagataaattgtcagtttacaccagsgattagcaaactagtctatggactcctcgcttgcttttgtaaataaagttttattggaacgccgccaaccccactcatgaatacgcgttctatggctgcttgcaagctacagctggtaacggtagagctgaggagtttccccacagggaccacacggccctcagtctatgacatttaccgtctgggccttttccgacagtttgttgacccctggtttacactattgatgaaaaactaaacatttccacataaaaaaaccatcacagaaccagcagacaagagaattcctgggtaagggag

SEQ ID NO: 177167 - DNA, 601 bp, Human
tgaatacaatagccacagaatacattaaaaccttaatttaagatctctgttgaaaaacaggtatcagagaccaggctcagtggctcacacctgtaatcccagcactttgggaggccaagacgggtggatcatgaggtcaggagatcgagaccatcctgctttaacacggtgaaaccccatctctactaaaagtacaaaaaaattatccgggcgtggtggcgggcacctgtagtcccagctactcaggaggctgaggcaggagaatagcgtgaacctggaaggcagagcttgcagtgagccragatcgtgccactgcactccagtctgggcgacagagcgagactccgtctcaaacaaaaacaaaaaaacaaaaaaaaaagaaaagaaaaacaggtatcaggactaaagggttttgtaagtttgaccagacttttaacaagtaaataatttctgtgatttttaaactgattgggagcataaaaaagtgtggatgatttcccaagtattttacaaaaccaaaacaatctcacttgtgaatttagacaaaataaaatattgatgttcaacactgtgtccccattaggaaagacaatacaattca

SEQ ID NO: 177168 - DNA, 601 bp, Human
actccatctcaaaaaaaaaagatgaggtagaaaattgaatacaatagccacagaatacattaaaaccttaatttaagatctctgttgaaaaacaggtatcagagaccaggctcagtggctcacacctgtaatcccagcactttgggaggccaagacgggtggatcatgaggtcaggagatcgagaccatcctgctttaacacggtgaaaccccatctctactaaaagtacaaaaaaattatccgggcgtggtggcgggcacctgtagtcccagctactcaggaggctgaggcaggagaatrgcgtgaacctggaaggcagagcttgcagtgagccaagatcgtgccactgcactccagtctgggcgacagagcgagactccgtctcaaacaaaaacaaaaaaacaaaaaaaaaagaaaagaaaaacaggtatcaggactaaagggttttgtaagtttgaccagacttttaacaagtaaataatttctgtgatttttaaactgattgggagcataaaaaagtgtggatgatttcccaagtattttacaaaaccaaaacaatctcacttgtgaatttagacaaaataaaatattgatgttcaa

SEQ ID NO: 177169 - DNA, 601 bp, Human
gcagaggttgaagtgagccgagatcgtgcaactgcactccagcctggacgacagagtgaaactccatctcaaaaaaaaaagatgaggtagaaaattgaatacaatagccacagaatacattaaaaccttaatttaagatctctgttgaaaaacaggtatcagagaccaggctcagtggctcacacctgtaatcccagcactttgggaggccaagacgggtggatcatgaggtcaggagatcgagaccatcctgctttaacacggtgaaaccccatctctactaaaagtacaaaaaaattakccgggcgtggtggcgggcacctgtagtcccagctactcaggaggctgaggcaggagaatagcgtgaacctggaaggcagagcttgcagtgagccaagatcgtgccactgcactccagtctgggcgacagagcgagactccgtctcaaacaaaaacaaaaaaacaaaaaaaaaagaaaagaaaaacaggtatcaggactaaagggttttgtaagtttgaccagacttttaacaagtaaataatttctgtgatttttaaactgattgggagcataaaaaagtgtggatgatttcccaagtat

SEQ ID NO: 177170 - DNA, 601 bp, Human
gtcaatacattaaaaaatccaaacaaaatacacaatttgctaatacaaataatcaaacctgacttaagatgaggaagaaaactggccaggcgtggtggctcatgcctgtaataccagcactttgggaggccgaggcaggtggatcacttgtggtcagagttcaagaccagcctggccaacatggtgaaaccccgtctctactaaaaatacaaaaaattggccaggcgtggtggcaggtgcctgtaatcccagctactcgggagactgaggcaggagaatcgcttgaacccaggaggcagargttgaagtgagccgagatcgtgcaactgcactccagcctggacgacagagtgaaactccatctcaaaaaaaaaagatgaggtagaaaattgaatacaatagccacagaatacattaaaaccttaatttaagatctctgttgaaaaacaggtatcagagaccaggctcagtggctcacacctgtaatcccagcactttgggaggccaagacgggtggatcatgaggtcaggagatcgagaccatcctgctttaacacggtgaaaccccatctctactaaaagtacaaaaaaattatccggg

SEQ ID NO: 177171 - DNA, 601 bp, Human
tctgaggaaaatttatagctttaaactagagtttcccagcctcaggactactgacagtccaggctggataactctttgttatgtgtgcaggagcagtcctgtgttgtaggaggttcccagcatccctagcctctacccactggatcagttacatccatcaatcgtcacaaccaaaaatgtctccagacatcatcgaatgcttcctgtgcatcaaagtcaccactggctgagaaccactgctttaagcctttttgttgggaatgaagacagactaaaaataataactcaagaagctattttwaaaaagtgataaatcaaagaaagtggattaaagaaattgaatattagaaaggaaaatctctcctcccaactaaagaaagaaaaacctcagcaggtcttatcaagagaactgcacctgtacttcgaacagaccaataaactcaacgaacctctgttaggtctgatcaaccaaaaaaaaaaaaaaaaagaagaagaaagaaaataaaaataaaaatagacgagaatagaaatgaacagaaattttaactttataacaggccactgtgcataactttatgtcaatacattaaaaaatccaaac

SEQ ID NO: 177172 - DNA, 601 bp, Human
ggctgaggtgggtggatcaactgaggtcaggagttcgagatcagcctggccaacatggtaaaaccccatctctactaaaaatacaaaaattacccaagtatggtggtgggcgcctataatcagtcccagctactcgggaggctgaggcaggagaatcgcttgaacctaggaggtggtggttgcagtgagccgagatcgtgcaactggacgccagcctgggtgacagagtgagactctgtgtcaaaataaataaataaataaataaataaataaataaataaataaaattaaaaaataaaartcgtcacattctaggttagaaacaaagaaaatctcaaattccaaagacaaaaggcagaaactatcagtgtgccaagtctaaccacgatgcagcaaaaccagaactgcacaccacgaaaaggacaggagggaaacctcagcaccttgaacagtgacgggttgaaagaaaataaaaccccaaatgatagactatttaaaaaaaacacagcaatgaggacaccccacatctcaaactacaagatacctagccaaaggtatactctgaggaaaatttatagctttaaactagagtttcccagcc

SEQ ID NO: 177173 - DNA, 601 bp, Human
aactattaaaatggcaaggagaatttggcaaaccagagtcagagagagacaaagactggatggagatacataggtagactgtgacagctcagagggacagaaattgagcaagggtactgtgggtttgaagagcataatgaacaagcctcctttgtttttttttttttttttttttttgaaatggagtttcgttcttgttgcccaggctggagtgcagtggcgccatctcagctcactgcaaaccctacctcccgggttcgagccattctcccgcctcagcctcccgagtagctgggattayaggcatgcgccaccatgcacagcttattttgtatttttagtagagacggggtttctccatgttggtcaggctcgtctcgaactcccgacctcaggtgacctgcccacctcagcctcccaaagtgctgggattacaggcgtgagccatcgcacctggccacaagtctgctttaacatgccaaatcggtactccatagagaacacacattcctgtccaatgttcctggaacaatctaaaagtggtcacattctggattagaaacaaagaaaatctcaaattccaaaaacaaaaggcagaaac

SEQ ID NO: 177174 - DNA, 601 bp, Human
ggagcagacaggccctggggttgccatggcaactgagcagcaggcaggaagccctggtctcaccggactcgggacttttagcttggcctgggtcctcacccatctcccacacacgagcagacttgggctcacctcaggaagggcaggatccactggggccagaccggcagggtggcaagagccagctgtgaagagaggaccatgcctcggtcatttcccagtgaccaacccggaaggccaagggtgtcccaggcccagccagaacccacggtcccacaggagctgaggaccagcacaggtrcctctcatccacatggacggcctgaaaacacgcacctccctgctccctccgcagcaacggacgtgccatcccaccacacagcacctgctcatggacatgcacgcaaacgtgcaccgcgtggggtacccgtgtacattccacacgcagtgtgtgacacacgtctgaacaagcacacaaacgcacgtgaagatgcacccactacacgtgcactaacacacccacacgcccgtgaaaggacatgaacacgcacacccacacttgagacacgcgatacgcgcacccacttatgcgatacgcgca

SEQ ID NO: 177175 - DNA, 601 bp, Human
aaccaacgctgtctgtgccaggaggtggctgccctggggccagggagctgtgactgcaggtgctttcctgagcacatggaacagctcgggggtacgtcaaaagggactgaatccacaaaacgcttgcaggaggggttccagaagaaacatgctgggctgggcatgagcgagtgtggccgccttggggacctgggaccccaactgtcctctcccctctcatgcatgtttcaaatcttctgaaagaagctgaccccttggggtggggacctgaggggtccttaccaggaagaagcgtgcctgytcggctgtgagcctcacgctggcctccgagtccaggtggaagacagccaggtggtcctgggtatcccgggcagtgccccggcacagggtgctgtggggggagggtggtcagcaggtggggcagccccgggcgtgcccttactccagccccaccggctcccactcacctgtacaggcaggggtgcagggagagcagcccctgctggggggcccgctgtggggtgtgcacagccacgcccacctcctggcgggcatcctcattggcgtactccaccactagggcatagcggcctggctgtgg

SEQ ID NO: 177176 - DNA, 601 bp, Human
tcctgggcccacaggcctatgcggctcctcccatagccctcttcctccccctcgccctcccatccgtcactgttcccccactcttatctcgagtgctgcttggtgccaccaggccgggccaggcccagctctcccaggacctgacccaggcaggcactcagcaggcacaagccgcaaatgggtgctccctttccgtgcggccatgtgaggttggtgtctcggaacacggcaacttatccgctgacacaacggtgggagacgcggctgcacagaacatgttgtgtggcatttatagaaagtkccaggccaggtatggtggctcctgtctgtaatcccagcattttgggaggcccaagagggcggatcacctgaggtcaggagtttgagaatagcctggccaatatggtgaaaccctgtctctcctaaaaatacgaaaattagccaggcgtggtggtgagtgcctatagtctcaggtacttgggagactgaggcacgagaatcgcttgaacccaggaggtggaggttgcagtgagccaagatcttgccattgcgctccagcctgggcgacagagtgagactccatttcaaaaaaaaaaaaaaa

SEQ ID NO: 177177 - DNA, 601 bp, Human
gcaccagagtgaccccgtgctgcaggcagagggacgagatgctgcaacgcccgtggtgcggggaggatagggggtgcaggcggtacgatgggggggtgcaggcggtacgatgggggggtgcaggcggtacgatggggagtgcaggcggtacgatggggggggtgcaggcggtacgatgggggggtgtaggcggtacgatggggggtgcaggcggtacgatgggggggccggtcacacagctcagacccaggaaactgcaaacccaggcgtccgaccgagccctgctctttccaagatgccmttgctcctcctccagctgcacaaaccccaaccgcagaccagcgtgttggccagttcctgggcccacaggcctatgcggctcctcccatagccctcttcctccccctcgccctcccatccgtcactgttcccccactcttatctcgagtgctgcttggtgccaccaggccgggccaggcccagctctcccaggacctgacccaggcaggcactcagcaggcacaagccgcaaatgggtgctccctttccgtgcggccatgtgaggttggtgtctcggaacacggcaacttatccgctgaca

SEQ ID NO: 177178 - DNA, 601 bp, Human
gtggtagccctgggctgcgcagtggctgatgaagtcataggatttatccaggggctcctcccggaggtagccaaagctgtagacgttctcagggaccacgagtacataatcctagggggtgaggcctggtcactctcccgcgggcccagagcctgcagcggggaggcccccagaggctggctgggaccagggtcctgcaggcagctcagagtcctggcagcagcagcccagcccagcccagccctgggccctggctgctcaggggaggccactccaagccaaacagcagctttcgggggcrtgaggaggcagcagcattcatgagacctcctggtgtctcccacatctctgtctgctggccacgccttcctcttccctctccttcctggaggccccacctcctccaggaaggccaccctgaccagcagggtgcagggtgcagggtccagggcccctctggagcctcacaaggtggatcgggaggtccccaaaggcaggagctgctttgctgggcacaaggccaggcctcagcaggcccagaagagacagacccagcccaagtgtaccacagtggtaatgacaagtataaggacagctggtc

SEQ ID NO: 177179 - DNA, 601 bp, Human
gggcacgtggtgaggccagctcccggcccagacccccaccccggacccctgacctgccagagccctgcccacctgatgtggtagccctgggctgcgcagtggctgatgaagtcataggatttatccaggggctcctcccggaggtagccaaagctgtagacgttctcagggaccacgagtacataatcctagggggtgaggcctggtcactctcccgcgggcccagagcctgcagcggggaggcccccagaggctggctgggaccagggtcctgcaggcagctcagagtcctggcagcagcagcccagcccagcccagccctgggccctggctgctcaggggaggccactccaagccaaacagcagctttcgggggcgtgaggaggcagcagcattcatgagacctcctggtgtctcccacatctctgtctgctggccacgccttcctcttccctctccttcctggaggccccacctcctccaggaaggccaccctgaccagcagggtgcagggtgcagggtccagggcccctctggagcctcacaaggtggatcgggaggtccccaaaggcaggagctgctttgctgggcacaaggccag

SEQ ID NO: 177180 - DNA, 601 bp, Human
atggaggggcacgtggtgaggccagctcccggcccagacccccaccccggacccctgacctgccagagccctgcccacctgatgtggtagccctgggctgcgcagtggctgatgaagtcataggatttatccaggggctcctcccggaggtagccaaagctgtagacgttctcagggaccacgagtacataatcctagggggtgaggcctggtcactctcccgcgggcccagagcctgcagcggggaggcccccagaggctggctgggaccagggtcctgcaggcagctcagagtcctggcagcagcagcccagcccagcccagccctgggccctggctgctcaggggaggccactccaagccaaacagcagctttcgggggcgtgaggaggcagcagcattcatgagacctcctggtgtctcccacatctctgtctgctggccacgccttcctcttccctctccttcctggaggccccacctcctccaggaaggccaccctgaccagcagggtgcagggtgcagggtccagggcccctctggagcctcacaaggtggatcgggaggtccccaaaggcaggagctgctttgctgggcacaa

SEQ ID NO: 177181 - DNA, 601 bp, Human
gcagatgcactggcccgtgagctcgtcacagaggcgggcaccgcagtcacaggctgtggggcgggtacagggtttactgacccctcttcccagtcccgcccctctcagaggcccagaatgcagccctaggggatgtggcagtgtgacgggggcgggggagacaagaacagggacccctgccccgggtgctgagccttggacagctcctgacatggaggcagctgctcagaatcaacatcatcgtcagagactgtggaccacctgctggtccctgaaaccttctgcatggcccgcaagctgragtcctgggcccaggcccgcagatggggcagcaatgctgccctgccaggctctagaacattctcctgaccctgctttctggtcgacccgtccaccttgggctctggcaccaactccctgccactgggcgcccaaggactggggtactcacgcctgcagttggggaagccccagtatccggtggcacagcgggagcagtcacggccaatgacatgggcatggcagggacactggcccccgaagggctcacacgtggggcctgtagcacctacttcgtggcagccacatggacgggctccgt

SEQ ID NO: 177182 - DNA, 601 bp, Human
agtgagacctcgtaggcaccccccacccaggcagcatcctcccagaagtggaggagagggcgctgctgcacccagggagcacaaatgggagcagggtgggtgccaggaccctctggctagaggaaatgctgtccttaaggccaccaggggccgcgctgacgccgctctgggctctcacttgcactggccgctgtctgtgtcacaggtagggtctgtgagctcctggatgccgggccctgagcagttacactcctcacagccgaccagggggtggcagccaaaggtctggggctggcacagyaggcagtcgggcgggatggtgcgtggcgggcagatgcactggcccgtgagctcgtcacagaggcgggcaccgcagtcacaggctgtggggcgggtacagggtttactgacccctcttcccagtcccgcccctctcagaggcccagaatgcagccctaggggatgtggcagtgtgacgggggcgggggagacaagaacagggacccctgccccgggtgctgagccttggacagctcctgacatggaggcagctgctcagaatcaacatcatcgtcagagactgtggaccacctgctggtcc

SEQ ID NO: 177183 - DNA, 601 bp, Human
acctcctggcgggtgtaggacgagctccggcagcgctccgtggccccaaagcagaagcagcgggtgcaacctttggggttggcagcatccagtgagaaggtcccaaggctgcactggtcacatttggggccctgcacgttctcctagggatgagaggacagtgagagtggtcggcaggtgccaggtgcctgaccccgggttcctggtacccacctgccaatggggatgactctcccaaaagcttctaggaagccccagctgccccgaaaggcccgtaaggacactttcagctgatgaggcyggagggagaggccagatctgggcccagccctcactcaccttacagtagcactgccctgtgagggggtcacacacgccaggcgcagtgcccgcctcgtgacagtcacaggggcggcagcgggggtagccatggaagcccggagagcaggtatcacagcggcgcccagtcacgttgggtctgcacctgtggcaggggcgggagctgagccccctccaccccaggtcactcacaccaaagtgagacctcgtaggcaccccccacccaggcagcatcctcccagaagtggaggagagggcgctg

SEQ ID NO: 177184 - DNA, 601 bp, Human
acaggctcagagcccgtcagcagtggtctgggcacccccagcacagagccctgtgctgggcctggatacttgcgctcattccctaccgggacagggcctgggcaccctcacggacccccatggagctccccctccctggacagaccccactcctggctcccaaccctctcaggcgtcctggccatcctcaaagtgcctcccccagacctgatgccctgcttacccggtcccccaggtaggagggtggggcctgccagtacagctcggggaaagcctcgggcacagcctcaggcacgtgccrcaggtctgcacggagcatctccgtccctggctgccgctcgtggggcaccacctgccggtcagtgctcagcagcacccatccctccatatccacgaactgtgggcacacacgtgtggctgcacatgggtggatgcccacacatcacagggccccatcttgcatccagtcccacctaagccctccccgagaaggcaatgccctcagtcctgcaggcgcacctcctggcgggtgtaggacgagctccggcagcgctccgtggccccaaagcagaagcagcgggtgcaacctttggggttggca

SEQ ID NO: 177185 - DNA, 601 bp, Human
gctccaggaatgtgatgctcatctggttgccctgggaaggcacatggggaggtgagggttggcacgggcctggaccacggtgccactgcgccacgcccacccaaccaccctgccacatcatctcagctccctcacctgcagcaccacatccggcctgctctccatggggacaaagacatctccccgctgggtctctgagtgcagttcataacggagggtcccaccgtaggatgacacctggaggcaggacagacagaggtgacctggccagactctggccacaggctcagagcccgtcagyagtggtctgggcacccccagcacagagccctgtgctgggcctggatacttgcgctcattccctaccgggacagggcctgggcaccctcacggacccccatggagctccccctccctggacagaccccactcctggctcccaaccctctcaggcgtcctggccatcctcaaagtgcctcccccagacctgatgccctgcttacccggtcccccaggtaggagggtggggcctgccagtacagctcggggaaagcctcgggcacagcctcaggcacgtgccgcaggtctgcacggagcatct

SEQ ID NO: 177186 - DNA, 601 bp, Human
aggaagccaacagctactgagcagctgctcacccctcagggatcagggactcacaaagcaggtgggaagacagcatgacaccccccagggtgaccagcgcagaagatatctgacaatgggtgtggggacctccccagcccccaccccgcttctgctcctgggctcttttccaccacggagaatgggcacagcagcactgggaccccttccggccttcccagatgagctgaggtccatgagggacctgggtgcccaagccagctcccctcacctccaccagctgcagctgcccacggtgaaygtggccaggcgtggggtatgccggctccaggaatgtgatgctcatctggttgccctgggaaggcacatggggaggtgagggttggcacgggcctggaccacggtgccactgcgccacgcccacccaaccaccctgccacatcatctcagctccctcacctgcagcaccacatccggcctgctctccatggggacaaagacatctccccgctgggtctctgagtgcagttcataacggagggtcccaccgtaggatgacacctggaggcaggacagacagaggtgacctggccagactctg

SEQ ID NO: 177187 - DNA, 601 bp, Human
agaggggagaagacggttgttactctgaagtctgacagagggtaagcaccaagaataacaaagaactctaaaaggatggaaaaagatttgcaagtcaaagagaaatgggcaaaagatgctaacaggcagtgcatggaggaagccaacagctactgagcagctgctcacccctcagggatcagggactcacaaagcaggtgggaagacagcatgacaccccccagggtgaccagcgcagaagatatctgacaatgggtgtggggacctccccagcccccaccccgcttctgctcctgggctsttttccaccacggagaatgggcacagcagcactgggaccccttccggccttcccagatgagctgaggtccatgagggacctgggtgcccaagccagctcccctcacctccaccagctgcagctgcccacggtgaacgtggccaggcgtggggtatgccggctccaggaatgtgatgctcatctggttgccctgggaaggcacatggggaggtgagggttggcacgggcctggaccacggtgccactgcgccacgcccacccaaccaccctgccacatcatctcagctccctcacctgcag

SEQ ID NO: 177188 - DNA, 601 bp, Human
ctcaggctgggtgtggtggctcatgcctgtaatcccagcactttgggaggctgaggtgggaggatcacctgaagtcaggagttcgagaccagcctggccaacacggcgaaaccccatctctactgaaaatacacaattatcagggtgtggtggcgggtgcctatagtcccagctacttgggaagctgagacagaagaatcgcttgatcctgggaggcagaggctgcagtaagccgagattgcaccactgcaccccagcctgggcgacagagcaagactgtctcaaaaaacaaacaaacaacaaaaaaaaaacaaagaaaaaccagatgagctgtgagaggggagaagacggttgttactctgaagtctgacagagggtaagcaccaagaataacaaagaactctaaaaggatggaaaaagatttgcaagtcaaagagaaatgggcaaaagatgctaacaggcagtgcatggaggaagccaacagctactgagcagctgctcacccctcagggatcagggactcacaaagcaggtgggaagacagcatgacaccccccagggtgaccagcgcagaagatatctgacaatgggtgtggggacc

SEQ ID NO: 177189 - DNA, 601 bp, Human
agctcaggctgggtgtggtggctcatgcctgtaatcccagcactttgggaggctgaggtgggaggatcacctgaagtcaggagttcgagaccagcctggccaacacggcgaaaccccatctctactgaaaatacacaattatcagggtgtggtggcgggtgcctatagtcccagctacttgggaagctgagacagaagaatcgcttgatcctgggaggcagaggctgcagtaagccgagattgcaccactgcaccccagcctgggcgacagagcaagactgtctcaaaaaacaaacaaacaaaaaaaaaaaaacaaagaaaaaccagatgagctgtgagaggggagaagacggttgttactctgaagtctgacagagggtaagcaccaagaataacaaagaactctaaaaggatggaaaaagatttgcaagtcaaagagaaatgggcaaaagatgctaacaggcagtgcatggaggaagccaacagctactgagcagctgctcacccctcagggatcagggactcacaaagcaggtgggaagacagcatgacaccccccagggtgaccagcgcagaagatatctgacaatgggtgtgggga

SEQ ID NO: 177190 - DNA, 601 bp, Human
ggaggctggcttacttgttggaaggcactgagagggggcaggggcagctgacacagggggtgctggggtcgtccctgctgctcacgaagccagcctggcagcgctcacagtgggccccttcggtgttgtgctggcagtcctggggcagagtggacagtcagagctatggtggacacccacatcctactgccgagtctgtgcagctcccaccacccctgcctcagactctgtgcccaaggccagatggtcccccactgggcaacacccttccccagacctcagttgacctggaagtgcagcycctggtcttccctggcacacttgactgtgccttcagtgaatgctgcccccctggccccaccagcccctactcaccacacagacgccagagccagggaggcagcggtctgagtgtccatggcactgacaagggacacatcggcccaggaagagacctttgacgtcccgatagaagccgggggcacattcctgagggtgtacgggggcaggtggcatcagcgattgagaggacgaggggccccaccctgcaagctcacaagtcagaccctcagggatcctgcaggcacgaggcactgggaac

SEQ ID NO: 177191 - DNA, 601 bp, Human
gagaaagggttgaccatgaacccagaaggctggctccgacttgtcctggctgggccccagcatcaggcacacagcctacttacggggtacgcccagcaggcctccctcctccccgcgcaaccctccccagggtgcatccctcccagcccgacgcctacgggtgcagttgccgggcagcagggcgttgccgtagaagccgggggcacagatctcgcagcggggcccagtggtgtggcgcaggcagccacggcaggcgcccgtcagggggtcgcagtcgctgaagagcaagttggggtcaccrttgccgctgcagtcgcatggctggcaggagctgcccagcaccagtgggttcccaaagaatccgggcgcacacctgggagcagggtggggaggggccgtcagtggcccgtggcgcccaccctcgcatatcctggggtcagcactcaggccctgccccactgccctagccccagctcaccgctcgcaggaggcacctgcataaccaggtttgcagaggcactgggtgcggccgcctcgcaggacacagccctcggcgaagctgcaaagaccagcagcgtcagtcactaggcccctggcagtg

SEQ ID NO: 177192 - DNA, 601 bp, Human
gtgtgagggtcacagcggcccccagggcactggcagcctgtggtggggggcttgggtgagcatggctggcctgggaccttggagcgtaccccactcagaagtccccatccgccctcctgtgaccggccagcactcacgcctgcagccctgctcagggagcccccagtagccaggggcacactcgcggcactggggtcccatggtccctggtcggcagtggcactgtccgctctgggggtggcactcggagccctcggcggccggtccacaagcacacgggcggcagcccccgcagccatcraaaccaaaatgtccctcctgtggcacaggctggtcactgccctgcccagccctcaagactgtcccagaccaacctggaagccaggggtcctgcccatctggccccaccccctgaggctctgcccatcaaacactgcccctcagccccacctatcagattctccccaggccccaactctagtccctaggccccacccacccagccctgcttaccccacagccctacctggcagcggtcacagcgccgcccagtcacgcccgccttgcacaggcagtgcccgctgtgggggtcgcaggcctc

SEQ ID NO: 177193 - DNA, 601 bp, Human
aaagacatttgagtgatattatacactgtaaacaaatgtattaggtagtttagatagtaattcagtgacttggtcaacccctaagactctcgagctcctgtcccctgcactgacacatgtacgaggcatgaagtaacatctgctgaatgaggacaagcgaaccgcggggaacacaggtgaaagcctcccggggccctggggggtcttggggctcctgcctggccgcctagccgccgtgcgtcctgcccgaggcttgtgctctgctgctccagcacctccagctgctgtgccgtctcatggygggggcccagggggctccggagctggctctgtgggaggcggaaggtgaaggcctgcactggcccgggttggggagggaaggccaggacgctcagtacctgcaggtcagcgatggaggcgttcagcctgtgcagacgggcccaggccatggagctggcattgatgccacgcagttgctcgtgaatggcggggaggagggcgccggcccgttccaggtcatccaggagcaggaccacacagtggtcacacactgcaggcgatgtggggtcacaggtcagtgtcattgggtcaggccagggga

SEQ ID NO: 177194 - DNA, 601 bp, Human
gccgagggtcccagggaagaggggccccttatctatttaactctcttatctgatgacttgttatttatcacttgttagttacctaaaattattggttataacttgccatttgttatttcctgtcaatttaatgaaatagttactcattaagacatttgaggccggccacagtggctcacgtctgtaatcccagcactttgggaggctgagatgggcagatcacctgaggtcaggagttcaagaccagcctgaccaacatggagaaaccccatctgtactaaaaatacaaaattagctgggygtggtggcgtgtgcctgtaatcccagctactcaggaggctgaggcaggagaatcgcttgaacccgggaggcagaggttatggtaagccgagatcgagccattgcactccagcctgggcaacaagagcaaaactgtgtctcaaaaaaaaaaaaaaaaaaaaaaaaagacatttgagtgatattatacactgtaaacaaatgtattaggtagtttagatagtaattcagtgacttggtcaacccctaagactctcgagctcctgtcccctgcactgacacatgtacgaggcatgaagtaaca

SEQ ID NO: 177195 - DNA, 601 bp, Human
ggccaggggcccggaacctgagcgcacctgggtggcccctagagcacctggcgaaaggccacagctgcctcacctgcccggccctcacctcctgcagtgcctccaacaccctgacaccagtctgctcagccagcttctgagccttctcgtcctgcccctctccgcctggcccaccctgctccctggccagctctctctgacatggcaccccctgccgacccccaggctgggctggcaggtcctgttaggcaggctcagggagccaagtctctcctgagtcccatgtctcagtgtgcactaygggatatctgtgagcgcgaacatctaaccggcacatttcctggggaggctgtcgaggggtctgacgtctcccggggccacctgtctggccacacggctgtgtcgccgacctcctgaccctgccctactgttcactccagaggcgtcgtctcccatctaaaagacagatcctgcctgttcttccaggccaagctcggccaggcacccccacccctaccccaggcagccctcctggctctgagccctgagcctggctgggctggcccctaccgctcagggtgcggtccacagcccggatggc

SEQ ID NO: 177196 - DNA, 601 bp, Human
ccgctccacctcggccagtgtccggagcagctgctcacctgatggagccgaggcattggccagccccaggtggcccgtctgggacatgagctctgtggggcaggggttcgtcagagcctggggccgcccgtactagtgcacctctgcctgctggcttccaagcccaagaccccagccctgccatccttggcaggccaggggcccggaacctgagcgcacctgggtggcccctagagcacctggcgaaaggccacagctgcctcacctgcccggccctcacctcctgcagtgcctccaacaycctgacaccagtctgctcagccagcttctgagccttctcgtcctgcccctctccgcctggcccaccctgctccctggccagctctctctgacatggcaccccctgccgacccccaggctgggctggcaggtcctgttaggcaggctcagggagccaagtctctcctgagtcccatgtctcagtgtgcactacgggatatctgtgagcgcgaacatctaaccggcacatttcctggggaggctgtcgaggggtctgacgtctcccggggccacctgtctggccacacggctgtgtcgccga

SEQ ID NO: 177197 - DNA, 601 bp, Human
tgggcgcacctgagtggcctgcgtcaagcactgcctggcccaggtcctggccccgcaggccctcgtactggccctgccaccgctccacattctcctgcatggcctgcagctgggactgcacacgggtggcggtgtcctgggcttcagcagccacagccttggcatgtgcgatcttcttgcttgtctcgtctgtggtgggcagagggcaggctcagcaggggccagcggggaccatcctggcttcatgtccccaagtctttctgttgggccagcaacagggacatccaaccccctatggatygtgtgagaccctcacaccccgctgctcagtgcaatccaaacccatcctaaatgcctccaccagacgccccctccatgccaggacaggcacccagcctctcaggccacagctggtccctggacatgtgccccatgtcacctcccaccacctggcccccaccatctctcctgggcttgctgggaacagtccgcagccacaggggtccctcagaaactgggtgaggcacatcgtcctctgctccaagcctctcagggtgggagccctggtcctcaccgcccaaggtcttgccagccccttggt

SEQ ID NO: 177198 - DNA, 601 bp, Human
ccgtgaaggtactggggtaccccccgacgtagaagacgaagtcgtctggccgcaggttgagcagcccctctgccccaggggccaccgtgtcacccttggtttcctggatcatctgtctctccactgtgacggacatgtggccaaactggagagtcctgagggcagaggcgaggggtggcgagtgggcacggagagatgaggggtggcgagtgggcacagagagatgaggggtggcgagtgggcacggagagatgaggggtggcgagtgggcacggagagacgaggggtggcgagtgggcayggagagacgggtggcgagtgggcacagagacgaggggtggcgagtgggcacagagacgaggggtggcgagtgggcacggagagacgagggatggcgagtgggcacagacgaggggtggcgggtgggcacagagacgaggggtggcgagtgggcacagacgggtggcgagtgggcacagagacgaggggtggcgagtgggcacagagacgaggggtggcgagtgggcacggagaggcgaggggtggcgagtgggcatggagaggtgaagggtggtgggtgcacacggagaggggagagatg

SEQ ID NO: 177199 - DNA, 601 bp, Human
aacacctggatctacaggaccagtgggggctccagggccagctgtgtccctgcggcctgccccgcccccatcgttccatctcctctccctgccaccctggtccccaccctggccctaccgccttgctggccgaggtcaggggcggtgggggctgcagtgggacggcctttttcaggccagccccaaagtcatacaacagcacgaggctgccttcttgcacggccaagcacaggaactggctctgcagaaacagggcagggttagtgtggggcagggtcagtgcaagtggggatggcaggaygggtgtgcctggcgcacctgctgcttcaggaagaagagcaccccgctgtaggacacgagccgcagctcctgctcgaagcgcttggtggtgctgatctgactgtcgaagctgatgcgggcgaagccggtgccgtccaggtaggagccgtccgtgagccacgggtccccggtcgacttggagctgcaggtcggagattctggggtcagcggagggtggggtggggtgggtggagacggggagggcaggccacacgcaccgggcacaaggcctgtccacagccgtgtccagctggaaggtcct

SEQ ID NO: 177200 - DNA, 601 bp, Human
gggggcagcatgcaggcaggatgccgggcgggctgacggctgcggcgggaggcctgggggcgtggatggtgaatgcaggggccgcccacacaggggccacccttccagccaccccagctctgcctgctcacccctggggtgcccaccttccgggcggtggcctgcagtcctctaggccccaggcccggggtctgggcttgcagggcgggtgcacagcccgtgctcacattgacgctgcccaggttctgctgcagatcaaatacgcgctgtgggcccaggagcctgtgcagggcgggcaggyggtcagcagctgcggaaggccagctgggaccttgtcccccagcgcccaccaggctcaccgctgcacgaagacgttgctgatgcagccactgaagttgtaaatggtgccagactcaggcaggcctcccaggaggagcctcgggggcccctcaggctgcggctggagctcggggggtggtccccggtggggcttcatctgctggagctggtcatcgacatacagccagactctggggggcgggaggccggaggctcggtttttccccaccctgcccacccccacctcagaggagacagaggt

SEQ ID NO: 177201 - DNA, 601 bp, Human
gcagcaggacctggcggggtaggaagggagggtcaggctatgcccccgaggtcaccagaatggggaggcaaaccctgccctggcacgccacctctgccaggcttacttgcttctcggtcacctgcaactgcaagtaggggggcgtccgggcctggcccaagtggaagatcagtccggtgactgccaggggccgcacctccagttccaggcccacatcaggcagtgtagctcctgggaggtctgcggggaggggttgtgatggagaagaaagggggggcccctccccagaacctcctggagmcccctgccctgccctgctggggcctgggatgccagcacccacagacctaaagtgataactcccccgctgcctgggaagaacaggcccgcctccagggggcccaagatgcagggtgtgacccctgccatccgtgtgggggcccccaggggcctcccgtgcagcctcagtctcttcacacagccgctgaacccgacggtcacctataggagcagaccgggcagggatcagggcccagggcagctgaaagggaacagtgggtggggagtgggggctggggcaagatggttctcaccggaagtt

SEQ ID NO: 177202 - DNA, 601 bp, Human; identical to SEQ ID NO: 39715

SEQ ID NO: 177203 - DNA, 601 bp, Human; identical to SEQ ID NO: 39716

SEQ ID NO: 177204 - DNA, 601 bp, Human; identical to SEQ ID NO: 39717

SEQ ID NO: 177205 - DNA, 601 bp, Human
tctccctctacccttgacatccaccatcctctgtctgtctctataaatttgactactctatatacatcatataagtagaatcatacatttgtccttttgtggctggcttacttagcacaatgtcttcaagattcctccatgtattatagtagagtatgtcagaatttccttccttttaaagactaaataatattcctttgtgtgtatatgcacagtgagtatatgcattcatccatcaatgaatatttgcattgtttccaccttttggctgtcatgaataatgctgctgtctttttttaarttaaagttttatcaagtcacattgtggttttgtaatagaaagaatgtttgtcagggtcagaaactgtggaggggaaagctacatttagattaaaagcaagtttgggagtttgattttgaattttagatttcactgggtataattctggagaggatggggcagaaaatgatcgaaagtttccaggaagaaatatctgtcgaagataacatactctctaaatggagagagtacctaaaacttgatctcttagggtatctaaagtaatctagaaccccagttcattcatctgtgtatacaatg

SEQ ID NO: 177206 - DNA, 601 bp, Human
taaaatgtacaaccattaaattccttacaaatttttctccttaaaattatgctaaaatacacataacaaaatttcccatttaaagtattttccagtgtacaggtcagtagtattaactactgtgtattcacattgttctccaaccatcactattatccatctgcagaactttttagtcttcctaattgagactctatatccattaaacattaactccccattcccttctccctctacccttgacatccaccatcctctgtctgtctctataaatttgactactctatatacatcatataartagaatcatacatttgtccttttgtggctggcttacttagcacaatgtcttcaagattcctccatgtattatagtagagtatgtcagaatttccttccttttaaagactaaataatattcctttgtgtgtatatgcacagtgagtatatgcattcatccatcaatgaatatttgcattgtttccaccttttggctgtcatgaataatgctgctgtctttttttaaattaaagttttatcaagtcacattgtggttttgtaatagaaagaatgtttgtcagggtcagaaactgtggagggg

SEQ ID NO: 177207 - DNA, 601 bp, Human
caggaacaagataaaaatgtgcacagtgcattttcaaatagtttatgtctctttctagtggttttctatgattgcttaagaaatcatgattaagtaagcaaatactggtaaaccaagtggtacatgaatatagtgccctcatgtatcctgcattcctaagtagggaaaacataatttaatatggacattttatttattttattttattttattttattttattttattttttgagacagagtctcactcttcgcccaggctggagtgcagtggctggatctcggctcactgcaagctccayctcccgggttcacgccattctcctgcctcagcctcccgagtagctgggactacaggcgcctgccaccatgcccggctaattttttgtatttttagtagagacggggtttcacggtgttagccaggatggtctccatctcctgacctcgtgatccacctgcctcggcctcccaaagtgttgggattacaggcgtgagtcactgcgcccggcttaatatggacattttaatcaaaaagagttagagcattattggttttccaaaaggaatataaatttcccttttacaggaaattatgttac

SEQ ID NO: 177208 - DNA, 601 bp, Human; identical to SEQ ID NO: 39718

SEQ ID NO: 177209 - DNA, 601 bp, Human; identical to SEQ ID NO: 39719

SEQ ID NO: 177210 - DNA, 601 bp, Human; identical to SEQ ID NO: 39720

SEQ ID NO: 177211 - DNA, 601 bp, Human; identical to SEQ ID NO: 39721

SEQ ID NO: 177212 - DNA, 601 bp, Human; identical to SEQ ID NO: 39722

SEQ ID NO: 177213 - DNA, 601 bp, Human; identical to SEQ ID NO: 39723

SEQ ID NO: 177214 - DNA, 601 bp, Human; identical to SEQ ID NO: 39724

SEQ ID NO: 177215 - DNA, 601 bp, Human; identical to SEQ ID NO: 39725

SEQ ID NO: 177216 - DNA, 601 bp, Human; identical to SEQ ID NO: 39726

SEQ ID NO: 177217 - DNA, 601 bp, Human; identical to SEQ ID NO: 39727

SEQ ID NO: 177218 - DNA, 601 bp, Human; identical to SEQ ID NO: 39728

SEQ ID NO: 177219 - DNA, 601 bp, Human; identical to SEQ ID NO: 39729

SEQ ID NO: 177220 - DNA, 601 bp, Human; identical to SEQ ID NO: 39730

SEQ ID NO: 177221 - DNA, 601 bp, Human
agtgacctttaaggaatccttttcaacattaaattcggcaataccacaaaattaaaagccatttgattccaatagccctggacacattaaagtaagggccaaagattttaaagaaaagatgcataaaatgagaatttaaaattgccaatttcaaattcccaagctgagataaacacatttctagttaagtaacgaggtcaattaaattcaaatttcgagattcaaaatctccatttttgaaattatttggttatccatatgtataaggctgttagtccattcaaacttggcctctcatcartggggataattttagatatttcgttaatgaacagtaaatttttaggtctatgattgtcataccatgattcctaataatttcatttgacaaacatacttttgacatcatgttttgtgtgtgtaaacatctatgtaagaatatcattttttcttttatcttctgcacagaagttactctgaaatgtatgagaaggcaatgaaatataatatgacagtaggtatattattctaaaagtcctaaagacgataacaaatattatccatttggggatagaagggaggtaaatgtatagcagatgtt

SEQ ID NO: 177222 - DNA, 601 bp, Human
ataggtggggacattaacaccccattttcagcattggacagatcatctagaaagaaaatcaacaaagaaacactggacttaatctaccatagaccaaatgaccctaatagacatgcacagaacattctatccaacacctgtaaaatacacattatttccttagcacatggaatattctcaaggatagaccacatgttagactacaaaacaagtctcaaaaaatttaaaaaaaaattgcaatcatgtcaagtctcttttctgaccacgatggaataaaactagaaatcaatagcaagagaarccttggaaactatgcaaacacatggaaattaaacaatatgctcctgaacgaccattatgtcaacgaataaattaaaaagaaaatttttaaaatttcttgaaacaaaagaaaatgggaacacaacacactaaaacctacgggagacagcaaaagtagtactaaaagagcagttaatagcaataaatgcctacatcaaaaaagcagggaaactttgaataaacaactgaatgaggcagcttatagaattagaaaagcaaaagtaagccaaactcaaaatttatagaagaaaataaataataa

SEQ ID NO: 177223 - DNA, 601 bp, Human
ttgggtaccagctaagccacactaaaataaagcaccagggaaactcctgtacctcctgattccatgcctttgtttctggacagtgtttctagacccacgctggaccagcagggaatccaatgtcctgatgggacaaaccccgttctgctgaatagagtggctttggcttggaataaacatcagcgacagccaggcagtagtgactacagccgtggggtgagccccagcactgtgctgggctacaaggctttacatgtgaccctgtgcagtgccagctgtcatggccattagagtgaccgcmttatccctcccccaactccaggcagcctggtgcagagactgacttcctttgccagaaagagagggaagtgggagagactttttacctggtaacccagggaattctcccttattttcccaaaatctaccaaagctgtgtatcaaggagtctgtaagagttgcagcattccggggcttagggcactctctagtgctgaaatggctgcagtgaccataggcttaggtcacaacactcaatcccttttgaattcttggaaagtcctctcaaaaaggatggctaaaaacaagcctatactgtgaa

SEQ ID NO: 177224 - DNA, 601 bp, Human
gccacagactgaaggctgcactattggttttcctacttttgaggttttgggattcggactgccttcctggctcctcagcttgcagatggcctgtgagactttaccttgtgattgtgtgaatcaattctcctaatagactcccctttatatatcacatctatcctattagttctgtccctctagagaatgctgactaatacagaggtggtagacttcagttgtgacaccagctgtggtggccaagggtgtgcctgtgtcactcatcccccaattccaggcagtgcagctcagggactctttycacttggagaaaggagagggaagaatacagagggctttgtcatgtaacttgggtaccagctaagccacactaaaataaagcaccagggaaactcctgtacctcctgattccatgcctttgtttctggacagtgtttctagacccacgctggaccagcagggaatccaatgtcctgatgggacaaaccccgttctgctgaatagagtggctttggcttggaataaacatcagcgacagccaggcagtagtgactacagccgtggggtgagccccagcactgtgctgggctacaaggcttta

SEQ ID NO: 177225 - DNA, 601 bp, Human
ttgcactggtgatgctgcaagcccagctcatctctgtaccttctggcaggactggagcctcagagaaaaactgacagtcccgtgctcaaggtatacaatagagtgagcattcacttcctgcccccttcactctccacctctcctctcagtaggaagaaggagaggattatttatggggtgggagagagggtcttcactttaaccctttgtttgccatcatatgctggccatggttgtcgttctttcaaaacagaaaataagtgctaggatatacttttgatatggtttggctctgtgtccscaccaaatctcatgttgaattgtcatccccagtgttggagatggggcctggtgggaggtggttggatcacatgggtggattctcatgaatgggttggcaccatccccctggtgctgttctcgtgatagtgagtgagtgagttatcatgagatgtggttgttttaaggtgaggggcacctccccttcctctctcttcctcctgcaccggccttgtaaagtactggctccccctttgccttcccctatgattgtaagtttcctggggcctcctcagaagcagaagctgctatgcttcctgta

SEQ ID NO: 177226 - DNA, 601 bp, Human
cttctgtgtcaggctggaggacccgcaagccttgcactggtgatgctgcaagcccagctcatctctgtaccttctggcaggactggagcctcagagaaaaactgacagtcccgtgctcaaggtatacaatagagtgagcattcacttcctgcccccttcactctccacctctcctctcagtaggaagaaggagaggattatttatggggtgggagagagggtcttcactttaaccctttgtttgccatcatatgctggccatggttgtcgttctttcaaaacagaaaataagtgctaggayatacttttgatatggtttggctctgtgtccccaccaaatctcatgttgaattgtcatccccagtgttggagatggggcctggtgggaggtggttggatcacatgggtggattctcatgaatgggttggcaccatccccctggtgctgttctcgtgatagtgagtgagtgagttatcatgagatgtggttgttttaaggtgaggggcacctccccttcctctctcttcctcctgcaccggccttgtaaagtactggctccccctttgccttcccctatgattgtaagtttcctggggcctc

SEQ ID NO: 177227 - DNA, 601 bp, Human
tctgcatttcgaatcgaaactacagaactgagcaaagcgttattcaaatactgtcattcattccaatttctcagcaaggcctatgatgcaatgttccttccactgacttcttggctatttttccttcttggctattcttccacacccaccttccctcctgttatacagaattttttcagtccctagaagtccttaaactctttagactttgagcctttactagggtgtattctcctgatggaaactttatcgttttttcctgatgaacttctctaatctttgactctttctagaagccgtygcaccctctactcaccattaggtgtccctcatcagaatgtattgccagtaaacacatctgcttagtctttcccattggctggtgagatcccctaagttaggagccatattcttcctgggccaggtatattggaagttctcataaataatcttggaatccatgactgataataaatataagttatttttatgtttatcttttaaatctacatgtcatggcaacttagcactcttttcaaatattatgttaaatgactggtatacagtaaaatttcaatgaaagtaagtttccattattctt

SEQ ID NO: 177228 - DNA, 601 bp, Human
tcaagagtgaatttaagtagcggaaacaactcctggtattaaatacaaatctgaaaacattacccgtatccctttgcttccctgtaagcctcagctgactagaaaggtggatgttttatgtcagttatagttttcctcacctcacctcacccacgatgagggcagcttgtttgaatggacatggattacaaaataagaaccacctcttcattactgttcttgaaattatatgtgggaaggaaacagacatttaaaaaaaaaactggttttctcacacacaggatttcagtttggggcttawgtaagaaactagcaagttatgtgaactataacttgcttggttggagagccttggaacacatcaattttgaaatgcttctaaacctatcaaattaacaacagcccaactgtcccaatgcttgaaatctacatggaaagcaacacagccttctccagagataatatgggtgctttagcactttgaaaggactatataaattgctctttaattatcaagacaaagagttaattatgtgaaatacttttaccagctacgtatgcaaaacatgacatcatatggaaaaaccacattccaagagtg

SEQ ID NO: 177229 - DNA, 601 bp, Human; identical to SEQ ID NO: 39731

SEQ ID NO: 177230 - DNA, 601 bp, Human; identical to SEQ ID NO: 39732

SEQ ID NO: 177231 - DNA, 601 bp, Human; identical to SEQ ID NO: 39733

SEQ ID NO: 177232 - DNA, 601 bp, Human; identical to SEQ ID NO: 39734

SEQ ID NO: 177233 - DNA, 601 bp, Human
cccaggaggcagaggctgcagtgagctgacatcatgccactgcactccagcctgggtgacagagactctgtctccaaaaacaaacaaaaacattcatgaggttaataccagcaacttcagctaccaatgattatcaactctccttttaaaaaactgaaatagatttgacctagagaagagaaaggtaactacacatctcctaggactttctgagttcctctctgatattcctatcttcctcacctgcagaagacaggaatatttctgcttatagtacaacttattttttttttaactggckagtaccagaagatttacaaatgtaaaatcaaacatgcagaaatatattttttgtcacaagacagagagcttgattaaatcatacaaatgtaagtttaatggtcaaaggctattttgaaaagaatgcatacctgctctttggatggcacaaggagttcttcaatcatcatgctgtcccgtgcataggagcttctgttcaaggtgtaagacctatccgaactgaaggagcggaggctgttgtatttacagttaaccattcaacagtggtagatgatgatgagatgaataaaaaaaaattaat

SEQ ID NO: 177234 - DNA, 601 bp, Human
cacttgagcccaggaggcagaggctgcagtgagctgacatcatgccactgcactccagcctgggtgacagagactctgtctccaaaaacaaacaaaaacattcatgaggttaataccagcaacttcagctaccaatgattatcaactctccttttaaaaaactgaaatagatttgacctagagaagagaaaggtaactacacatctcctaggactttctgagttcctctctgatattcctatcttcctcacctgcagaagacaggaatatttctgcttatagtacaacttattttttttttaactggcgagtaccagaagatttacaaatgtaaaatcaaacatgcagaaatatattttttgtcacaagacagagagcttgattaaatcatacaaatgtaagtttaatggtcaaaggctattttgaaaagaatgcatacctgctctttggatggcacaaggagttcttcaatcatcatgctgtcccgtgcataggagcttctgttcaaggtgtaagacctatccgaactgaaggagcggaggctgttgtatttacagttaaccattcaacagtggtagatgatgatgagatgaataaaaaa

SEQ ID NO: 177235 - DNA, 601 bp, Human
ctgtggtcccagctacttaggaggctgaggcatgagaatcacttgagcccaggaggcagaggctgcagtgagctgacatcatgccactgcactccagcctgggtgacagagactctgtctccaaaaacaaacaaaaacattcatgaggttaataccagcaacttcagctaccaatgattatcaactctccttttaaaaaactgaaatagatttgacctagagaagagaaaggtaactacacatctcctaggactttctgagttcctctctgatattcctatcttcctcacctgcagaagayaggaatatttctgcttatagtacaacttattttttttttaactggcgagtaccagaagatttacaaatgtaaaatcaaacatgcagaaatatattttttgtcacaagacagagagcttgattaaatcatacaaatgtaagtttaatggtcaaaggctattttgaaaagaatgcatacctgctctttggatggcacaaggagttcttcaatcatcatgctgtcccgtgcataggagcttctgttcaaggtgtaagacctatccgaactgaaggagcggaggctgttgtatttacagttaac

SEQ ID NO: 177236 - DNA, 601 bp, Human
ctgcagacatgtgggagtcccaaaagtctacctattgcttaacttctaacttggctatgatatgtgactatcatttattcatctgctccaattcacgttcattgtgcagtaagtcaaaaagcccagcatgatttcaccaattatttacattgtttaaatattataagccacctttaaaagttttattgtccagatagtttcatctgtcattaaatcactactgtgcatacttaaagccaggtattatctgtgtagtaattattccaggaccatcctgagcccacatgcaggaagactgtgktactggaacttcttatagtaacccgctatctattcaaccacaattattggaagaaaacaattacacaaacaccaaatgcatgtagcagagattctggtagaaagcaaaatactatcacatcttcagacacccatcaaaggcagctttgaagctaagggaacaaaaaatgaccagtctcatctttacttactaaaaacaattctaacaaattccaacatagatacacagtttgtttagcaaaatacaacattcaggctgggtgcggtggttcacacctgttcccagcactttgggaggccg

SEQ ID NO: 177237 - DNA, 601 bp, Human
tctagacatcagcatctgcagacatgtgggagtcccaaaagtctacctattgcttaacttctaacttggctatgatatgtgactatcatttattcatctgctccaattcacgttcattgtgcagtaagtcaaaaagcccagcatgatttcaccaattatttacattgtttaaatattataagccacctttaaaagttttattgtccagatagtttcatctgtcattaaatcactactgtgcatacttaaagccaggtattatctgtgtagtaattattccaggaccatcctgagcccacakgcaggaagactgtgttactggaacttcttatagtaacccgctatctattcaaccacaattattggaagaaaacaattacacaaacaccaaatgcatgtagcagagattctggtagaaagcaaaatactatcacatcttcagacacccatcaaaggcagctttgaagctaagggaacaaaaaatgaccagtctcatctttacttactaaaaacaattctaacaaattccaacatagatacacagtttgtttagcaaaatacaacattcaggctgggtgcggtggttcacacctgttcccag

SEQ ID NO: 177238 - DNA, 601 bp, Human
agtaataaaatatatattgtaggttcctatgaagtacaacacacatatgtaggtctagacatcagcatctgcagacatgtgggagtcccaaaagtctacctattgcttaacttctaacttggctatgatatgtgactatcatttattcatctgctccaattcacgttcattgtgcagtaagtcaaaaagcccagcatgatttcaccaattatttacattgtttaaatattataagccacctttaaaagttttattgtccagatagtttcatctgtcattaaatcactactgtgcatacttwaagccaggtattatctgtgtagtaattattccaggaccatcctgagcccacatgcaggaagactgtgttactggaacttcttatagtaacccgctatctattcaaccacaattattggaagaaaacaattacacaaacaccaaatgcatgtagcagagattctggtagaaagcaaaatactatcacatcttcagacacccatcaaaggcagctttgaagctaagggaacaaaaaatgaccagtctcatctttacttactaaaaacaattctaacaaattccaacatagatacacagtttg

SEQ ID NO: 177239 - DNA, 601 bp, Human
gcagaaaatttcaaccaattcctggcaacaccttatacccaagacttagtttcattatttgagacaagtgctttctctagtgctaatacccatttaaaacccatgacatgctattgcactgaaatggtttggctgtgtccccatccaaatctcatcttgaattgtagctcccacaattctcacctgttgtgggagggacctggtgggaggtaattgaatcataggggcaggtatttcccgtgctgttctcgtgatactgaataagtctcacaagatctgatggttttataagggggagttrccctgcacaaattctcttcttgcctgccaccatgtaagatgtctctttctcttccacaataattgtgaggcctccccagccatgtggaactgtgagtcaattaaacctcttttctttataaattacccagtctctagtatgtctttattagcagtgtgagaacagactaatacatgcacctataatcaattttttttttttttgacagagtctcgctctgttgcccaggctggagtacagtggtgcgatcttggctcactgcaaactctgcctcccaggttcaagcaattctcctgcctc

SEQ ID NO: 177240 - DNA, 601 bp, Human
tcaacaattaacattgctatatttgctttaactttatccacatgcattttggctgaactatttggaaataaatagttgaattaatgattgcttaattctggaaaacttcagcatgcataccccaatattctctgagtaggtccaataagtagcagtgataagctaagaaaattatcaatgctaaaattatcactgctaagaaaatgatcaatgatttcctacatacacagatatctccaagacattttcaaatgcccccaacagtccctaaaatgtctttatgactttcatttcccgctcygaaatctcctgccaatttattctggatttgcatggatctgagtagtgttatatgcttattaaacatgctggttccacaaggaatgcctatgtgggtattctgtgctcattaaagacagcaactttctgtttctacattatcaacttaaagtttattttgaaagattttcagatgtcctatgctctcctttcctctgatgggtctatagaagtgttcatgatgtccacagaggtatttttgagttggaagcaacaactgactacaagagcatcagtttcatctcaaaacttctctttgtct

SEQ ID NO: 177241 - DNA, 601 bp, Human
ccttccacctggattcaacaattaacattgctatatttgctttaactttatccacatgcattttggctgaactatttggaaataaatagttgaattaatgattgcttaattctggaaaacttcagcatgcataccccaatattctctgagtaggtccaataagtagcagtgataagctaagaaaattatcaatgctaaaattatcactgctaagaaaatgatcaatgatttcctacatacacagatatctccaagacattttcaaatgcccccaacagtccctaaaatgtctttatgactytcatttcccgctccgaaatctcctgccaatttattctggatttgcatggatctgagtagtgttatatgcttattaaacatgctggttccacaaggaatgcctatgtgggtattctgtgctcattaaagacagcaactttctgtttctacattatcaacttaaagtttattttgaaagattttcagatgtcctatgctctcctttcctctgatgggtctatagaagtgttcatgatgtccacagaggtatttttgagttggaagcaacaactgactacaagagcatcagtttcatctcaaa

SEQ ID NO: 177242 - DNA, 601 bp, Human
tcctccttcctccaagttactattttgaaattgttcacacaaatgaaaaagttgaaaaactgtataaaaaatacccatgtaccttccacctggattcaacaattaacattgctatatttgctttaactttatccacatgcattttggctgaactatttggaaataaatagttgaattaatgattgcttaattctggaaaacttcagcatgcataccccaatattctctgagtaggtccaataagtagcagtgataagctaagaaaattatcaatgctaaaattatcactgctaagaaaatkatcaatgatttcctacatacacagatatctccaagacattttcaaatgcccccaacagtccctaaaatgtctttatgactttcatttcccgctccgaaatctcctgccaatttattctggatttgcatggatctgagtagtgttatatgcttattaaacatgctggttccacaaggaatgcctatgtgggtattctgtgctcattaaagacagcaactttctgtttctacattatcaacttaaagtttattttgaaagattttcagatgtcctatgctctcctttcctctgatgggtcta

SEQ ID NO: 177243 - DNA, 601 bp, Human
ctaaagtaattgctgtaatccaggagataggaatgctctgaacggccagaattgggtctcactgttgcagaacaggagggacttatgccccttctaaacaacattagctgagaaatgggtggggttagggattcgaccatcagatccaggcactgccacggaaatgggtatatgtggaaagccaaatgggtgtatgcaggcaaaaccaaccgacatcgataagtgacttatgcttttctcccatctttgaatgactctataaaaaatcatactgaattacatgtttctgcctacagtatayacataccttttagtcttacaactaattctggtgtcatttaaaggaagataaactaattggttagcctgctaaatatttgtaaactgatgtcatgccttctaccttttatctgtctgaaggtcaaatagttccattcctgtaatgatgccttccatgccataatttttagtttttcatacttttttttttttttttggagacagagtctcgctctgtctcccaggctggagtgcagtggtgcgatctcggctcactgcaacctccacctactggttcaagcgattttcctgcttcagcctc

SEQ ID NO: 177244 - DNA, 601 bp, Human
accaaactgaactggtttaagatactccctttccagggatgggggaagactgaaattaaattgctggtttatatggcaagaaaatctgtatggtgctaacttcaaggtcggttgaatccagctcaaatgatggtaggaatcattggtcttcacattctactcccagcagctttggacgtatgtcatctttatagcttaggaaccccagtagagtttctctttcccaaaaggttagacaaagtctcaaatttgagtctcactagatgggctcagatttcactttttatcctaaagtaattgytgtaatccaggagataggaatgctctgaacggccagaattgggtctcactgttgcagaacaggagggacttatgccccttctaaacaacattagctgagaaatgggtggggttagggattcgaccatcagatccaggcactgccacggaaatgggtatatgtggaaagccaaatgggtgtatgcaggcaaaaccaaccgacatcgataagtgacttatgcttttctcccatctttgaatgactctataaaaaatcatactgaattacatgtttctgcctacagtatatacatacctttta

SEQ ID NO: 177245 - DNA, 601 bp, Human
gcttgagacatcaaaactaactgcactaccttaaggaagtcacaataccaacttctctgccttaaaacaaaaaatctgtaatcttgctgaccaattgttgagaggtgttgaatgcatcacctgaataatgctggcaaagcacattgaagagagaaagcagcatattaaatgtcaccagtcaaagatgcctatcttctagggggactatctctagcaaatctttaatctgaggctggctaccttctgccaccatgcacgtttctgagcaccccccttagaaattagcttatgtgaaagaaayagcaaggttaatctgccgacgggtgtgggagatgggggtgggagtgtgggtggaatagggttgagaggtagaggaggaaaatctgactgttagcataggcagtcttttgggttaggtattcttctcccttcctattactgaggtaattgaaaatgcttggatcttgaaaatacgagcaggaagtttcttctgaagaatgctccaattttcacactacttgctaacatatcaaattgtacattacacattatatgactaaatgtatatgaaatcatccttagcctcaaaaaagaccaagtc

SEQ ID NO: 177246 - DNA, 601 bp, Human
ggtcagagtggaagctgagcgtgtcaacacccagcttgagacatcaaaactaactgcactaccttaaggaagtcacaataccaacttctctgccttaaaacaaaaaatctgtaatcttgctgaccaattgttgagaggtgttgaatgcatcacctgaataatgctggcaaagcacattgaagagagaaagcagcatattaaatgtcaccagtcaaagatgcctatcttctagggggactatctctagcaaatctttaatctgaggctggctaccttctgccaccatgcacgtttctgagcwccccccttagaaattagcttatgtgaaagaaatagcaaggttaatctgccgacgggtgtgggagatgggggtgggagtgtgggtggaatagggttgagaggtagaggaggaaaatctgactgttagcataggcagtcttttgggttaggtattcttctcccttcctattactgaggtaattgaaaatgcttggatcttgaaaatacgagcaggaagtttcttctgaagaatgctccaattttcacactacttgctaacatatcaaattgtacattacacattatatgactaaatgtatat

SEQ ID NO: 177247 - DNA, 601 bp, Human
tggtaatcataataccccttccattaggtagccaaaagcacgaaatgagatgatgcatttaataaaatattgtggcaggtagtgtattaagtattataattattgtgacgtgcagtggatattgagtgaaatggcaaaccgcgacccaaatagatagtagtaggtttaaacatccagcactactacatggaaacacttttaagaaatggattccacaaaaggaaacctgacacaagtagtaaaataaaataaaaattaaaggcctactataatagaaaaagcaggtcttttttcccttacrgtatttattttcttgaagtcaactattattactcttaagacttattttgagaatagcatataaagaaatttcgttcattaaatttccgaattggattgatttcaagacaatctggttatgaactcgaacaaaagaaggtgaatcaaggtcagagtggaagctgagcgtgtcaacacccagcttgagacatcaaaactaactgcactaccttaaggaagtcacaataccaacttctctgccttaaaacaaaaaatctgtaatcttgctgaccaattgttgagaggtgttgaatgcatcacc

SEQ ID NO: 177248 - DNA, 601 bp, Human
gctctaccgcctaatagctgtggacaagctatttaactggacaagctaaacactcctcacagccctagtctcctcgtctgtaaagtggtaatcataataccccttccattaggtagccaaaagcacgaaatgagatgatgcatttaataaaatattgtggcaggtagtgtattaagtattataattattgtgacgtgcagtggatattgagtgaaatggcaaaccgcgacccaaatagatagtagtaggtttaaacatccagcactactacatggaaacacttttaagaaatggattccayaaaaggaaacctgacacaagtagtaaaataaaataaaaattaaaggcctactataatagaaaaagcaggtcttttttcccttacggtatttattttcttgaagtcaactattattactcttaagacttattttgagaatagcatataaagaaatttcgttcattaaatttccgaattggattgatttcaagacaatctggttatgaactcgaacaaaagaaggtgaatcaaggtcagagtggaagctgagcgtgtcaacacccagcttgagacatcaaaactaactgcactaccttaagg

SEQ ID NO: 177249 - DNA, 601 bp, Human
gcctgactaatgatgatatcaccgtctccaagagcttaatactttccaaaaatagtttctcactagtcctattcatcagagcaaagaggagaacaagtacacactggccttacaaacaaggacacacccaaatgcccaggtctggaaataattgtccaggcagggaaggaaagaggcagggtcaagaaagtgtttgcaagagagagagaaaaaaaggagaaatccaattaactccaatattagtaattctctacgttgctgactgtcaacctccagtgttagatgacatgagttaaggtcyagaactaaccctgcaagtttccttatctaacagctctaccatctatgggtgaaggtggtcttgcaaattaactggtagccttgacaggctaatgttaacagcaaccaggaaatctcccaataacaggtcacatgcaacactcagtgcaacaattctgggagattgtaaatacaatttagtttagtaacagttggatgatacaatcagactaggagccacagaaagtaaagggctatcagggataacttcactctacggccacaacttggacagggccaaggcagaggaagtcatgtgggt

SEQ ID NO: 177250 - DNA, 601 bp, Human
acattatttaatggagtccaaagcctgactaatgatgatatcaccgtctccaagagcttaatactttccaaaaatagtttctcactagtcctattcatcagagcaaagaggagaacaagtacacactggccttacaaacaaggacacacccaaatgcccaggtctggaaataattgtccaggcagggaaggaaagaggcagggtcaagaaagtgtttgcaagagagagagaaaaaaaggagaaatccaattaactccaatattagtaattctctacgttgctgactgtcaacctccagtgytagatgacatgagttaaggtccagaactaaccctgcaagtttccttatctaacagctctaccatctatgggtgaaggtggtcttgcaaattaactggtagccttgacaggctaatgttaacagcaaccaggaaatctcccaataacaggtcacatgcaacactcagtgcaacaattctgggagattgtaaatacaatttagtttagtaacagttggatgatacaatcagactaggagccacagaaagtaaagggctatcagggataacttcactctacggccacaacttggacagggcca

SEQ ID NO: 177251 - DNA, 601 bp, Human
cattttggaagtgatgtcaaggattattcaactgaaaatgcacattatttaatggagtccaaagcctgactaatgatgatatcaccgtctccaagagcttaatactttccaaaaatagtttctcactagtcctattcatcagagcaaagaggagaacaagtacacactggccttacaaacaaggacacacccaaatgcccaggtctggaaataattgtccaggcagggaaggaaagaggcagggtcaagaaagtgtttgcaagagagagagaaaaaaaggagaaatccaattaactccaayattagtaattctctacgttgctgactgtcaacctccagtgttagatgacatgagttaaggtccagaactaaccctgcaagtttccttatctaacagctctaccatctatgggtgaaggtggtcttgcaaattaactggtagccttgacaggctaatgttaacagcaaccaggaaatctcccaataacaggtcacatgcaacactcagtgcaacaattctgggagattgtaaatacaatttagtttagtaacagttggatgatacaatcagactaggagccacagaaagtaaagggctatc

SEQ ID NO: 177252 - DNA, 601 bp, Human
agtcccagcactggggcattatagtaatacacataggatgcttttatcaaaccaatggaggccattcaagaatgcatcttatcaatgcctaggtcttattattgactcaaaatatttacattcctttgttaacagcactaccacaacttactgtgcatcagttcaatggtaaggactgacctaggcccatacattcattttttgtttgagttgtcagaacctattagccctgagagtaatggagccatttgacagatgaggaaaatgaggtttagaaagacttcaaaaactaggcaatacraagtcaacacctagcactgggtggctttaatagaacactatgttaaagaaaaattcacacggaatttttaataatttttattcccatgtcaaagataatatgaataagcacattacttttcattttggaagtgatgtcaaggattattcaactgaaaatgcacattatttaatggagtccaaagcctgactaatgatgatatcaccgtctccaagagcttaatactttccaaaaatagtttctcactagtcctattcatcagagcaaagaggagaacaagtacacactggccttacaaac

SEQ ID NO: 177253 - DNA, 601 bp, Human
ttgacctttccttatctttacttattgaaagctccttcagagatgccccagcatcacctgctggttttgtgatcattagcagattactcaacttttttcagtcttagtttctgcattttcaaactggggatggttgatatggagataaaagaaaacatatacgtcaaagtctggcaccaatgcagtgctggtgttggcatggaattatcataatgtctccttatatgtgtaaagccttctatacttttcaaaagactttcacttatattagctcatttgtcacaatctgatcatttatggkggaaaacagcaaaaataaaaatattccagtcccagcactggggcattatagtaatacacataggatgcttttatcaaaccaatggaggccattcaagaatgcatcttatcaatgcctaggtcttattattgactcaaaatatttacattcctttgttaacagcactaccacaacttactgtgcatcagttcaatggtaaggactgacctaggcccatacattcattttttgtttgagttgtcagaacctattagccctgagagtaatggagccatttgacagatgaggaaaatgaggttt

SEQ ID NO: 177254 - DNA, 601 bp, Human
ccacgtggctcagacactaagccagtcctcgcctggcctccatcaggaataaaggagatattttgtcattgacctttccttatctttacttattgaaagctccttcagagatgccccagcatcacctgctggttttgtgatcattagcagattactcaacttttttcagtcttagtttctgcattttcaaactggggatggttgatatggagataaaagaaaacatatacgtcaaagtctggcaccaatgcagtgctggtgttggcatggaattatcataatgtctccttatatgtgtaargccttctatacttttcaaaagactttcacttatattagctcatttgtcacaatctgatcatttatggtggaaaacagcaaaaataaaaatattccagtcccagcactggggcattatagtaatacacataggatgcttttatcaaaccaatggaggccattcaagaatgcatcttatcaatgcctaggtcttattattgactcaaaatatttacattcctttgttaacagcactaccacaacttactgtgcatcagttcaatggtaaggactgacctaggcccatacattcattttttgt

SEQ ID NO: 177255 - DNA, 601 bp, Human
attatctgactttaaattatactacagagatataatcaccaaaacggcatggtgctgggaaaaaatcaggcacatagatcagtggaacacaatatagaacccagagataaatccatacatctacagtgaactgatttttgacaaaggtgctaagaacgtacattggaggaataatagtctcttcaataaatgatgctgggaaaatcagatagccatatgcaaaagaatgaaactaggcccctatctctcgccatatacaaaaatcaaatcaaaatgaattaaagacttaaatctaagaccycaaactatgaaactactaaaaaaaaatacattagggaaactctccgggacattgaactgtgcaaaaatttcttgagtaataccccacaagcacaggcaaccaaggcaaaaatagacaactgggatcacatcaagttgaaaagcttccgcacagcaaaagaaacaatcagcaaagtgaagagacaacccacagaatgggagaatgtattgacaaactctccatctgacaagggattaataaccggaatatataatgagctcaaacaactctctaaggaaaaaaaaaatctaataatccaac

SEQ ID NO: 177256 - DNA, 601 bp, Human
caaaactggaagaatcacattatctgactttaaattatactacagagatataatcaccaaaacggcatggtgctgggaaaaaatcaggcacatagatcagtggaacacaatatagaacccagagataaatccatacatctacagtgaactgatttttgacaaaggtgctaagaacgtacattggaggaataatagtctcttcaataaatgatgctgggaaaatcagatagccatatgcaaaagaatgaaactaggcccctatctctcgccatatacaaaaatcaaatcaaaatgaattaawgacttaaatctaagacctcaaactatgaaactactaaaaaaaaatacattagggaaactctccgggacattgaactgtgcaaaaatttcttgagtaataccccacaagcacaggcaaccaaggcaaaaatagacaactgggatcacatcaagttgaaaagcttccgcacagcaaaagaaacaatcagcaaagtgaagagacaacccacagaatgggagaatgtattgacaaactctccatctgacaagggattaataaccggaatatataatgagctcaaacaactctctaaggaaaaaa

SEQ ID NO: 177257 - DNA, 601 bp, Human
gtttttaggtaccttagtgctttctcttctgagttttgtggtttcctcaggtttatgagcagacgtaactcaattttaataacctaaatacagggaaacaaaatactcttcctatggcgcatccatctaaatataaaatgaagcaattcaatggaacctacggttttatacatagatactgaattggtatttcatttccatgctacctgtctgcgaagacttactcctacagattagaatctacttaaaaccgaaatataaaatttcaactattcacttatgtttgttctgacatgttackgtgcatagcaccacagtactaacaaaaaaactttgcctctatttaattactgaacaaatacacatttaaaatgattaacagggccaggtgcggtggtggctcatgcctataatcccaacactttgggaggctgaggtgggtggatcacttcaggtcaggagttcaagatcagcctggccaatatggtgaaaccccatatctattaaaaattcaaaaagaaaactagacgggtgtggtggcatgcacctgtaatcccatctaatcgggaggctgagacaggagaatcgcttgaacccgggg

SEQ ID NO: 177258 - DNA, 601 bp, Human
agatcacctaatgaatgtgaacacattgagagatttgtacaactgggggagagttttggggttggactattgatatgcacagaggacatcaagcaagtgaaaaaactccagggaaaataaaatattgtgctggaaagaaaaagcaatcaggtcaggcacggtggctcatgactaatcccagcactttgggaggctgaggcaggtagatcacttgaggtcaggagtttgagaccagcctggccaacatggtgaaaccccttctctactaaaaatacaaaaaattagctgggcgtggtggcaygtacctgtaatcccagttgggaggctgaggcaggagaatcgcctgaacccgggaggcggaggttgcagtgagccgagattgcgccactgcactccagcctgggtgacagagcaagactccgtctcaaaaaaaagaaagaaaaagcaatcataatataagccacatatgtgagtaacatttacacaggcataacaagataagcatcaaatacagatataagcaaaataaattacaactgtttgcggaaatgggaggatacgaagtgtgcatagggaggaaaagtgtggaaaaaaaagcttc

SEQ ID NO: 177259 - DNA, 601 bp, Human
aaagtatagagaaatttttaactctagaaaataggagagaaaatacaagaaagcaaaagataagttcaggaggttcaaatcctcccctcagtctaaaaaaaaagaagtcctagaaagaaaaaaaattgtgaacaaaggaaaataaatcaaggaaacaatttaagaaacttttccagagccaaagacagaggttgccagcgtaaaatgacccagtgagtgaccaacactatgaatacagaacccattatggtacatcatcgtaacatttcagaattcggagacaaagacagggtctataaayatggagagaaaaaatggtcacagatggagggtctgtgtcagacttttaacagcaaaacgtgaaggtaaaaggcaatagagcaattcctttaacatgctgacaggaaatgacttcaagtcagaattctataaccagctaaattaaaaacaagtataaactagacagatattttcagatatataacaccttaaaaaacatatttctcatgcactctctgaggaaactaatggaagatgtactccaccaaagtgaaggactgacccaagaaaagggagggcatggactccaacacaagagaaa

SEQ ID NO: 177260 - DNA, 601 bp, Human
tggtgtgctggggggaaaccagaggtagtgtgagctttcaccagggctgcagaccagcctcatttcagcaaaatcttaattgaattaaaatttactattctatttgcctagcagagggagggcaaacattctgtgaaggaatatatcaccatcgggtgtgtccacaattttttatacaccatgtctagcataaagtgaaaaattgccaagcatggtcagagtgtgtggataaaaccagaaaaatgaaataaaaccaaaccaagctagagagacactataaatagactcccaggccatcccrattctgaggtaagctaataagtgctttataataactatgattagtatgtttacaaaaacacagggaaagatagagaaaataaattaaatgggatagaatgctagaatatacataagaaggaatcaaatgggcattggttcagtgctaaatacaatgtcagttctttacttagacacaatataaaagagggttaagttagagccctaaatggaaaaatatacaaaatgaaggataggttaaaaaaaagaaagaaaacagtacaagatgtggaacattgagagattttaacataggtgtaaa

SEQ ID NO: 177261 - DNA, 601 bp, Human; identical to SEQ ID NO: 39735

SEQ ID NO: 177262 - DNA, 601 bp, Human; identical to SEQ ID NO: 39736

SEQ ID NO: 177263 - DNA, 601 bp, Human; identical to SEQ ID NO: 39737

SEQ ID NO: 177264 - DNA, 601 bp, Human; identical to SEQ ID NO: 39738

SEQ ID NO: 177265 - DNA, 601 bp, Human; identical to SEQ ID NO: 39739

SEQ ID NO: 177266 - DNA, 601 bp, Human; identical to SEQ ID NO: 39740

SEQ ID NO: 177267 - DNA, 601 bp, Human; identical to SEQ ID NO: 39741

SEQ ID NO: 177268 - DNA, 601 bp, Human; identical to SEQ ID NO: 39742

SEQ ID NO: 177269 - DNA, 601 bp, Human; identical to SEQ ID NO: 39743

SEQ ID NO: 177270 - DNA, 601 bp, Human; identical to SEQ ID NO: 39744

SEQ ID NO: 177271 - DNA, 601 bp, Human; identical to SEQ ID NO: 39745

SEQ ID NO: 177272 - DNA, 601 bp, Human; identical to SEQ ID NO: 39746

SEQ ID NO: 177273 - DNA, 601 bp, Human; identical to SEQ ID NO: 39747

SEQ ID NO: 177274 - DNA, 601 bp, Human
aggctcacagagttcaataaatttgcccaaggtcattcctcaagtaccctacggttcacctcgctcctttgttcacaccttgaaactcactggagactatgctgagtgcattccaaaagtcagtgaattgaaaaagagtggatcttatggaatatgaattatatctcgaataaagctgttgtttaaataattcctggatttggagtgattaggaagtgagtataaaggaagaattagctctgatatttttctctcagcatcagacgttatggtgagcctgttctctaatttttttttttttacatttttaaaggaaaactctgcgtcaaacacctattctcaaaaccagactattcccaatgtctactaagaaaaattgctctggttcttagggtcagacagcctgaagaagttgtgtatgaaaaagtgacatgctcagatatataccagtcttactaggtcaaagaatgagacattgaaacaacacagaccccaataattaccctgaaacattttttaaagactaattatggcccaagagaaatcaaaaatttatgaaggatactgaaattatctgggagaaacttgaaaaagctgaaag

SEQ ID NO: 177275 - DNA, 601 bp, Human
ctgattagcacccttatcagtaaagtggaattaaaaccacctgatttgcagtgctatcctttctttttaaatttttcacatatgaaggcatttatcagtgcttcatgaatgctagacactcaacaattactattctccctctaccttgctgtaaagacatctttaaattcatggttggtggcgattgtgtcttataccaaacctttggcatgacaattttttctacagaacaaatataatggtgataataactcataattatcaagggcttactatgtaacaaggactgtatttcacatgygcctcacataattattttatttattctcaacaataaccataggaagttaggaaggtaatctccattttgcagaagaaagacaggctcacagagttcaataaatttgcccaaggtcattcctcaagtaccctacggttcacctcgctcctttgttcacaccttgaaactcactggagactatgctgagtgcattccaaaagtcagtgaattgaaaaagagtggatcttatggaatatgaattatatctcgaataaagctgttgtttaaataattcctggatttggagtgattaggaagtga

SEQ ID NO: 177276 - DNA, 601 bp, Human
gagaggatcacaaaaagtaactagtaggtactaggctttgaacctgggtgaaagaataatttgtataataaacacctgcaatacaagtttacctatataacaaacctacacgtgtaggtttgagtttggcactcaatctctctgagccttagtttaggctgagggaggagaattgcttgaacccaggaggcggacgttgcagtgagctgagattgtgccacggcactccagcctgggtgacagagtgagactccatctcaaaaaaaaaaaaaaaaaaaaaaaaaagaaacaaagaaagaaagaaaagaaaagaaaagaaaagaaaagaagtagacctacatttggaccccagccttactactcagtggaataaccttagatatgttacttgacatctctgaacttcagtttccttataagtggaattaaaaccacctgattagcacccttatcagtaaagtggaattaaaaccacctgatttgcagtgctatcctttctttttaaatttttcacatatgaaggcatttatcagtgcttcatgaatgctagacactcaacaattactattctccctctaccttgctgtaaagacatctttaa

SEQ ID NO: 177277 - DNA, 601 bp, Human
gagtgagaggatcacaaaaagtaactagtaggtactaggctttgaacctgggtgaaagaataatttgtataataaacacctgcaatacaagtttacctatataacaaacctacacgtgtaggtttgagtttggcactcaatctctctgagccttagtttaggctgagggaggagaattgcttgaacccaggaggcggacgttgcagtgagctgagattgtgccacggcactccagcctgggtgacagagtgagactccatctcaaaaaaaaaaaaaaaaaaaaaaaaaagaaacaaagaaagaaagaaaagaaaagaaaagaaaagaaaagaagtagacctacatttggaccccagccttactactcagtggaataaccttagatatgttacttgacatctctgaacttcagtttccttataagtggaattaaaaccacctgattagcacccttatcagtaaagtggaattaaaaccacctgatttgcagtgctatcctttctttttaaatttttcacatatgaaggcatttatcagtgcttcatgaatgctagacactcaacaattactattctccctctaccttgctgtaaagacatct

SEQ ID NO: 177278 - DNA, 601 bp, Human
gtaggaggagtgagaggatcacaaaaagtaactagtaggtactaggctttgaacctgggtgaaagaataatttgtataataaacacctgcaatacaagtttacctatataacaaacctacacgtgtaggtttgagtttggcactcaatctctctgagccttagtttaggctgagggaggagaattgcttgaacccaggaggcggacgttgcagtgagctgagattgtgccacggcactccagcctgggtgacagagtgagactccatctcaaaaaaaaaaaaaaaaaaaaaaaaaagaaasaaagaaagaaagaaaagaaaagaaaagaaaagaaaagaagtagacctacatttggaccccagccttactactcagtggaataaccttagatatgttacttgacatctctgaacttcagtttccttataagtggaattaaaaccacctgattagcacccttatcagtaaagtggaattaaaaccacctgatttgcagtgctatcctttctttttaaatttttcacatatgaaggcatttatcagtgcttcatgaatgctagacactcaacaattactattctccctctaccttgctgtaaa

SEQ ID NO: 177279 - DNA, 601 bp, Human
acaaagtcttgctgtcgtcaggctggagtgcagtggcgcgatcttggctcactgcaacctgcgcctcccgggttcaagtgattctcttgcctcagcctcccgagtagctgggactacaagcacatgccaccacgcccagctaatttttgtatttttagtagagacgggggtttcaccatgttggccaggatggtctccatctcttgacttcgtgatccacttgcctcggcctcccaaagtgctgggattacaggcgtgaaccacactgcacccggcctatttgtcttttttaaggaaaccytgagtgacctggtcactggtttaattcaggaactatttttatcttgttaattaacagttattcagtagcaaaatgggaggggaacagagaggataaaagaacataaaaaacatgaaacctcctaaactgtgcttatgcttctctctgaactagaactttgaacagttgtcccttcaaggaagaagttggctttttaaaaagacagatttgggttttttttttggctggtctgcttttgaagagaggaaagttctggtaagaatgaagtgtttttggggatatgaaaagagtggcgagaag

SEQ ID NO: 177280 - DNA, 601 bp, Human
gacaatttatttttttttttctgagacaaagtcttgctgtcgtcaggctggagtgcagtggcgcgatcttggctcactgcaacctgcgcctcccgggttcaagtgattctcttgcctcagcctcccgagtagctgggactacaagcacatgccaccacgcccagctaatttttgtatttttagtagagacgggggtttcaccatgttggccaggatggtctccatctcttgacttcgtgatccacttgcctcggcctcccaaagtgctgggattacaggcgtgaaccacactgcacccggmctatttgtcttttttaaggaaaccttgagtgacctggtcactggtttaattcaggaactatttttatcttgttaattaacagttattcagtagcaaaatgggaggggaacagagaggataaaagaacataaaaaacatgaaacctcctaaactgtgcttatgcttctctctgaactagaactttgaacagttgtcccttcaaggaagaagttggctttttaaaaagacagatttgggttttttttttggctggtctgcttttgaagagaggaaagttctggtaagaatgaagtgtttttg

SEQ ID NO: 177281 - DNA, 601 bp, Human
gagttttaagattttcagagaagaacctacaacaggactggttataaaagtggcatgtagattggttataaagtagcacatagaattcatctatggagaagggggttgaaaaagtaaacatttataacaagacagacattatcaagggtcacttgccacagatgacagataaagcttaattgttatgaaattaatacgttatattaaataatggtaagacaatttatttttttttttctgagacaaagtcttgctgtcgtcaggctggagtgcagtggcgcgatcttggctcactgcaacytgcgcctcccgggttcaagtgattctcttgcctcagcctcccgagtagctgggactacaagcacatgccaccacgcccagctaatttttgtatttttagtagagacgggggtttcaccatgttggccaggatggtctccatctcttgacttcgtgatccacttgcctcggcctcccaaagtgctgggattacaggcgtgaaccacactgcacccggcctatttgtcttttttaaggaaaccttgagtgacctggtcactggtttaattcaggaactatttttatcttgttaattaacagt

SEQ ID NO: 177282 - DNA, 601 bp, Human
catattttttgtgtcatacaaagaaactaagaggtgtcttcattagtaacggacaacttaaataccagctgacatatatgtggctcttttgttctacacaaagcactttcacaggcatcattcatttgagagcatacagaggcaaaggagcagtgcagagagacaactaggtgtggagtcagaagtccaggtttggaagactaaatctatttactgtttccgggtggtggcgatgttgagtgtgtgtcatcataatcaacgatgaccagggcttttactagctgatgtagtgtctttgtaygatttggaaaagggtgcccacttggggtgtatacaaccttgtaggtacacaggttggcaactagatagcagctttgagcaaattagaagaaagtacccctatgtcttacaggccagtgtcagggcagatggcttgacaagtgaaaagggcaagatttcagaccccatttgctctcctgcacaacttacacggcagttgtgactatgactaaacactgattgagtgattctcatatatcaggcatcaagctaggagctttacatatattagctcatctattccttattagttcactattag

SEQ ID NO: 177283 - DNA, 601 bp, Human
tagaacaaaatctatgtctgctgccaaagttaaagttgttcttgttgcatgataccttagtggtgatggcaagttcttcacacccagaccaactgtcctttctgtgattctagcctcttcaatagacctttgctaatacacctacttcgttagcaaaaccactgatatttcagtccctgggcttgctggtgataaggagtaacttttaattcccccttattttgcagctacagtttttcctgaatacataccatattttttgtgtcatacaaagaaactaagaggtgtcttcattagtaayggacaacttaaataccagctgacatatatgtggctcttttgttctacacaaagcactttcacaggcatcattcatttgagagcatacagaggcaaaggagcagtgcagagagacaactaggtgtggagtcagaagtccaggtttggaagactaaatctatttactgtttccgggtggtggcgatgttgagtgtgtgtcatcataatcaacgatgaccagggcttttactagctgatgtagtgtctttgtacgatttggaaaagggtgcccacttggggtgtatacaaccttgtaggtaca

SEQ ID NO: 177284 - DNA, 601 bp, Human
tttttattctctccttgggaatttttcaaaactgttactagatttctccagcagatggtgctgtgcacaacataaagctacacatttcacatcagtgctcaactgcttctacaatgacttaacactattggtctcatggcaaaaacaattaaattatattgaaatgaacccaattggcaacttctgagaagtctgtttctaagatactgtttatgtagtcagacagtaaatttaaaaaattttctgttacatagcaagtaccaatttccctttcctgtttacaataaaacaatagtgtaaytattcaatctaaaatgtattatcttaaaaacttcatttgctctcatttgaaagttcagcaatgacaagaaaatatgttcctagcattgtaaaattgtttgggggaacttcagcaacattttgttccaagacagcgattgggatttttaaataatggcataattcatatatactcaaagccttccgtgtaatacttaggtagcaacaatttttgtgttaaaacaaaatagatatgtaaaacaaagcatacacactgtccagagaggcactgtccagtaaaaatataatgtaaactgggtat

SEQ ID NO: 177285 - DNA, 601 bp, Human
ttaaacacaatgaatcaataacctcgcatgagcagcaaatacagaacacactaaactccaaaagcttagacctgcagtttctggcacactggtctctctgttcacatcaacactaaaggtagtggaggctgatgtccaacctcgtggacctgcttcactgccctcagagggctaaaagctctactgtgcctgatatggggggtggggggcaggatggcttatgtcattattttgatccactaatgtttcataaagacatgtaatttctggcaaatccatatatgcaaatgcattaaaaacytgtccttattaatgcttatttgctttgtcctaattttcatttctaaactagaatttttatttctactagtttgggggactgttctgctacagtttcctttcctttccaacacgatggacatcattcaattgatttaaaatgccagtttatggcaataggctgaaagtcagtattttgctatggttttttttttttttttttttttgcaccccaaccacagtcctgatttggttaaattctatttttattctctccttgggaatttttcaaaactgttactagatttctccagcagatggt

SEQ ID NO: 177286 - DNA, 601 bp, Human
cctctgtgttgtgttcattttttttcaaagcttttagcaattcttttgacaccattaaaacttgcatggttattgaccttcaatgtacattttaacagtattttgaagataagccccaactcaaagacacaactaatgtgggaatttcaggcactgctgtaggcaagggggacatttagtgtctccatgtactattccttaaatagaatcacatgcactgccttcttcaacagtcagatttccaggtgtctacatgatgaaatggagaaacagtattctatttttttttttttttttttttggacagggtctcactcactctgttgcttaggatagagtgcagtggtataatctctgctcactacaattttcacctcccggattcaagcagttctcctgtctcagcctcccaagtagctgggattacagccatgcgctaccatgcccagctaatttttgtatttttagtagagatggggtttcacaatgttggccaagctggtattgaactcctgagctcaagtgatgtgcccgcctcagcctcccaaagttctgggattacaggcatgacccgtgaaaaccacgcccagcctctctggtt

SEQ ID NO: 177287 - DNA, 601 bp, Human
atgttctccttcaaaatggctcaggactccttatggtgctagcaatttaagaagacagatcatgaaattacatccttcaaatggggcagatttcctaattctgcttataacaagctgtgtatcctgtgagtatgaaatttacttgagatcagtctagacccaccagaggaactgaggcatcttttggggaactggaagtactgtacacttcttagctatttttgtgtgtgagagagttctgggtatatgtgcacacatttgtgaggattaaaagtagaaagaaacagctataacacccccraaaacgatgacagcactgaattgagaagaattgccactttgcgtgatagaggcaggctgaccacacttaagctctactctgtcacctttgataaggcattaaagccaccccaaatataaagtgaacatgtacatttcagatgcagcagacaagttgcaagtggaaatgctcagatttctaactatataaacagagaagctccgaggagaagcgatcagtaccctccacattcaaattctgacatattttataatttcccagcagctcagggaccctctgtgttgtgttcattttttttca

SEQ ID NO: 177288 - DNA, 601 bp, Human
gacactagagggtagactggagggaggataggagggagccagacaaagagcgactgccctgtataacctgcggaaattgctgtacacctgagcaagatgcacagcaatgtgcacaggatcatcctttataggggaaaatgtaatctgcacatttttgtttttttttttttgagacggagtctcgctctatcgctaggctggagtgcagtggcacaatctccactcactgcaagctctgcctcccgggttcaagcacccctcctgcctcagcctcccgagtagctgggactacaggcatgcsccaccatgcccagctaattttcgtacttttagtagagatggggtttcaccatgttggccaggatggtctcgatctcttgacctcgtgatctgcccacctcagcctcccaaagtgctgggattacgggcgtgagccaccgcgccaggctacgtttgtatatttttataagaaatatgtagaagaaacattctaggctgttagcaatggttacctcagaggaacaggaaatggaattggggaaggaagatgagaagagggtagggaacaaggagtattacccttgggttgatatagctatgc

SEQ ID NO: 177289 - DNA, 601 bp, Human
agccgagatcacgccactcactccatcctgggcaacagagtgagactccatttccaaaaaaaaaattaaaatcttaccaaaaaattcaggaaaatatggtttcgctttagttaggggaaactttcctatacaaaactggaaacccagaagcctaaaagcataatataaaaggtaatatatttgactacataaaaatgtaaagatttccatgacaaaaagagtaaacttgaaaagcaaaaagtagactggaaaaatagccacacctgacaagtaaaagattaatatgctcaataccaaacgyattaataataggatggcagataagtcaatagatgatagcaaaatattataaacaggcaattcacagaagctgaaaaatggtcaataaaacatattacaatgttcaaactggataatttacatggaaatgccaattagaatgagatactatctccctccacacccacttcttggattagctaaaattaaacactaatcacatcttgttatcagagaaaaattaagggaaataagtgctttcattactgcaagtgggtgtgaatggcaataattttttaacagtgtaactgggcatcatcta

SEQ ID NO: 177290 - DNA, 601 bp, Human
catatacttttatatatgtattatgtatttaagttatatttaaatcaaggtaatatatttaaatttcaaataagtgagagaaagatgatttatttaaaagatggtatttacataataggaaatctatttggaaaaacaaagctaaatcacatcttattgtatataaataaaaaattacatttgcttaggagacaactatttttaaaaattaaaatctggccaggcgtggtggctcacacctgtaatcccagcactttgggaggccgaggcagattacgaggtcaggagttcaagaccagcygggccaacatggtgaaatcccatctctactaaaaagtacaaaatttagctgggtgtggtggcatgcgcctgtaatcctagctacttggggtgctgagacaggagaattacttgaacctgggaggcgaaggttgcagtgagccgagatcacgccactcactccatcctgggcaacagagtgagactccatttccaaaaaaaaaattaaaatcttaccaaaaaattcaggaaaatatggtttcgctttagttaggggaaactttcctatacaaaactggaaacccagaagcctaaaagcata

SEQ ID NO: 177291 - DNA, 601 bp, Human; identical to SEQ ID NO: 39748

SEQ ID NO: 177292 - DNA, 601 bp, Human; identical to SEQ ID NO: 39749

SEQ ID NO: 177293 - DNA, 601 bp, Human; identical to SEQ ID NO: 39750

SEQ ID NO: 177294 - DNA, 601 bp, Human; identical to SEQ ID NO: 39751

SEQ ID NO: 177295 - DNA, 601 bp, Human; identical to SEQ ID NO: 39752

SEQ ID NO: 177296 - DNA, 601 bp, Human; identical to SEQ ID NO: 39753

SEQ ID NO: 177297 - DNA, 601 bp, Human; identical to SEQ ID NO: 39754

SEQ ID NO: 177298 - DNA, 601 bp, Human; identical to SEQ ID NO: 39755

SEQ ID NO: 177299 - DNA, 601 bp, Human; identical to SEQ ID NO: 39756

SEQ ID NO: 177300 - DNA, 601 bp, Human; identical to SEQ ID NO: 39757

SEQ ID NO: 177301 - DNA, 601 bp, Human; identical to SEQ ID NO: 39758

SEQ ID NO: 177302 - DNA, 601 bp, Human; identical to SEQ ID NO: 39759

SEQ ID NO: 177303 - DNA, 601 bp, Human; identical to SEQ ID NO: 39760

SEQ ID NO: 177304 - DNA, 601 bp, Human; identical to SEQ ID NO: 39761

SEQ ID NO: 177305 - DNA, 601 bp, Human; identical to SEQ ID NO: 39762

SEQ ID NO: 177306 - DNA, 601 bp, Human; identical to SEQ ID NO: 39763

SEQ ID NO: 177307 - DNA, 601 bp, Human; identical to SEQ ID NO: 39764

SEQ ID NO: 177308 - DNA, 601 bp, Human; identical to SEQ ID NO: 39765

SEQ ID NO: 177309 - DNA, 601 bp, Human; identical to SEQ ID NO: 39766

SEQ ID NO: 177310 - DNA, 601 bp, Human; identical to SEQ ID NO: 39767

SEQ ID NO: 177311 - DNA, 601 bp, Human; identical to SEQ ID NO: 39768

SEQ ID NO: 177312 - DNA, 601 bp, Human; identical to SEQ ID NO: 39769

SEQ ID NO: 177313 - DNA, 601 bp, Human; identical to SEQ ID NO: 39770

SEQ ID NO: 177314 - DNA, 601 bp, Human; identical to SEQ ID NO: 39771

SEQ ID NO: 177315 - DNA, 601 bp, Human; identical to SEQ ID NO: 39772

SEQ ID NO: 177316 - DNA, 601 bp, Human; identical to SEQ ID NO: 39773

SEQ ID NO: 177317 - DNA, 601 bp, Human; identical to SEQ ID NO: 39774

SEQ ID NO: 177318 - DNA, 601 bp, Human; identical to SEQ ID NO: 39775

SEQ ID NO: 177319 - DNA, 601 bp, Human; identical to SEQ ID NO: 39776

SEQ ID NO: 177320 - DNA, 601 bp, Human
aaacagagctgctttttattttcttatatccacgtatgagtcatcatttcagtttaaaatacttttaatatctaaaaatagagtaaacctcaaagaaaaaaatctattagattgtaccacaaaagtacaaagaacaagcaaatctatcacagtgaggttttaaagtgattagaaatacatgttaagacaatcatcatcaacttatataaattataaaaattatacttctaattttaaatttctaactaactgctgtcaactcacctcattttaggcttggaatttcatctctttaatttttaaaacacgctttcagacaacagaccatacagaacagaacttagatgggtcagatgctatagactgtttatgccaaggagccagaaaggatcagaatgattatcctcctcccataaggaagaacacggagtgggagttaggaaacctaaatcccagataaaatactgggtcttaaactagttacttaacgtctctctggttcttgtccctcctaaaaatggctaaacagatacttattcccttttcctgcaccatgaatgaaggtataacgaaatggcatacattttacttggaacttttt

SEQ ID NO: 177321 - DNA, 601 bp, Human
atttcattatcaagcatgctgaaatttcacaaccacaaggaaggagtttctacaaccacaaggaaggagtttctaatagtagagcaatgccacataatgatccagctacaggatacctttataatcaaacgccggcgaataactcgggtagtgactctccgctcttcctctgagcttgaatcactctcactgtctttcaagtcctgacaaatgcatttttagtataattttaccatcacacttaaaataaaagacattctgagaagggaaatcaagaaagaattacacttacttgatgttktcttcttttttttttttttttttttgccgactaaagaaaaccatgatgtatatttgtgagagtcttaaaaaaaatttaagtggaagaaaatttttgaccaggattctaagtgaaattactctgtgcatgtgtgtgtgtgtgtgtgtgtacaggtaaagatcaaggtagttataagttattaaaaaataattatggagactttttggcagcagaaactacaattaaatcattcatattccttttaaaactagtttaaaatctatattcatctaccatgaaggtgtatacccttgtaaattg

SEQ ID NO: 177322 - DNA, 601 bp, Human
ctgtgtgattttgagtaaataaatttatctccaatcttcagttctgagatcttggaaacacagtaattttagtctcaatgacccatttaggtactacattcccattttatgtttttgacaagagatggttcccatgtcatattcaccatatactattatagtcctcaagctcttttccattagaaagatagatagcaacatatggagtaaagagaaaagcaacagaagtgtgactctttgcaattgccccaaaaatctgaacagaaaaataatttataaagtgtttttgttatacctatarcttccaatgatgattataactattttttagcctttggtttttccatctcatatgaaagatatctctcaaagcttgtttgtgaatgatcctattgtttatacaatgccttcctcagttataaaacctattctctgatgacttcactcaatctctctaaaattacattaacttcaagaagtaatgggtctgggcgcagtggctcacgcctgtaatcccagcactgtgggaggccaaggtgggcagatcacaaggtcaagagatcgagaccatcatggccaacatggtgaaaccccatctcta

SEQ ID NO: 177323 - DNA, 601 bp, Human
aactgcctgagttagcagaaacatacatgtaagctcttatttagaaaaccagtaaaaatgttgaaaaattgaaataaaaatacagttgtactatatagtaaaaattcagttatttgaattttatgaaatttcacaatagtttggttgtgtgttggtttacagttttttacctttgcagttactggatttgctaagctaataaggtaaactcacgactggttagtaacataaattgcttctaagcatttgaaaccactgtatattatcaaattgtatagagatcagaattttatcagcacaytcatttaagtcccatgacaaatgggagattttgttgacttgactcattctataggagtttgaaaacattaaatgtaaaaaaaaggttaaaacttcatagaaaaagaatggatccactttgaaagtaaagagaaaaatcgccgtcacctcatttattatacaaatggaattctaagaagacagatttgcccagacttttggcaatccaatgcttagcatacatactgcttcctctgggagatacttcccagccagagctagctctgggagggatggaaccaccccagactagttttcagaa

SEQ ID NO: 177324 - DNA, 601 bp, Human
atttaacttgtttttcctcactgtggtataggtggaatgaaaataaaacaaggtgttgcttgatcttgtttagtgcatctccaatcttgcttatgacaagtttgaatcagcgcagtgaagagaggggagaaaaactggaaaaatgtagaggtcttgtgtaaatacactaaaatttgcaacacgtttttaatggcagtgttatttgtattttctatggttggtggtttcaaatgtttggagaaaacccaaaattttattttaaaagtaaagtcataaggacagcaaaaaaagccaataaaargtaatgaaagttttccttatagcttaaacacgaatgacaaatatttttgagctaacttttggaaatgtacacatctttgagtgatagacaattaaagaacccaggaaaatccctaaaatggtatcctattgggcaggtactgaatgaatctttttgtgggaaaagatgtcagttaatttttgaattgtttggacaatctctgaaaggactatgaagtaagcatatgtataagcatagtgaatacatacaagtatgtattcattgacttagattcattgacttagattaatagccttacaa

SEQ ID NO: 177325 - DNA, 601 bp, Human
gataatttggtcagtgccagccaatggtgagaacattctatgattgccatatgtcatgtgaccatatgtcacaatcagtagaaaggcagttctggttcaaaataacagaataaagactagaacactattgttttgctagcaaagttttgttctcatttttttttttttcttattacaaagtgactttgtgttcttacagtttgtgggtgcatagttcatgacaatgggcgggacatttaacttgtttttcctcactgtggtataggtggaatgaaaataaaacaaggtgttgcttgatctygtttagtgcatctccaatcttgcttatgacaagtttgaatcagcgcagtgaagagaggggagaaaaactggaaaaatgtagaggtcttgtgtaaatacactaaaatttgcaacacgtttttaatggcagtgttatttgtattttctatggttggtggtttcaaatgtttggagaaaacccaaaattttattttaaaagtaaagtcataaggacagcaaaaaaagccaataaaaagtaatgaaagttttccttatagcttaaacacgaatgacaaatatttttgagctaacttttggaaat

SEQ ID NO: 177326 - DNA, 601 bp, Human
agcaacagattccagaaggaagaatttgaaaatacataattataggatgcagttacacactgtaaaccgaaaggcttcatatgttgagacaaattttagccaaggattagagctctgattagatcgtctcactttaagcactgtttcttcattagttctaccgaatctctagagatttttgtggattgagttttatctaacttgaactaagatagtaccttagtttgggcatgatatttatcactctggtttatttaaaaattcattcactaaagataatacacacattttttgaaagatwatgagaaaagttgagggtacagagagaatcttgaagactgaatctttcatagctcttaagtgagaataattgtgtcggatatagtacatagtttatacactgaagtatcttcattgccataggcaaaaaaatagataaaatcaataccaagggaatttaagatgatatcttctgatctatgcacccacaatctataagaacacaaagttgtttcgtaataaaaaaaaatgagaacaaaacaatagtgttttagtctttattctgtcatttttaaaccagaactgctgcatctctattggc

SEQ ID NO: 177327 - DNA, 601 bp, Human
tctaaattccaagagaagcatgaaatctgaatgatgattacttttctggtgatgaggttgccttcttcatcagtaaattgttcttctgtgacagattcaccaggaatgttttttgcttcctctccctaaaggatgtggcataaagattagcaacatactagatggagaaatctccacactactccaaacaccacacacatgctctggaattttagagaaataagttgtaaattctacttgctactccagtgcaagggaaaaaggctgacttcactgacagttatttagcagtcaacaacaytcaagcattaaacctcaagtatgtataagcgtgatggttagcaacagattccagaaggaagaatttgaaaatacataattataggatgcagttacacactgtaaaccgaaaggcttcatatgttgagacaaattttagccaaggattagagctctgattagatcgtctcactttaagcactgtttcttcattagttctaccgaatctctagagatttttgtggattgagttttatctaacttgaactaagatagtaccttagtttgggcatgatatttatcactctggtttatttaaaaa

SEQ ID NO: 177328 - DNA, 601 bp, Human
caagcaagctagagagcactgtcaaaatgaataccacataattgtacttgacaataattcagtaagttagtgataaatcaaaataacgagcagcctatccatttcctatagtaagctaaaagaaatcagcaccacagctcataaggcagcagaattgtaaacaatctgttgcaatgagattcagacttcttagttaagtactaatccatggaaatgctgttgatctgagggacttttttaagttagtggaattgccaatgacttcctcttactgtcagaccaagaaggcatctattttgcrtaaacaaatcctctcttcactgagcatcaggaatacagttccccgagagcaaggttgtggcacaaatactcagtttttacccaatttttaacagaaaacaaatgaagccttttcaattttgtgatttgtacttctgataaattttcagtttactttttctaatgtaaacattgtctattgaagtttctatttttaaattgaaaagggtagagatctgagaaacaagtgaaaaataaccagagatgttttctctgagagaaaggggttgactggagggattctttaactggcacattggaa

SEQ ID NO: 177329 - DNA, 601 bp, Human
gctcaaacatcatattctcaaagaaaccttccccgtcacctctgacccaggttaagtctctggcaaacaagtggacactggaggcagcttgttcgggtttgtatcctagttctgccactttttacttatgtgagcgtgggcaatttatttaaccactttgggcctgtttcctcatctatcaaatggggatgatgaaggccttatccaagagggttggctgtgaggattgcctgaagagcacgcatgaaacactgggaagaggatgtgtagtaaacattctttccagaatgctctgcagttyttagtggtcttctcaatgccattaaatggtcatgtgagaaagtctcacagaaagaaatgaagtaaatgttatactgaataaacaaatgataaggcttgcggggagggagaattgagaacttatctgggccttagttagctcacacataaaattacaggcagtgaaactagattacttcccagttccttccctcagcactctgcataccagtatcctggcaagtagggaacagcagatgcatgaaaatgaaaactagaatctgtttgctctttcttactactttaacctgtggggctaaga

SEQ ID NO: 177330 - DNA, 601 bp, Human
ataaactggatcataccacactcttgcctaaaatcccttagtggtttcccactgcttttcgggtacagcccagaatccttacagggatgactgactgctactcattctttaaaattcagctcaaacatcatattctcaaagaaaccttccccgtcacctctgacccaggttaagtctctggcaaacaagtggacactggaggcagcttgttcgggtttgtatcctagttctgccactttttacttatgtgagcgtgggcaatttatttaaccactttgggcctgtttcctcatctatcaartggggatgatgaaggccttatccaagagggttggctgtgaggattgcctgaagagcacgcatgaaacactgggaagaggatgtgtagtaaacattctttccagaatgctctgcagttcttagtggtcttctcaatgccattaaatggtcatgtgagaaagtctcacagaaagaaatgaagtaaatgttatactgaataaacaaatgataaggcttgcggggagggagaattgagaacttatctgggccttagttagctcacacataaaattacaggcagtgaaactagattacttcccag

SEQ ID NO: 177331 - DNA, 601 bp, Human
cattaacaactaccctgcatttagagcgagtgatgcagaacatataaactggatcataccacactcttgcctaaaatcccttagtggtttcccactgcttttcgggtacagcccagaatccttacagggatgactgactgctactcattctttaaaattcagctcaaacatcatattctcaaagaaaccttccccgtcacctctgacccaggttaagtctctggcaaacaagtggacactggaggcagcttgttcgggtttgtatcctagttctgccactttttacttatgtgagcgtggrcaatttatttaaccactttgggcctgtttcctcatctatcaaatggggatgatgaaggccttatccaagagggttggctgtgaggattgcctgaagagcacgcatgaaacactgggaagaggatgtgtagtaaacattctttccagaatgctctgcagttcttagtggtcttctcaatgccattaaatggtcatgtgagaaagtctcacagaaagaaatgaagtaaatgttatactgaataaacaaatgataaggcttgcggggagggagaattgagaacttatctgggccttagttagc

SEQ ID NO: 177332 - DNA, 601 bp, Human
aattcattaacaactaccctgcatttagagcgagtgatgcagaacatataaactggatcataccacactcttgcctaaaatcccttagtggtttcccactgcttttcgggtacagcccagaatccttacagggatgactgactgctactcattctttaaaattcagctcaaacatcatattctcaaagaaaccttccccgtcacctctgacccaggttaagtctctggcaaacaagtggacactggaggcagcttgttcgggtttgtatcctagttctgccactttttacttatgtgagcrtgggcaatttatttaaccactttgggcctgtttcctcatctatcaaatggggatgatgaaggccttatccaagagggttggctgtgaggattgcctgaagagcacgcatgaaacactgggaagaggatgtgtagtaaacattctttccagaatgctctgcagttcttagtggtcttctcaatgccattaaatggtcatgtgagaaagtctcacagaaagaaatgaagtaaatgttatactgaataaacaaatgataaggcttgcggggagggagaattgagaacttatctgggccttagt

SEQ ID NO: 177333 - DNA, 601 bp, Human
tccttctcatccaataaaaaccaagttgtgttgaaatttttttatttagccatcctcactgccaagctagcttctgcaatagtctctcaacaggttttctgttcatccaccagtgccccttccaattcattaacaactaccctgcatttagagcgagtgatgcagaacatataaactggatcataccacactcttgcctaaaatcccttagtggtttcccactgcttttcgggtacagcccagaatccttacagggatgactgactgctactcattctttaaaattcagctcaaacatcayattctcaaagaaaccttccccgtcacctctgacccaggttaagtctctggcaaacaagtggacactggaggcagcttgttcgggtttgtatcctagttctgccactttttacttatgtgagcgtgggcaatttatttaaccactttgggcctgtttcctcatctatcaaatggggatgatgaaggccttatccaagagggttggctgtgaggattgcctgaagagcacgcatgaaacactgggaagaggatgtgtagtaaacattctttccagaatgctctgcagttcttagtggtcttc

SEQ ID NO: 177334 - DNA, 601 bp, Human
ctttcaccaggttcagcagtaggacatgcataggagtgggttcattctagctactgctacattgatgtcatccttcattttctcatcttggatccttctcatccaataaaaaccaagttgtgttgaaatttttttatttagccatcctcactgccaagctagcttctgcaatagtctctcaacaggttttctgttcatccaccagtgccccttccaattcattaacaactaccctgcatttagagcgagtgatgcagaacatataaactggatcataccacactcttgcctaaaatccctyagtggtttcccactgcttttcgggtacagcccagaatccttacagggatgactgactgctactcattctttaaaattcagctcaaacatcatattctcaaagaaaccttccccgtcacctctgacccaggttaagtctctggcaaacaagtggacactggaggcagcttgttcgggtttgtatcctagttctgccactttttacttatgtgagcgtgggcaatttatttaaccactttgggcctgtttcctcatctatcaaatggggatgatgaaggccttatccaagagggttggctgt

SEQ ID NO: 177335 - DNA, 601 bp, Human
tgcttagtattttgtggatctgctatagggagaagtctttcaccaggttcagcagtaggacatgcataggagtgggttcattctagctactgctacattgatgtcatccttcattttctcatcttggatccttctcatccaataaaaaccaagttgtgttgaaatttttttatttagccatcctcactgccaagctagcttctgcaatagtctctcaacaggttttctgttcatccaccagtgccccttccaattcattaacaactaccctgcatttagagcgagtgatgcagaacatatraactggatcataccacactcttgcctaaaatcccttagtggtttcccactgcttttcgggtacagcccagaatccttacagggatgactgactgctactcattctttaaaattcagctcaaacatcatattctcaaagaaaccttccccgtcacctctgacccaggttaagtctctggcaaacaagtggacactggaggcagcttgttcgggtttgtatcctagttctgccactttttacttatgtgagcgtgggcaatttatttaaccactttgggcctgtttcctcatctatcaaatg

SEQ ID NO: 177336 - DNA, 601 bp, Human
tcttgtgcctatcttacctaccaccagctcacctaacatatttgaagaaatgaaagatcacacaccaatcttacatatttgaagaaatgaaagatcatgcactgatctatcatttcttcaactatgttaggccttttcccacctcagggtgcttgcacatgttgtaccctttgcttggggtcctcttcttctccattattttcataattggtgccactgatgaggtcttagcttaaatgtcatgatttcagagagaccttccctagccccaaagtctaagtacattcttacattctttcaytggatcctggactttgtattttcagtgtttaaacatttgtcccatttctttttcccattgcagactgggagatccagaaagacagggaccatgaagcatttattcactattgtatatctagtccttccactttaagccaggcagatggccaaatattctttgaagaaataaatgaaatgggttaactttttggcctcaggtaaagggctgccttgacaagcatgggcactcttgccactcttggcttacacatggctgtgagaacctgagcattttcctagaggaggtttagaatacagt

SEQ ID NO: 177337 - DNA, 601 bp, Human
agaagaaacaaaaagtgtctgttcatgttctttgcccacttgttaatggggtgggtggttttttgcttgtaaaaagcaaaaattgacaaactggacctaattaaggagcttctacacagcaaaagaaactatcaacagaataaagagataacctacataatgggagaaaatatttgcaaactatgtatctgacaaaagtctaacatcgagcatctataaggaatttaaattccctttagaatgaaatctaaatcctttcctctggcctacagggctctgaatgatggtgtgtgtgtgtgttttttaatgttatcttgtgcctatcttacctaccaccagctcacctaacatatttgaagaaatgaaagatcacacaccaatcttacatatttgaagaaatgaaagatcatgcactgatctatcatttcttcaactatgttaggccttttcccacctcagggtgcttgcacatgttgtaccctttgcttggggtcctcttcttctccattattttcataattggtgccactgatgaggtcttagcttaaatgtcatgatttcagagagaccttccctagccccaaagtctaagtacattctt

SEQ ID NO: 177338 - DNA, 601 bp, Human
tcctctcctctcccctctcaccctcaagtagatcccagtgtctgttttttccctttttgtgtccatgtgttctcatcatttagcttccactaaatgagaacatatggtatttggttttctgttcctatgttagtttgctaaggataatggtctctatctatgttccgttcctgcaaaggacatgctctcactcttttttttatacctgcatagtattccatggtgtatgtgtgtgtacattttctttatccagtctaccattgatgggcatttaggttgattccattctttgctattgtgmatagtgctgcagtgaacatacatgtgcaagtgcctttgtgatagaacaatttatattcctttggtttatacacccaataatgggattgctgggttgaacggtcgttctgtttttagctctttgaggaattgccacaccactttccataatggttgaactaatttgcactcccaccaatagtgtataaatgtttccttttctccacaaccttgccagcacctgttattttttgagtttttaataatagccattctgactggtgtgacatggtatctcattgtggttttaatgtgcaattct

SEQ ID NO: 177339 - DNA, 601 bp, Human
ttcaaacccaagtccaagcctgaatgcctgtcattcttcttaaaactcattcctcttccacttctgcttctttctctatcatccagttgcttatgccagaaatctaggagtcatttttgactcaatgattcttctccactctacccaccatgctaatctatcaagtgctgtcaatcttcccagctgaagccaccattatggcttagttgaactgaagcaataagttcctaactggttaccttcattttattcttgtccccctatccattctctagatagtccgtgctcttgtgtttttttwaaagagggaaaaaagaccaagttaggtccttgcttaaaatccttcagaggcttcgaattcctctaaacatgcacacaaacaattattttattaagttcaagggtacatgtgcaggtttgttacacattattttgccacccaggtactaagcctagtacccaatagttactttttcctctcctctcccctctcaccctcaagtagatcccagtgtctgttttttccctttttgtgtccatgtgttctcatcatttagcttccactaaatgagaacatatggtatttggttttctgttccta

SEQ ID NO: 177340 - DNA, 601 bp, Human
tgcagtggcaagatctaggctcactgaaagctccacctcccaggttcacgccattctcctgcctcagcctcccaagtacctgggactacaggtgcccgccaccacacctggctagtctttttgtatttttactagagacagggtttcaccgtgttagccaggatggtctacatctcctgacttcgtgatctgcctgcctcggcctcctaaagtgctgggaatacaggcgtgagccactgcatctggctgaggaaatttttttaaactctgaaatgttgcttttgaggactcaacttttgakccccttcttggcttacttcagttttctccctaggtaatcacatctgttcactggtattcaatacccatttcttttgtgatgattcccacatttttatatgcacagccccaacttttcctcagagcttcggacttgcatatgtaacataaatacttggatgtctcatagcatttcaaacccaagtccaagcctgaatgcctgtcattcttcttaaaactcattcctcttccacttctgcttctttctctatcatccagttgcttatgccagaaatctaggagtcatttttgactcaatgat

SEQ ID NO: 177341 - DNA, 601 bp, Human
taattttatttcttaaaataaaaaatattatatatttttaagaaaaataaaaaatacataatataaaaacatatttactctatatgaattccggtaaaatattctggagggcagggtcctgaatttgtagtgaagcaattcagcccatagctctgacttctgagaatcagaatcaggaaatccagacctgtcattaactgcactcagccttagagattttgctctctctttgtcactgttcattgcttagtaaagaggaataaggatacctgttgtactaacttcctagggctactgtgaraaacaagtgatgtgaaatagtggaaacttttctgaagtgtaaaccaccatcacatgcagaggatttcagacactgctgttctcacttctcccactgttatattctagccatcactggctgctgctgcttagtccaccagcctctgtaatccaaagctcttcaaggttctattcttggtttttttaatactagtagcaatagctgacgcttattgagtgcttactaaggagggtcatggttggagctctgcggaagagagaggtcagaggcaatttttttttttttttttttttttttttt

SEQ ID NO: 177342 - DNA, 601 bp, Human
gggctaattttatttcttaaaataaaaaatattatatatttttaagaaaaataaaaaatacataatataaaaacatatttactctatatgaattccggtaaaatattctggagggcagggtcctgaatttgtagtgaagcaattcagcccatagctctgacttctgagaatcagaatcaggaaatccagacctgtcattaactgcactcagccttagagattttgctctctctttgtcactgttcattgcttagtaaagaggaataaggatacctgttgtactaacttcctagggctactrtgaaaaacaagtgatgtgaaatagtggaaacttttctgaagtgtaaaccaccatcacatgcagaggatttcagacactgctgttctcacttctcccactgttatattctagccatcactggctgctgctgcttagtccaccagcctctgtaatccaaagctcttcaaggttctattcttggtttttttaatactagtagcaatagctgacgcttattgagtgcttactaaggagggtcatggttggagctctgcggaagagagaggtcagaggcaatttttttttttttttttttttttt

SEQ ID NO: 177343 - DNA, 601 bp, Human
accccatcgctactaaaaatacaaaattagctgggctaattttatttcttaaaataaaaaatattatatatttttaagaaaaataaaaaatacataatataaaaacatatttactctatatgaattccggtaaaatattctggagggcagggtcctgaatttgtagtgaagcaattcagcccatagctctgacttctgagaatcagaatcaggaaatccagacctgtcattaactgcactcagccttagagattttgctctctctttgtcactgttcattgcttagtaaagaggaataagratacctgttgtactaacttcctagggctactgtgaaaaacaagtgatgtgaaatagtggaaacttttctgaagtgtaaaccaccatcacatgcagaggatttcagacactgctgttctcacttctcccactgttatattctagccatcactggctgctgctgcttagtccaccagcctctgtaatccaaagctcttcaaggttctattcttggtttttttaatactagtagcaatagctgacgcttattgagtgcttactaaggagggtcatggttggagctctgcggaagagagaggtc

SEQ ID NO: 177344 - DNA, 601 bp, Human
agaaaccccatcgctactaaaaatacaaaattagctgggctaattttatttcttaaaataaaaaatattatatatttttaagaaaaataaaaaatacataatataaaaacatatttactctatatgaattccggtaaaatattctggagggcagggtcctgaatttgtagtgaagcaattcagcccatagctctgacttctgagaatcagaatcaggaaatccagacctgtcattaactgcactcagccttagagattttgctctctctttgtcactgttcattgcttagtaaagaggaayaaggatacctgttgtactaacttcctagggctactgtgaaaaacaagtgatgtgaaatagtggaaacttttctgaagtgtaaaccaccatcacatgcagaggatttcagacactgctgttctcacttctcccactgttatattctagccatcactggctgctgctgcttagtccaccagcctctgtaatccaaagctcttcaaggttctattcttggtttttttaatactagtagcaatagctgacgcttattgagtgcttactaaggagggtcatggttggagctctgcggaagagaga

SEQ ID NO: 177345 - DNA, 601 bp, Human
tactttatgtaactaaaatacactacagtgcagttttaaagtaattcccaattcaggtagctttgtttcttcactaataccaataagtagggcttttttgattgttcttttctgttcacttgtgattaaaaagtatcttaagtcaaagggctggaaaaaaaaatactggaaaactgttcattcgtgttttagcagtgaaagaaaaacctaacagtaataaaattttattactgttattatttttattaggtaaagatatttattctaaactgttctaaagtggattagctaatttaatccraataaccctgaggtactattattttttccattttgtagataaataaaagctttgtggctctattttcttatttattttttaattaatttagttctttccagatggagtcttgctctgtcgcccaggctggagtacagtggtacgatcttggcttgctgcaacctctgcctcctaggttcaagcgattctcctgcctcagcctcctgagtagctgggaccacaggcatgtgccaccatgcctggctaatttttatctttttagtagaaatgggtggggtttcaccatgttggccaggctgg

SEQ ID NO: 177346 - DNA, 601 bp, Human
tttttgttttgttttttggttttttttttttttttttgagacagagtcttgctctgtcgcccatgctggaatgcaaaggcatgatcttggctcactgcaacctccacctcccgggctccagtgattcccctgcctcagcttcctgagtagctgggattaaaggcgcccaccaccatgcctggctaattttttgcatttttggtacagatggggtttcaccacgctggccagggtggtcttgaactcctgaccgcaggtgatctgcccgcctcaacctcccaaagtgctgggattacaggcrtgtcaccatgcccagcctgaaattctgtgtttctaacagacttttaggcatgctgatactgtggtccacagacttcactttgaggatctagattacatgccaggtatcaactacaaattgttttccaacttcattgtctttgctcatgattttgtatccacctatacttgccttctctgattatcatctgtggctaattcctcttctacccttcaaatttgtttcaaatgccacctccttgaaagttcagatttctttccctaatgaaatccacctttgtagttcaactcttactcatct

SEQ ID NO: 177347 - DNA, 601 bp, Human
gtagagacggggtttcactatgttagtcaggatggtctcgatctcctgacctcgtgagccgcccaccttggcctcccaaagtgctgggattacaggcatgagccaccacgcccggccctcaacttttatgtaacaaagttgtgagttgtttttgagttgccatggacacccccaggatgaaggtcacataatgtgagcatgcccagatgaactaaatatgcaaccataggaggaacctaagttctcaggctggggagctaattaagaagcttatgtctcatggcaggatccagtcagataragccttggcgtcaccccattgcaggatccagtcagatcatgcctcattaccctatgcttctgaaacatgacccagcccccagcttggagagacagatttgagtggttcctcctgtctccttgtcagtcaagtggcaatacacctttctcctgcaaaaacctggtgctttggtgtttggtgttcgactgtccattgtgcacgggcaaacacccagtttggtttggtgacagttttagactgtgttgggaagaccctcttctagttctgtctgaagctcaggttattcagctgcttggggaa

SEQ ID NO: 177348 - DNA, 601 bp, Human
gctgggactacaggtgcccaccaccacgcctggctaattttttgtatttttagtagagacggggtttcactatgttagtcaggatggtctcgatctcctgacctcgtgagccgcccaccttggcctcccaaagtgctgggattacaggcatgagccaccacgcccggccctcaacttttatgtaacaaagttgtgagttgtttttgagttgccatggacacccccaggatgaaggtcacataatgtgagcatgcccagatgaactaaatatgcaaccataggaggaacctaagttctcagrctggggagctaattaagaagcttatgtctcatggcaggatccagtcagatagagccttggcgtcaccccattgcaggatccagtcagatcatgcctcattaccctatgcttctgaaacatgacccagcccccagcttggagagacagatttgagtggttcctcctgtctccttgtcagtcaagtggcaatacacctttctcctgcaaaaacctggtgctttggtgtttggtgttcgactgtccattgtgcacgggcaaacacccagtttggtttggtgacagttttagactgtgttggga

SEQ ID NO: 177349 - DNA, 601 bp, Human
agtgagcttttctaggtgacctccagagagccttgcttattattgtatctgtgttttgtaattgcaccagaccacctggttcaactttttttcttttttgagatggagtcttgctctgttgcccaggctggagtgcagtggcccgaaattggctcactgcaagctctgcctcctgggttcacaccattctcctgcctcagcctcccgagtagctgggactacaggtgcccaccaccacgcctggctaattttttgtatttttagtagagacggggtttcactatgttagtcaggatggtcycgatctcctgacctcgtgagccgcccaccttggcctcccaaagtgctgggattacaggcatgagccaccacgcccggccctcaacttttatgtaacaaagttgtgagttgtttttgagttgccatggacacccccaggatgaaggtcacataatgtgagcatgcccagatgaactaaatatgcaaccataggaggaacctaagttctcaggctggggagctaattaagaagcttatgtctcatggcaggatccagtcagatagagccttggcgtcaccccattgcaggatccagtcagat

SEQ ID NO: 177350 - DNA, 601 bp, Human; identical to SEQ ID NO: 39777

SEQ ID NO: 177351 - DNA, 601 bp, Human
aggtttgtttccctctcccttcctcttcctttcccttcccatctgcattgtacatgttgtggtgtcccatcttaaaaccaaagtcttcttcctcagtagtgtgttcctgctggccatacttctctttcttcccctttgaggcttaacttcttgaaagagcagcctacagttgttcccgcttgctcacctttcagctcattctagcagtccttctcccctgtctgcagcaccacaaattctgactgaagtcacatgggagtggtttaagttagttttgaattaaaaccttgtggaatttttmtaaactagtctttccaactttggtaatgcagtatgatgaatatatattctttaattcaaaaccatgtgctaaagttaagatgaagatatagatattataggtgaagagaatgacatgcttaaattgcatcagttatctctgatatagcccttcccccttaaaataaccaatgtctccttttttgttttttagctccacggtcaggcttggctgcaaaacactttattgatgtaggaggtaatatatttccttttttattctgtaaatgtttgcaagtatttactttgtctttaaaaggta

SEQ ID NO: 177352 - DNA, 601 bp, Human
gcaggagaatcgctcgaacctgggaggcggaggttgcagtgagctgagattgtgccactgcactccagcctgggcaacagagtgagactctgtttcaaaaaaaaaagttaaagcaattatatattcaacttcattttactgctcatgtagcgtaggccctaaaaggctgggaaaatatgaccaagttaaaacactgtatgtttaataaaaaatcttgcaaaagttaatcaagtacttcatgggacaaaaagattctcactgctattgctacattacattctcaaagatgatcatcagcttratcacagtgctaataagttatgtatccaacagactattgcttaggaaagaggtaagcagaaacacttacaaacacaaactaataatacaaatgcaatttctcaagagatgacatacagctgggcatggtggcacgtgccagtagtctcagctacttaagaggctgaggcgggatgattggttgggcccaggagtttgggcccagcctgagtaacacagcaaaatcccatctctaaaaatatatacatgtgtaaataaataaagaagacatacaaatggccaacacatacatgaaaaaaaa

SEQ ID NO: 177353 - DNA, 601 bp, Human
cgctagggaaagaaaaacaaaaaacccaacagaaaactccaacatttcatttcattatgtggtagtgcaaaatcttactttaagaaataaaaaagttaaaacaaggctggttgtggtgactaacaccggtaatcccagcactttggaaggctgaggagggcagatcacttgaggtcaggagttcaagaccagtctgaccaacatggtgaaaccccgcctctaataaaaacacaaaaaattagtcaggtgtggtggcaggcgcctgtaatctcagctactaaggaggctgaggcaggagaawcgctcgaacctgggaggcggaggttgcagtgagctgagattgtgccactgcactccagcctgggcaacagagtgagactctgtttcaaaaaaaaaagttaaagcaattatatattcaacttcattttactgctcatgtagcgtaggccctaaaaggctgggaaaatatgaccaagttaaaacactgtatgtttaataaaaaatcttgcaaaagttaatcaagtacttcatgggacaaaaagattctcactgctattgctacattacattctcaaagatgatcatcagcttaatcacagtg

SEQ ID NO: 177354 - DNA, 601 bp, Human
aaacagttagcttatcaatggccttaccaacttaatgaatggcactatgattattatttagtgttactggatcagcaaataatctataaacctgtaaaattagcattgcattaaatgtcatttactagcaccatcacctaccacagattactatgtttagaaatgcctgcttctgcctctaatgaaaatcaaacagatcttagaacatacatgatcatgcatgtatgttgaatttcttttatattcgtttctttttttttttttttaaataacaagtttgttttattttagattcttcttsggcagaaatcattatttactttcttgggtaaaaacagtacagttttagaaacagacttaatttttcaggtggtatcctaactacctatttctaccagattggggaagaacaaagtgatttagggtgttaaaatatatcattggacgaccaataaagatatgctgagtatcactgtggtcagcaatactcactgctcttagttaacactttaactaaaacgaggtgatgatcaattttccaaaaaacaatacattttttataaaaataaatcttgagaaaacaagtcaattacgcacattt

SEQ ID NO: 177355 - DNA, 601 bp, Human
ggtgctgatttgttaactatggagtaaattagaattaaaaaacaaaacaaaacaaaaaaactgtctgctgggcacggtggctcatgcctgtaatcccagcactttgggaggcggaggcaggtggatcaccaggagttcgagaccagcctgaccaacatggagaaaccctgtctctactaaaatacaaaaaattagccgggcatggtggcgcatgcctgtaatcccagccacttgggaggctgaggcatgagaatcgcgccactgcactccagcctgggcaacagagtaagactctatctcaaaaaaaaaaaaaataaataaaaataaaaaaataaataaataaataaaaccattgataatttatttgcagacatttttctatatttttcccacctaacaaaattgggataatatggattataccgtctttgatattttttgaacttaacatttatattgaatacatgttcactatgtacatagcactggcaatcgaccatcatctttctactgatctttttattaaaaggatgacaaatacgagagtctgtaagagatcctgtagctaagactcatttacctccccactgcacacaaaaaa

SEQ ID NO: 177356 - DNA, 601 bp, Human
ctactgataaagttatccatttaaaaaaattcacacaagttaatgggtgctgatttgttaactatggagtaaattagaattaaaaaacaaaacaaaacaaaaaaactgtctgctgggcacggtggctcatgcctgtaatcccagcactttgggaggcggaggcaggtggatcaccaggagttcgagaccagcctgaccaacatggagaaaccctgtctctactaaaatacaaaaaattagccgggcatggtggcgcatgcctgtaatcccagccacttgggaggctgaggcatgagaatcrcgccactgcactccagcctgggcaacagagtaagactctatctcaaaaaaaaaaaaaataaataaaaataaaaaaataaataaataaataaaaccattgataatttatttgcagacatttttctatatttttcccacctaacaaaattgggataatatggattataccgtctttgatattttttgaacttaacatttatattgaatacatgttcactatgtacatagcactggcaatcgaccatcatctttctactgatctttttattaaaaggatgacaaatacgagagtctgtaagag

SEQ ID NO: 177357 - DNA, 601 bp, Human
gctgcagccatcctggccttaactcaacaagtgccaaattctcccacttttatgtgctatttctctctctttccacctctacctctacctctcttcatctagttaactactgcttatcatttcagatctcagcctaagggtattctttagggaagacttggagtaaagaatcacagctataaaacctactctatgccttcggaaatcagctcttttctaattgttttattaagttggaacaaatataaacagatttaccatatatgatttatcatacaataactaaaataaaaacttcacktaacagtgttgaataagatagaggaatagcttgctgaaccagaaaattacttttttttgcaacccaaaccttcagaatgcagccttgaacctggaagtaaaatgaaaagtatttctgatttacattgatcacaaagtaaaaattcagagtccatttatttttggtttcttggctcaaaacaaattagaaaaaacaattaggtcaggtttcgagaagaggaaagtagaagctgaaaggtatacatgacaacagtaggactagtattttggagcttcccagcaaatgagaaacagtatttta

SEQ ID NO: 177358 - DNA, 601 bp, Human
aaagtcaatctattaataatgcagccctggcagggtgcggtggctcacgcctgtaatcctagcactttgggaggccaaggcaggcagatcacgaggtcaggagatcgagaccatcctggctaacatggtgaaagcccgtctcttctaaaaacacaaaaaattagctgggcatggtggcatgtgcctgtagttccagctactcaggaggctgaggcaggagaatcacttgaacccaggaggcagaggttgcagtgaaccaagattgcaccattgcactccagcctgggtgacagagcggggraaaaaaaaaaaaggcaaatactgtaaatgcatctaaaagagtaagttttcttaaatagaaaacttctgtatcctatgaagaatttgttttttttacttagtattactatagtcccaactgcagagcagactaaatataaaaacacatccaaagaagtactttagaaaagaagatataatagtactttgtcgtgatgaggtttttacctacaaaatttattagtttaattcccctcaaaacaaatcttaccaacttgaagttaatcttaatcatttgtttcagtgctttaaatccccattc

SEQ ID NO: 177359 - DNA, 601 bp, Human
atgcttctttccttgactaactgaacatatgtatttattagggtgaggaataaactaataatgctgcaattatcttgcttatgacaatacattctgccctgaggcacagcacaaagaacaagaaaacttgagaacaatccctgaaacctaaccaagaattgaattacaataaagaaaacagcagaggtggatgggacaaaaaaaaaaaaaggatagaactatggaaatatatacatatataaaaccacttctgtttccaagtttcatgtgggggtaaatgataggtgacatcctgtcaatragctgctaaatccacattacagtacatatcttgcagcaaaagggaaatcagagaaatacgactatcctaactttgaagctgtatcttggcactgaaataggagttttgcaaaaagttacagtttttggctgggcttggtggctcactcctgtaatcccagccctttgagaggctgtgagcattgcttaagtccaggagtttgagaccagcctgagcaacatggtgaaaccccgtctttacaaaaaacacaaaaattagtcaggtgtggtggcatgcgcctgtagtcccagctacttggag

SEQ ID NO: 177360 - DNA, 601 bp, Human
catccacaatcctcataatctgcaattgctgttaacctctctttttactgagttctattttctttttttttttatcaaagacatgaagcattggcagatacaaatgcttctttccttgactaactgaacatatgtatttattagggtgaggaataaactaataatgctgcaattatcttgcttatgacaatacattctgccctgaggcacagcacaaagaacaagaaaacttgagaacaatccctgaaacctaaccaagaattgaattacaataaagaaaacagcagaggtggatgggacaaaaaaaaaaaaaggatagaactatggaaatatatacatatataaaaccacttctgtttccaagtttcatgtgggggtaaatgataggtgacatcctgtcaatgagctgctaaatccacattacagtacatatcttgcagcaaaagggaaatcagagaaatacgactatcctaactttgaagctgtatcttggcactgaaataggagttttgcaaaaagttacagtttttggctgggcttggtggctcactcctgtaatcccagccctttgagaggctgtgagcattgcttaagtccagga

SEQ ID NO: 177361 - DNA, 601 bp, Human
ttatgtgaatgtgatctctctctctcaaaatatcttattttcagaccacaggaaataagctgaccacaggaaactgaaattgaagaaagcaatctgtggataagggttgggaggactgctgtacgtatgaaatgttttaatgtttatgtttttatctaggagatttattattgtcttcccaaaatcttcacaactgctttagaaccacttattcaattaaaaagcccttcctaagtcccttccacatgccaggcactgggtctgtcatggggaaatacaaagttaaaaaagccaaggttcycggtctcaaaaagttcacactctagtagaagattaatctgtcagtagataaattacaatgtaagtgacaatgactaggtgaagcataaaccaagtgcctaggagaatgaaatagggactaaccttcctggaggacgtcacaggaatcacaaaaaagtgctgacatttgagcatgactttaaagttgaccaacagcccatgaaatgtgggccatgaaaaatagcaatatgatcaacaggaagatattcataaatatctcacactgacatacactaagccaaaatttattgggtcttcaaac

SEQ ID NO: 177362 - DNA, 601 bp, Human
agtgaaaacttactatacagacatacctatgattaagtttaatttataaatcaggtacagtgagacattaacaataactgatcataaaatagaacacataacaatatactgtaataaaagttatgtgaatgtgatctctctctctcaaaatatcttattttcagaccacaggaaataagctgaccacaggaaactgaaattgaagaaagcaatctgtggataagggttgggaggactgctgtacgtatgaaatgttttaatgtttatgtttttatctaggagatttattattgtcttcccmaaatcttcacaactgctttagaaccacttattcaattaaaaagcccttcctaagtcccttccacatgccaggcactgggtctgtcatggggaaatacaaagttaaaaaagccaaggttcccggtctcaaaaagttcacactctagtagaagattaatctgtcagtagataaattacaatgtaagtgacaatgactaggtgaagcataaaccaagtgcctaggagaatgaaatagggactaaccttcctggaggacgtcacaggaatcacaaaaaagtgctgacatttgagcatgacttta

SEQ ID NO: 177363 - DNA, 601 bp, Human
ggaaaactaagtagatactttataaaatcttgtggctacagaaaatagcgtaataaataacctcagaagataaaaattctacaaacttttctaagaaaatacaaaagggcaaatgttgaatattaactgagttctgaaaagttttctcactctttcctttatgaactgctttaaggaaatttaccttaactgaaatacaaaatcttaccttactaaattcgtcattgctaaaatttctggatcatttttgtacggcttggcctaaacacagtaaagaaaaaaattaaatatatgtacaaaraaacaacattttaaaaaaagaaataacatttatttccagatagctgataagagaaattaacaattaaaacacacgtacctcctgtgagtcaaatggatttattcccgatttcataagcatatttgctaagaccaaatattttaagcaagtggttcgtcttggacttccagattcatcataattcttgaaggcttcaaaaaaatcagtgtgtgccttttcaaattcaccttccctcaagtgcattttaccaccacattctgtgaagaataagacatgagaaaataggacattttcagttct

SEQ ID NO: 177364 - DNA, 601 bp, Human
gacaggcgtgagccaccacgcccagcctatccattgtaaacatttttaaaaatactttcatcttgtcattgagaaaatatatgagtaaaaaaatatgcttatgctgtcttgtcttactgaaaattcttgactcatcttggactagttcgtaatttcattctggattaagagaggtataggcagtatcattgtgaaataatgttttaagacatccacaatcagttttccactgaaagacacaggtgcattcgtgcgtgcgcagacagacagacacacacacatggataataggaaaactaaatagatactttataaaatcttgtggctacagaaaatagcgtaataaataacctcagaagataaaaattctacaaacttttctaagaaaatacaaaagggcaaatgttgaatattaactgagttctgaaaagttttctcactctttcctttatgaactgctttaaggaaatttaccttaactgaaatacaaaatcttaccttactaaattcgtcattgctaaaatttctggatcatttttgtacggcttggcctaaacacagtaaagaaaaaaattaaatatatgtacaaagaaacaacatt

SEQ ID NO: 177365 - DNA, 601 bp, Human
gacaccatgcatcacatcatgtgggtcaaaatttaccattaaaataagttttgagttctaatacagtggctttgctggagtagttggatataataaatttataaatgtcattatatattctgatataggtcagataaaggtctgacaaatcagtcctttaaccaattttaatgtacttagccaatttaatttatacaaaatatcaatgtctagggtaaagcttttcctcaatatttcttagagttttaaaagtgtaaactgctgcttagcaatttaacattataaacaactttggttcttrgttaatgtgaccaaatgtgaatgaaataaactatctgaaataaagatgacgtttcctttaataatgaaaagcaacctaattcaacaaataaattaaaataaagtaaacaataaagaaactgatttaatgtggtaacttaaggtttttaattccaaactgttcttagtccccctaaaaaaaaacgcttttttttttacagccaaaattaaggtttctttaaaaaaagttaaatgaggacattttacacaggaactttaatatcatgaaataagctatcttctccaagtatacacaatttat

SEQ ID NO: 177366 - DNA, 601 bp, Human
tactgcacgccctctgctagtgcttccatctgttgggtcccaatgtaacctcatattaggggcacgtgattcaagtgctttgacaggaattattttcctctagtctcctggcaactgactaggaagacaaaattaggaagcattactttcttacctaccccaaatacactgctgtaatatactataggaggacatattcaagcattgaaaacacttgcacaaacatttgttttatatttgtgtacatacatattttaaccgtaagacattcttccatttcttaagtggggtttcaaaaaaracatcttatacaaaattgtgggacaccatgcatcacatcatgtgggtcaaaatttaccattaaaataagttttgagttctaatacagtggctttgctggagtagttggatataataaatttataaatgtcattatatattctgatataggtcagataaaggtctgacaaatcagtcctttaaccaattttaatgtacttagccaatttaatttatacaaaatatcaatgtctagggtaaagcttttcctcaatatttcttagagttttaaaagtgtaaactgctgcttagcaatttaaca

SEQ ID NO: 177367 - DNA, 601 bp, Human
caaaaatctaaataatattatactttctgtcatggaaatcacagttaaacaagcacacataaccttctgccaaaaaaaacataaatttccttttcatgcttttggttttttaaaagaaagattaaataaatcttcttttggggttatatactatatttatacaaagttaattaaaatcacctcaatatcttacttctcttaaaagttggcaataaaacatttaacaactatttaatgtttgatgttttcaaatgaaattgtgcatttaattcctaattgttcataatgaaaggaaccaggyttcatgtacactacatgaaggggtgtagcctcgtctttcaaatgagaaagcatatcctctgtgtaggttattcagaaaatgcagcttcttaatttttatcttctagaaagctaccagcaactgtgaaaattttcaaaaggaacatttctcaatcccctgttgcagaaggccaaagactgatttatattcataattctctgaggtatctagtatctcctcttgaaataattctgtaaagctctatgggaattgctaaaggtgctgagaaggaagaatccaaccttgtggatatggcaccat

SEQ ID NO: 177368 - DNA, 601 bp, Human
cagataatccaaagaccctgcttctcaactttcatatgcaaaaatctaaataatattatactttctgtcatggaaatcacagttaaacaagcacacataaccttctgccaaaaaaaacataaatttccttttcatgcttttggttttttaaaagaaagattaaataaatcttcttttggggttatatactatatttatacaaagttaattaaaatcacctcaatatcttacttctcttaaaagttggcaataaaacatttaacaactatttaatgtttgatgttttcaaatgaaattgtgyatttaattcctaattgttcataatgaaaggaaccaggcttcatgtacactacatgaaggggtgtagcctcgtctttcaaatgagaaagcatatcctctgtgtaggttattcagaaaatgcagcttcttaatttttatcttctagaaagctaccagcaactgtgaaaattttcaaaaggaacatttctcaatcccctgttgcagaaggccaaagactgatttatattcataattctctgaggtatctagtatctcctcttgaaataattctgtaaagctctatgggaattgctaaaggtgc

SEQ ID NO: 177369 - DNA, 601 bp, Human
ttatgtattaaatcagataatccaaagaccctgcttctcaactttcatatgcaaaaatctaaataatattatactttctgtcatggaaatcacagttaaacaagcacacataaccttctgccaaaaaaaacataaatttccttttcatgcttttggttttttaaaagaaagattaaataaatcttcttttggggttatatactatatttatacaaagttaattaaaatcacctcaatatcttacttctcttaaaagttggcaataaaacatttaacaactatttaatgtttgatgttttcmaatgaaattgtgcatttaattcctaattgttcataatgaaaggaaccaggcttcatgtacactacatgaaggggtgtagcctcgtctttcaaatgagaaagcatatcctctgtgtaggttattcagaaaatgcagcttcttaatttttatcttctagaaagctaccagcaactgtgaaaattttcaaaaggaacatttctcaatcccctgttgcagaaggccaaagactgatttatattcataattctctgaggtatctagtatctcctcttgaaataattctgtaaagctctatgggaa

SEQ ID NO: 177370 - DNA, 601 bp, Human
atctatactttgcaatagacagaaagaaaacagcttaatgccatgcagcttcattaagtggcatttctttgacagtggcaaagaaagtaatagaatccagttggcagaaagaacataccttcaatgtgttctcttatgaaaggatcatccatgatgttgctgtgatttgtttttagaatcttttcaaattcagtgatgtcattattctgataggcactaatagaaaaacaaagtgtaaattatgtcaaacatgaagaagttatgtattaaatcagataatccaaagaccctgcttctcaaytttcatatgcaaaaatctaaataatattatactttctgtcatggaaatcacagttaaacaagcacacataaccttctgccaaaaaaaacataaatttccttttcatgcttttggttttttaaaagaaagattaaataaatcttcttttggggttatatactatatttatacaaagttaattaaaatcacctcaatatcttacttctcttaaaagttggcaataaaacatttaacaactatttaatgtttgatgttttcaaatgaaattgtgcatttaattcctaattgttcataatgaaa

SEQ ID NO: 177371 - DNA, 601 bp, Human
aaaataaaccttaaaaattaactttgaacctaagcatcaataataaacatgcaacagcatctatattagatttttttaaaaagggacagttaccttaaacaaaatggacattatatataaacttgactatagtaatatgaaattggtcaatttctttaaaagagcttcataattttaaggaatatcccatccaatgacagcatttagaaacatatctatactttgcaatagacagaaagaaaacagcttaatgccatgcagcttcattaagtggcatttctttgacagtggcaaagaaagkaatagaatccagttggcagaaagaacataccttcaatgtgttctcttatgaaaggatcatccatgatgttgctgtgatttgtttttagaatcttttcaaattcagtgatgtcattattctgataggcactaatagaaaaacaaagtgtaaattatgtcaaacatgaagaagttatgtattaaatcagataatccaaagaccctgcttctcaactttcatatgcaaaaatctaaataatattatactttctgtcatggaaatcacagttaaacaagcacacataaccttctgccaaaaaaa

SEQ ID NO: 177372 - DNA, 601 bp, Human
tataataaaatgttaccaagttagagtgactcttaaatgcaagactggtatactgcatttataactataaattataaacatcattaaaatctatgaatataagtaccttagaaataaaaggaatatgtattcttgtgtaaggcttaattaattttataagcacttgtgttctgatgtttcgcaaaagctctgaaagacaaaaaattaaaataacattttatttaacagtttgtatgatatctttatggatcattatgtactcctaattatcttctcaaaatacatcttcctgcttggcaakgatataaagtgtttagattttaaaatacctgggtcaatggatggacagtatgatcagctgctgcctatcccataatttcttgttcccacctccttgattttgttgacattgagactctactaaaatattattttgccttctcaatattacactacttatcatttcctcaacagttaatatctttaaagaagctctgatttataccagccagccaagttccttgttttagactctctcaaaacctagagtactatattttatataatgcttttacaatttcctccagttttgtctgtacaa

SEQ ID NO: 177373 - DNA, 601 bp, Human
acctttactacactgcaggtacagaaatatacggacacatttttagagaattgacattttgcaaaatgcagcaaacattttaatttatacatgagaaaaggaagtgttcaaaagggtatgcatttcaagttattgcaggttatttgtgagagaatttctgcaggtaaaacatgtttaaatttaaccaacagtagcgtgtcagtgtatttaaaatcatgacaaaaatcttctctctggtcatgttgcccatgacaaattactatgatgttgtacgtttagggcaagatgtcaatacagcataaatcccatggtattttggttttcttctggagattaaagctgtttttcttgggataaatgcagcagcaaaacacaaaccagttgatcaaaaaagcacttctgccataactccaataattttcaggacacatcaaccgacagtagttttgccattcccagttcttttaaggattacatctctgcactgttgccttaaggacgtctgtaaaagcttgttctctgttaagccagtttactgactacagcctggttgagagaatttagttggttggtccatttatctagtgcagtatatcgtgca

SEQ ID NO: 177374 - DNA, 601 bp, Human
ataaaagtgagatttctccaccagtacaataaagttgttacaagtggttcctatgtgtttgtttttgtttttgagacagagtctcactctgtcacccaggctgcagtgcagtggcacaatcttggctcactgcaacctccgcctcccgggttcaagcaattctcccacctcagcctcctaagtagctgggactacaggcacccgccaccacgcccagctaatttttgtatttttagtagagatggagtttcaccatgttggccaggctggttttgaacttctgacctcaggtgatccaccygcttcagcctcccaaagtcttaggattacaggcgtgagccaccacacccggcctcctgtgtgttttgaaggtgattgtgacctcaggttttggcagggctataccttgtgtttgctcttactccaactccatggcatacctggaccaggcctcttcatcttgaagagggatctgctgaaatgcaggcccagtgaatctccccatgcctggacacagttccgtcaagccaggacccggtgctgcctgcacccctgtttctgttagtctgactgtcctcgctgagtctaactccttgagggc

SEQ ID NO: 177375 - DNA, 601 bp, Human
gagacagagtctcactctgtcacccaggctgcagtgcagtggcacaatcttggctcactgcaacctccgcctcccgggttcaagcaattctcccacctcagcctcctaagtagctgggactacaggcacccgccaccacgcccagctaatttttgtatttttagtagagatggagtttcaccatgttggccaggctggttttgaacttctgacctcaggtgatccacctgcttcagcctcccaaagtcttaggattacaggcgtgagccaccacacccggcctcctgtgtgttttgaaggygattgtgacctcaggttttggcagggctataccttgtgtttgctcttactccaactccatggcatacctggaccaggcctcttcatcttgaagagggatctgctgaaatgcaggcccagtgaatctccccatgcctggacacagttccgtcaagccaggacccggtgctgcctgcacccctgtttctgttagtctgactgtcctcgctgagtctaactccttgagggcagagaggatgtcttatttatttctgccccgctagccgtgtaaactgagtaggtacttgtaaatgttcattga

SEQ ID NO: 177376 - DNA, 601 bp, Human
ttctgacctcaggtgatccacctgcttcagcctcccaaagtcttaggattacaggcgtgagccaccacacccggcctcctgtgtgttttgaaggtgattgtgacctcaggttttggcagggctataccttgtgtttgctcttactccaactccatggcatacctggaccaggcctcttcatcttgaagagggatctgctgaaatgcaggcccagtgaatctccccatgcctggacacagttccgtcaagccaggacccggtgctgcctgcacccctgtttctgttagtctgactgtcctcrctgagtctaactccttgagggcagagaggatgtcttatttatttctgccccgctagccgtgtaaactgagtaggtacttgtaaatgttcattgaataagtacctgattaatagaatttaattcaagaagaatgtattgatgggcctgtgtggtcaccacagtactgagatgtaggtgggagctggctgaagggggaggcacctaaacaggagtgcagacagcggcacctacggatgatggcccgctccatcccaccgcagcgaaattgtcccagacctctgcagcttcccccacacctag

SEQ ID NO: 177377 - DNA, 601 bp, Human
tctgactgtcctcgctgagtctaactccttgagggcagagaggatgtcttatttatttctgccccgctagccgtgtaaactgagtaggtacttgtaaatgttcattgaataagtacctgattaatagaatttaattcaagaagaatgtattgatgggcctgtgtggtcaccacagtactgagatgtaggtgggagctggctgaagggggaggcacctaaacaggagtgcagacagcggcacctacggatgatggcccgctccatcccaccgcagcgaaattgtcccagacctctgcagctycccccacacctagactgagagagagctcttcttccttctgtagggagcaggtgtttcctccagatgtccaatatgtacctcccattacagcggtgttaggaaggtgagggctgccgctgaaagggtccccttcataatcatcactagatttggggtatattatggattaaatagaatttttataagatgacctgaggatctatttaaataaaatcctctttctttctgcaagatcatggatttaaattcaacacaactgacttcatagggaaggggtatggtgaaagggaagtgaggtgg

SEQ ID NO: 177378 - DNA, 601 bp, Human
ctggctgaagggggaggcacctaaacaggagtgcagacagcggcacctacggatgatggcccgctccatcccaccgcagcgaaattgtcccagacctctgcagcttcccccacacctagactgagagagagctcttcttccttctgtagggagcaggtgtttcctccagatgtccaatatgtacctcccattacagcggtgttaggaaggtgagggctgccgctgaaagggtccccttcataatcatcactagatttggggtatattatggattaaatagaatttttataagatgacctgrggatctatttaaataaaatcctctttctttctgcaagatcatggatttaaattcaacacaactgacttcatagggaaggggtatggtgaaagggaagtgaggtgggcagcactgatatttaacaaggtgagggtccttctcctgctctgactgtcacattaaaatattcccaggagaaattggagaaaactcagatgaaatatcgtctgtgttccaggaggcaggactcatcggaatgcttttattttgctccattttaagagatttgcagataaagaggagtgaagatttctattcaga

SEQ ID NO: 177379 - DNA, 601 bp, Human
aaatcctctttctttctgcaagatcatggatttaaattcaacacaactgacttcatagggaaggggtatggtgaaagggaagtgaggtgggcagcactgatatttaacaaggtgagggtccttctcctgctctgactgtcacattaaaatattcccaggagaaattggagaaaactcagatgaaatatcgtctgtgttccaggaggcaggactcatcggaatgcttttattttgctccattttaagagatttgcagataaagaggagtgaagatttctattcagatttacttgctttatacttttaacttatagaccacaagccaactttcgaaagagcatcattttgaatagtaagagttaggaaggcaaatacagaaggactaatggcttccaagattatgagcttcataggaatggtttgagatgaggctatagtaaagcagaatattgaagttcccccaccccctttcatttttcatttttcatttttaagagtgagcgaggccaggcgtggaggctcacacctgtaatcccagcactttgggaggccgaggtgggcagatcacaaggtcaggagtttgagaccagcctggccatca

SEQ ID NO: 177380 - DNA, 601 bp, Human
cttttattttgctccattttaagagatttgcagataaagaggagtgaagatttctattcagatttacttgctttatacttttaacttatagaccacaagccaactttcgaaagagcatcattttgaatagtaagagttaggaaggcaaatacagaaggactaatggcttccaagattatgagcttcataggaatggtttgagatgaggctatagtaaagcagaatattgaagttcccccaccccctttcatttttcatttttcatttttaagagtgagcgaggccaggcgtggaggctcayacctgtaatcccagcactttgggaggccgaggtgggcagatcacaaggtcaggagtttgagaccagcctggccatcatggtgaaaccctgtctctactaaatgtacaaaaattagccaggcttggtatcaggtgcctgtaatcccagctactcaggaggctgaggcaggaaaattgcttgaacccaggagtcggaggttgcagtgagctgagatcgcaccactgcacatctcagaaaaaaaaagagtgaggccccaagtttttttgcatttgtttgtaactgaatacgtctgaagttatg

SEQ ID NO: 177381 - DNA, 601 bp, Human
gaagtgatctgcccgcctcagccaccctaagtactgggattacaggcatgagccaccacacctggcttctgtttttctatctgtgcattggggatgaaattaacacaaatgatgtttaaagaaaaaaatgctcagagaagttagaaatgtgctttaaattggaatcatctcttagtatgtaaaagttttttgtaatagaaacaagcagggcagtatttgacctgttgacagtgtccttggactttacaatttgtgaagcagcgtattttgcttgagttgtacgattgtcgtttttttcccyccactttgacaactgttacagaacctgtcaccagatacaggcaagggaggttgggcttcccatctctgcacggcttccctgtgattcacaagcaagcaatcagaagtgcacaaaagtttagaacgcgattttcattctcttctttccttagaaaaactcgctttgttagccttttccagaaaggaaggcactcaattgttgtaatactcaaatcataaaaagaagcctagtctagtctattcagcaaggtgttctgaaagagggaattttttaagttcaattatgcgaagatcttgaagg

SEQ ID NO: 177382 - DNA, 601 bp, Human
agaaaaactcgctttgttagccttttccagaaaggaaggcactcaattgttgtaatactcaaatcataaaaagaagcctagtctagtctattcagcaaggtgttctgaaagagggaattttttaagttcaattatgcgaagatcttgaaggtgggactcaaaggagagggctatcctgggaagaaggctttggaaaatgagaggcatgaaggggagagggtatttaaatgtgtttgaagccaaggatccttgagagaaaaagctggcactaacagcgttcaaagaacttgcgtgacaagtkatgactaatgacactgagggtgggttgtgggtgcctagtgaattcctccgaagccaagagagaggtttccagacccagggaagaaggtgtgtacacccagaagtagtgtagggacagagattccgatcacaagctgtgactggaagacgccgaccaccactgcagcagcctgaaaaccacagtcttgaaccgccagcgaagggctgggaagtgcggatccagggctggtgcactgaacccagaggagcaggctcccattcccagctaagggtggcagctggcggggatctttccagcaga

SEQ ID NO: 177383 - DNA, 601 bp, Human
cactaacagcgttcaaagaacttgcgtgacaagtgatgactaatgacactgagggtgggttgtgggtgcctagtgaattcctccgaagccaagagagaggtttccagacccagggaagaaggtgtgtacacccagaagtagtgtagggacagagattccgatcacaagctgtgactggaagacgccgaccaccactgcagcagcctgaaaaccacagtcttgaaccgccagcgaagggctgggaagtgcggatccagggctggtgcactgaacccagaggagcaggctcccattcccagcyaagggtggcagctggcggggatctttccagcagaaagctgtaagtggaagctttcaattcagagcagtagcaatgccttcaaagtcccaggcttcacgtgggaacagagaatgtgaagagtatttagcaggatgccaatataagaaatctatattggtgttcgtttgtttgtttttgagatggagtctcgctctgtcacccaggccggagtgcagtggtgcgatctcagctcactgcaatctctgcctcctgggttcaagcgattctcctgcctcagcctcctacatagctggtactaca

SEQ ID NO: 177384 - DNA, 601 bp, Human
agcagaaagctgtaagtggaagctttcaattcagagcagtagcaatgccttcaaagtcccaggcttcacgtgggaacagagaatgtgaagagtatttagcaggatgccaatataagaaatctatattggtgttcgtttgtttgtttttgagatggagtctcgctctgtcacccaggccggagtgcagtggtgcgatctcagctcactgcaatctctgcctcctgggttcaagcgattctcctgcctcagcctcctacatagctggtactacaggcacgcgccaccatgcctggctaaattkttgtatttttagtagagatggggtttcaccacgttggccaggctggtctcaaactcccggcctcatgatccgccctctgcagcctcccaaagtgctgggattacaggcgtgagccaccgcacctggcccaatattgtttgtttatttatttcttgacaggatctcactctgtcaccaggctggagtgcagtggtgtgatctcagctcactgcaacctccacctctctggctcaagcaatcctccctcctcagcctcctgagcagctgggactacaggtgcacaccaccacacccaactag

SEQ ID NO: 177385 - DNA, 601 bp, Human
cagcctcctacatagctggtactacaggcacgcgccaccatgcctggctaaatttttgtatttttagtagagatggggtttcaccacgttggccaggctggtctcaaactcccggcctcatgatccgccctctgcagcctcccaaagtgctgggattacaggcgtgagccaccgcacctggcccaatattgtttgtttatttatttcttgacaggatctcactctgtcaccaggctggagtgcagtggtgtgatctcagctcactgcaacctccacctctctggctcaagcaatcctcccwcctcagcctcctgagcagctgggactacaggtgcacaccaccacacccaactagattttgtgttttttgtagagatggggtttagccatgttcagctagtctcaaactcctgggctcaagtgatctgtccgccttggcctcccaaagtgttgggattacaggtgtgattcatgatgtccagcccagtatttttctttcactctggaaaccaaaaattattggctttttttcctgttgcattccctttacttagatgaatctagcaaggttggctgttagtgtctaggtcagaagtctaag

SEQ ID NO: 177386 - DNA, 601 bp, Human
cttagatgaatctagcaaggttggctgttagtgtctaggtcagaagtctaagtgaaagtgaatatttaaccacactcaagcacagctgatgatctttaatactaatagaggtataagacttaaaagaaacaagaacccagagggaaaatatggccatggactcagagaaaaccacggcagcttccatggactcataaaaagagctcaaaacctaggaagtggatggagactctttttggaatgaatgaattcaaatgtgggctttcttagtagattaaatcattttctagaaggaatttcrgaaggatgtgtgcccaattatggtatcaggtctgttgtagactcttcaaggaggaagcctctgaaagacaagaaggaacaattaaaaattagaattcaggtgagtggatcacgaggtcaagagatcgagaccagcctggccaacatggtgaaaccccgtctctactaaaaatacaaaatttagctgggcatggtatggctgtagtcccagctactcgggaggctgaggcaggagaatcacttgaacccgggaggcggaggctgcagtgaaccaagattgtgccactgcactccagcctgg

SEQ ID NO: 177387 - DNA, 601 bp, Human
agtagctatttcaaaacgtagggctgataaatttgggatggtttgagaacgttaagttggggaactccatttctttttttacatttttatttattttcatttgtttatttatttatttgagacagagtttcgctctgttgcccaggctagagtgcaatgccatgatctcggctcactgcaacctctgcctccggggtataagtgattctcccatatcagcctcccgaggagctgggactacaggcgcctgccaccacacctggctaatttttgtatttttagtagagatgggatttggccrtgtcagccaggctggcctcaaactcctgaccgcaggtgatccgcctgcccttggcctcccaaagtgctgggattacaggtgtgagccaccgcgcccagccagggaactgcatttctgacagtggctcagtagtttggaagttaactggcaaaggtggacagaatctttaaacatatgtggaggaattggagagtttacaagatagtgaagaactgccaggccatggtctggagaagatggaaacttgatgtttggggccattgtgtccctggggtgttggccaatttatgaaagaagcag

SEQ ID NO: 177388 - DNA, 601 bp, Human
gacagtggctcagtagtttggaagttaactggcaaaggtggacagaatctttaaacatatgtggaggaattggagagtttacaagatagtgaagaactgccaggccatggtctggagaagatggaaacttgatgtttggggccattgtgtccctggggtgttggccaatttatgaaagaagcagttaagagcctgagtggcacttttgaggggctagaagggaagaccctggtaaacatcccaaactttggattgggacccaaaaaagctccatcccaggagtacaggtgacctggaaacrgatcagcgtaatcgaggactgaagtccagttctagctacgcccagtccttgagactggattaaggtgatctcagattgcaaggacctcaaatgcctggcagaagcaagtgaatatccttctggaggaacagagcctcatcctaggcctctaattatttttaaggacaatttttcaaatgcaggctttcctccctttgcacagttcccttatgcataaatttcagtcagtggccagctgcagtggctcatgcatgtaatcccagcgctttgggaggccaaggcgggtgaattgcttgagtc

SEQ ID NO: 177389 - DNA, 601 bp, Human
agtttggaagttaactggcaaaggtggacagaatctttaaacatatgtggaggaattggagagtttacaagatagtgaagaactgccaggccatggtctggagaagatggaaacttgatgtttggggccattgtgtccctggggtgttggccaatttatgaaagaagcagttaagagcctgagtggcacttttgaggggctagaagggaagaccctggtaaacatcccaaactttggattgggacccaaaaaagctccatcccaggagtacaggtgacctggaaacggatcagcgtaatcraggactgaagtccagttctagctacgcccagtccttgagactggattaaggtgatctcagattgcaaggacctcaaatgcctggcagaagcaagtgaatatccttctggaggaacagagcctcatcctaggcctctaattatttttaaggacaatttttcaaatgcaggctttcctccctttgcacagttcccttatgcataaatttcagtcagtggccagctgcagtggctcatgcatgtaatcccagcgctttgggaggccaaggcgggtgaattgcttgagtctgggagttggagac

SEQ ID NO: 177390 - DNA, 601 bp, Human
tcagtggccagctgcagtggctcatgcatgtaatcccagcgctttgggaggccaaggcgggtgaattgcttgagtctgggagttggagaccggcctgggcaacatagaaccccatctctatttttaaaaataaaatattaattatcactgcttagttaaattatagtggtctcccaacaatacagatcagatcccagctcccatggtatatacactgtgagtgctgtataaagtacaagctctgccgccagttctccagcctacaaatcacagtatagataacagatgtgcatgatgatcrctggccaattgcgtcacttctctcaaagtcagtctgtgattggtccctgagcatctgtcggtcagtttcatgcacagactgcaaagcatatggttttgtctactctttgtctctcagtgataaacccacatggcattttgtaaaagtggatacatcaggccaggtgtggtggctcatgcctgtaatcccagcactttgggaggctgaggcaggtggatcatttggggtcaggagtttgagaccagcctggccaacatggtgaaaccccatctctactaaaaatacaaaaattagctggat

SEQ ID NO: 177391 - DNA, 601 bp, Human
gggcaacatagaaccccatctctatttttaaaaataaaatattaattatcactgcttagttaaattatagtggtctcccaacaatacagatcagatcccagctcccatggtatatacactgtgagtgctgtataaagtacaagctctgccgccagttctccagcctacaaatcacagtatagataacagatgtgcatgatgatcactggccaattgcgtcacttctctcaaagtcagtctgtgattggtccctgagcatctgtcggtcagtttcatgcacagactgcaaagcatatggttktgtctactctttgtctctcagtgataaacccacatggcattttgtaaaagtggatacatcaggccaggtgtggtggctcatgcctgtaatcccagcactttgggaggctgaggcaggtggatcatttggggtcaggagtttgagaccagcctggccaacatggtgaaaccccatctctactaaaaatacaaaaattagctggatgtggtggcaggcgcctgtaatcccagttactggggaggctgaggcaggagaattgcttgaacccaggaggcagagcttgcagtgagccgagatcat

SEQ ID NO: 177392 - DNA, 601 bp, Human
gaaccccatctctatttttaaaaataaaatattaattatcactgcttagttaaattatagtggtctcccaacaatacagatcagatcccagctcccatggtatatacactgtgagtgctgtataaagtacaagctctgccgccagttctccagcctacaaatcacagtatagataacagatgtgcatgatgatcactggccaattgcgtcacttctctcaaagtcagtctgtgattggtccctgagcatctgtcggtcagtttcatgcacagactgcaaagcatatggttttgtctactcyttgtctctcagtgataaacccacatggcattttgtaaaagtggatacatcaggccaggtgtggtggctcatgcctgtaatcccagcactttgggaggctgaggcaggtggatcatttggggtcaggagtttgagaccagcctggccaacatggtgaaaccccatctctactaaaaatacaaaaattagctggatgtggtggcaggcgcctgtaatcccagttactggggaggctgaggcaggagaattgcttgaacccaggaggcagagcttgcagtgagccgagatcatgccactgcac

SEQ ID NO: 177393 - DNA, 601 bp, Human
aaaattagaaacttttactcatcagaaaacacttaataaaatgaaaagtcaagccatagacttagagaaaatatttacaaaacatatatctgacaaaggacttggatatggattatataaagaactattgtaattcaataagatgtcaaacaacccaattaaaaatgggtgaaagatgaactaactcttcaacaatgggcatgtcatttgaatggatggtaagcaagcacatgaaaagatgttcatgtgcctttccctcattagtcactagggaaatgcaagttcatagacatctctcttsgtagaaagatatcactacacacccacaagagtggctgtaattaagcagtctgaccaagtatgcgtaagaatgtggaataagaactctcatacactgctgatgggaatgtaaaatgatagccactttggaaaacattttggcaaataataccacttacattattatcgaaaatattgtatacctgaaagaactcaaagtgaaaaagctatatactgtctgcttccaaggctacacattatgggaaaggcaaaactatgaagacagtaaaaagatgcgccagtggttgccaggggctcatgg

SEQ ID NO: 177394 - DNA, 601 bp, Human
tggaagccatgctcgagaagagcccatccccaggaggtgatcagggttctcctccaggtgaggaacctggcagccgtgtgtgagaaccttagaaaagggagagggaagaggctgtggcaggaagtgaggagggagttagtgataccctgggcaggatgccatgagctgggatggaaaccacaggatgaatgcaagtaattaaaaaaaaaaaaaaaaaaaacagcattgggccgggcagtggctcacgcctgtaatcccagcattttgggaggccgaggtaggtggatcacctgaagtcagsagttggagaccagcctagccaacatggtgaaactgaaaatgcaaaaattagccaggcatggtggcgtgtgactatagttccagctactcaggaggctgagacaggagaatcacttgaacctgggaggtggatgttgctgtgagctgagatcgtgccactgcattgcagcctcggtgagagagcaaggccccatctcaaaaaagaaaaaaacagactttccgaccaaacgatcgacaaaccagactgtccaaacagccataagccgtaactttgtgcggaggtaaaagaccgaggtcacat

SEQ ID NO: 177395 - DNA, 601 bp, Human
cctgggcaacagagcaagaccctgtatcaaaaaaacaatcaaacaaaaaatcactcctaattttcctcccttttagtacttttaaaaattaacttaaaacattttttggataattgtagttttttttacttttttttttttgagacagagtctcattctgtcacccaggctggagtgtactggtgcaatctcaggtgactgcaacctctgtctcctggattcaagtgattctcctgcctcagcctcctgagtagctgggttcataggcgtgcaccacacctggctcgtttttatatttttrgtagagatggggtttcaccttgttggccaggctggtctcagattcctgacttcaagtgatctgcccgccttggcctcacgtgcagttttaggaaataatacagagatccccagcactctttccagttttccccaagggtaacatcttgcaaagtgagaggacgatatcacagtcaggatactgacattgataccatcaagatacataatgtttccatcaccaatcagtggtcatggtgccttttatagccaaacccacttctctcctaccttcccatcccttttttaattttgccagtca

SEQ ID NO: 177396 - DNA, 601 bp, Human
tactctgtatggcttcaattcttttaaatttgttgaggtttgtttaatggtcaaagacatggtctgtctaggtgaatgttccatgggcttttagggaaaaaagtatattctagtgttgttgaatggtgtcttagtccattcaagctgctataacaaaataccgtaaactgggtgatttataaacaacagaaatttttctctcacagttctggaggctgggaagttcaagatcaaagtgccagcagattcagtgtcatgtgaggacgtgcttcctgcttcatagataagaggtacatacacrtttaggagcatcgtgtcttcctggtggatgaattctgttatcattaggtgatcctttgagcacttttaaaaagaatctgttggccgggcgcagtggctcacgcctgtaatcccaggactttggggggccaaggcgggcagatcacgaggttaggagattgagaccatcctggctaacacagtgaaaccctgtctctactacaaatacaaaaaaattagccgggcatggtggcaggcgcctgtagtcccagctactcaggaggctgaggcaggagaatggcgtgaacacaggaggcagagc

SEQ ID NO: 177397 - DNA, 601 bp, Human
aacaaaataccgtaaactgggtgatttataaacaacagaaatttttctctcacagttctggaggctgggaagttcaagatcaaagtgccagcagattcagtgtcatgtgaggacgtgcttcctgcttcatagataagaggtacatacacgtttaggagcatcgtgtcttcctggtggatgaattctgttatcattaggtgatcctttgagcacttttaaaaagaatctgttggccgggcgcagtggctcacgcctgtaatcccaggactttggggggccaaggcgggcagatcacgaggtyaggagattgagaccatcctggctaacacagtgaaaccctgtctctactacaaatacaaaaaaattagccgggcatggtggcaggcgcctgtagtcccagctactcaggaggctgaggcaggagaatggcgtgaacacaggaggcagagcttgcagtgagccaagatcacgccactgcactccagcctgggcaacaaagtgagaccctgtctcaaaaaataaaataaaataaaataaaaataatctgtttaatagcctactagtgttcttcctttactattttattgagcattaattaatc

SEQ ID NO: 177398 - DNA, 601 bp, Human
tctcttagcacggactgtgtgctctgaggcgagtgtgtgattgaccagaaccagggcatcacatacagctgacaggagctgccccacagctgcagcaggctgtggcaggaataaggtactctcctagctaagcagcacctgaaacttccgtaataggacccagtctggtcagtctggaacgaaagtgagagtgagtgtgcatcacaaagggcgggatgggaggaaaagcatcgaaacccactcctctggggtgcatgttaaagaattttaagaaaggttttgctggagattatggaattawgttgtcccccccaaagattgagggttctgtgtgaagtggaatggccttcttttaatgtcgggtggccagccgagggtacaataaatagggaaatgattggtcatatatttagggtagtgactggggttggaggacaccctgggcatccagatcagttcccatacatcaattcctggatgatcacagtctagacatgccccaaatggttacagccttgtctggcaacttactgtaagactctagtgacctgagccgaacctaaggcagttagagggcccccttcaccagacacctcaggtg

SEQ ID NO: 177399 - DNA, 601 bp, Human
cggactgtgtgctctgaggcgagtgtgtgattgaccagaaccagggcatcacatacagctgacaggagctgccccacagctgcagcaggctgtggcaggaataaggtactctcctagctaagcagcacctgaaacttccgtaataggacccagtctggtcagtctggaacgaaagtgagagtgagtgtgcatcacaaagggcgggatgggaggaaaagcatcgaaacccactcctctggggtgcatgttaaagaattttaagaaaggttttgctggagattatggaattaagttgtccccyccaaagattgagggttctgtgtgaagtggaatggccttcttttaatgtcgggtggccagccgagggtacaataaatagggaaatgattggtcatatatttagggtagtgactggggttggaggacaccctgggcatccagatcagttcccatacatcaattcctggatgatcacagtctagacatgccccaaatggttacagccttgtctggcaacttactgtaagactctagtgacctgagccgaacctaaggcagttagagggcccccttcaccagacacctcaggtggaaagaaaaa

SEQ ID NO: 177400 - DNA, 601 bp, Human
cacagataaactgggaaagaaaaataacttgtgagtaattcagaatctggattatcaggtcaggctcaatggctcacgccagtagtcccagcactttgcggggcccaggagggcagatcacttgagttcaggagtttgagaccagcctgggcaacatggcgaaaccctgtctatacaaaaaatagaaaaattagccaggcatggtggcatgtgcctgtagtcccagttacccgggaggctgaggtgggaggatcacttgagcctgggaggtcgatattgcagtgagctgtaattgcaccaygcactccagcctgggtgaaagaaggaaactctgtgtccaaaacaaaacaaaacaaaacaaaaaaagctaaattatcaaatgtctagatcgttgatggttggaagtaaagttgagaaatgttcacactgggagatgacacacagtaaaccacacagagggttctaacgtggttgttagaagcagaaactagaggcttgctgcctgaggtcaaaccccggtcccggtggttctgtgccccagcgcatgttgtggtagcctctctgtacttcagtttcctcatctgtaaagtaaacataatga

SEQ ID NO: 177401 - DNA, 601 bp, Human
ggtcccgcctttgtagatgttatagtttgggaagaccagccgggcagagagaagagcatgattcaaggatgaaggcgtgggctgggggccgagggagcaaggattcccagtaacgagggaggaaggagcagcaccatgtgcccattactctatagacatctcgaaccacctggccatgtagctgtcattaacctaaatttacagttattgaaactgaggttcagccaggcgtagtggctcacgcctgaacacaggaggcggaggttgcagtgagccgagatcacgccactgcactccaggmtaggtgagagagcgagactctgtctcaaaaaaaataaataaataaaagaaaagaacaaaactgaggttcaaagaaatgtacagtgctcccccccttatccaaagaggatacactccaagcccccacagtggatacctgaagcctcagatagtatcaagccctatatatgctatgttttttccctgtatatgcatacctatgataaagtttataaattaggcacagtaggagactaacaacaatgataataaaatggaacaattataacatacactgtaacaaaagggtctcttcctctct

SEQ ID NO: 177402 - DNA, 601 bp, Human
acaaactttctgaaaattatgaagaagtgctgggttttaaatggaagtcatatagtgtgaactttgtgtaaagtccgtagggagttttcttggaaatggctgggaacattctttttgcacctttgaagataaaggtaggtggaggagctcacagctcttgtgccatgttgggcttgtcactcttgtttatgtgccaaattcttttgattacaaaattttaagtttaatgctttaggtattgttgggcaagatctagatgtatctagttaaatgtaggtgatatgcaaactatttatgatgyatttgatttaaattcattaagatagagtgtctttaccaccattatagtctggtccttttccttctgttttaaatgtgtttccattggcattttctaaactgactttgttagcgtgttaatcatttggcactggtaatgattaatcttttctttctttctattttttttcttttttttttttgagacagagtcttgctctgtcaccaggctggagtgcagtggcgcagtctcagctcactgcaacctccgcctcccaggttcaagtgattctcctgcctcagcctcccaagtagctaggga

SEQ ID NO: 177403 - DNA, 601 bp, Human
ctcaattccatttgttggttgtcttgagtgtctgatcacatagaatataaagatgttttgatagttgggacagtattcagctacctgctatttaatacattatttcagaaaatatttacaaagggggctgggcacagtggctcatgcctgtaatcccagcactttgggaggccgaggtgggcggattacctgaggtcaggtgttcaaaaccagcctggccaaacatggtgaaaccacatctctactaaatatacaaaaaattagccgggcgtggtggtgtgtgcctgtagtcccagctacycaggaggctgaggcacgagaatcgcttgaacccgggaggcgtggggttgcagtgagccgagattgcacaactgcactccagcctgggtgacagagtgagactgcatctataaaaacaacaacaaaaaagaaaatatttgcaaaggaccttctgggtccaagaacctcatgtccaatacaagggtgcacacgtgggtgagacacggcagctgctctccagaagcccacagtggaggggtttcccttcggtctccttttattccaagcaagtggcaaaactactttactcttaatacaaacc

SEQ ID NO: 177404 - DNA, 601 bp, Human
ccccggacactccacacgtgcattcatttcgttgttcaccatctgtgtcccagttacaagggaggctccctgagagcagggatctgatttttgttagttgttgttgttgctgttttgaggtggagtcttgctttgtcgcccaggctggtgtgcagtggtgcgacctcagctcaccgcaacctccgcctcccatgttcaagcggttctcctgcctcaacctcctgagtagctgggattacaggtgcctgccaccatgcccagctaatttttgtatttttagtagagacagagtttcatcatsttggtcaagctgccctccaactcctgacctcgtgatctgcccacctgggcctcccaaagtgctgggattacaggcatgagccactgcacccgaccctgttttttgtttggttttggttttggtttggttttggtttttttttgagacacggtctcactctgtcgccccggctagagtgtggtggcaccatctcggctcactgcaacctccacctcccaggttcaagtgattctcctgcctcagcctcctgagtagctgggattacaggcacatgccaccacacccagctaatttttgtat

SEQ ID NO: 177405 - DNA, 601 bp, Human
gtatttttagtagagacagagtttcatcatgttggtcaagctgccctccaactcctgacctcgtgatctgcccacctgggcctcccaaagtgctgggattacaggcatgagccactgcacccgaccctgttttttgtttggttttggttttggtttggttttggtttttttttgagacacggtctcactctgtcgccccggctagagtgtggtggcaccatctcggctcactgcaacctccacctcccaggttcaagtgattctcctgcctcagcctcctgagtagctgggattacaggcrcatgccaccacacccagctaatttttgtatttttagtagagatggggttttgccatgttggccagtctggtctcaaactcctgacctcaagtgatccgcccgcctcggcctcccaaagtgctgggattacaggtgtgagccactgtgcccggcccagggatctgtttttgtctccgctgtgtccccagcacctcaaacatattgtacggagctgcgacagctgcgcagtcagtgatgactgagagattcctggccccgtgggctatggctccttcaacagtttgttgtttaaaggttctt

SEQ ID NO: 177406 - DNA, 601 bp, Human
tctcaaactcctgacgtcaggtggtccgcctgcctcagcctcccaaagtgcagggatcacaggcatgagccactgcacccggcccaattaaaatctttaacactaaacaatctagtacatcactggtggaaacagacatacacctattgcaaagggcatctcagctttaaggactcagtcacctcctgagcaagatggagggagaactggggaggggtcccatggggactgtaattctctctaggttgtatatttttaaaagacttcagcagtgtgataaacctgggtggtgtgtacatgkgtattacagtcatgttgcttaatgacagggacaggttgtgagaaatgcatccttaggtgatttcatcattgtgtgaaagtcatagagtacacttaaacccagatggtagagcctgctgcacaccgaggctctgcggtgcagcctgttgctccaaggcacgcacctgtacagcgtgttactgtactgaacggcgtaggcccctgtgacacaatggtaagtatttgtgcgtctaaacataccaaaacatatagtagaaaaggttacagcaaaaatacagtattatcatcttatgggaccatg

SEQ ID NO: 177407 - DNA, 601 bp, Human
gaaagttctttcctggcagtggccaggagggctgcccagccccctcctgcctcctctggcagcttaaacacaggaccccttattctgtgctctctcctgacccctggtcctcatgcaggagggaaccctgctcttctagggtccttttctaaaagtagtgtcttttaggtcattgtcaagaactataatctaaaatgtatttttaactcatctggaaattctgacagaggtaaggcttgagaatttcctgcatactagccttgtggtctatataatccattaaaagccacatttaacccarttccacagactgaactgtgcttcccatctaaataaattaaaagcaggccgggcacggtggtcacgtgtgtaatcccagcactttgggaggtcgaggcgggtggatcacctgaggtcaggagttcgagaccaacctggccaacatggtggaacctcatctctactaaaaataaaaaaaattagctgggcgtggaggcgtgcacctcttaagcttaaggacatatttcttatgatccaattaatgtaaaatattttattttttatttattttttgagacagagtttcactcttgctgcccag

SEQ ID NO: 177408 - DNA, 601 bp, Human
ggtcaccatagtgggtagtagatcactaaatcttattcttcctgtctaactaaaacttttttccttttgaccaacatctccccattccctccctcaacctcagcccctgataaccaccattccactctctactgctatgagtttgacctttttagatttcacatatgagatcacatggtatttgtctttctgtgcctggcttcttttacttagcataataccttccagatttacccatgttgttgcaaatggaatttccttcttttttaaggctgaatagtattcgtgtgtgtgtgtgtgygcgtgtgtgtgtgtgtgtgtatcacattttctttatctcttcgttcattaatgatcatttaggatgattccacatcaggctactgtgtatagtgctgcagtaaacatggaagtgtagacatctcttcagcatactgcttccaatctctttggatataaacccagaagtgggattgctggatcatatgtagtgctatttttgtttttttgaggaacctccatacttattttgcataatgctattctaattcacaatactaccaacagtggacatgggttcttttttctctacatgcttgcc

SEQ ID NO: 177409 - DNA, 601 bp, Human
gtctaactaaaacttttttccttttgaccaacatctccccattccctccctcaacctcagcccctgataaccaccattccactctctactgctatgagtttgacctttttagatttcacatatgagatcacatggtatttgtctttctgtgcctggcttcttttacttagcataataccttccagatttacccatgttgttgcaaatggaatttccttcttttttaaggctgaatagtattcgtgtgtgtgtgtgtgtgcgtgtgtgtgtgtgtgtgtatcacattttctttatctcttcrttcattaatgatcatttaggatgattccacatcaggctactgtgtatagtgctgcagtaaacatggaagtgtagacatctcttcagcatactgcttccaatctctttggatataaacccagaagtgggattgctggatcatatgtagtgctatttttgtttttttgaggaacctccatacttattttgcataatgctattctaattcacaatactaccaacagtggacatgggttcttttttctctacatgcttgccaaccacttgttatcttttatctttttatatatctggctgcttc

SEQ ID NO: 177410 - DNA, 601 bp, Human
tgtgtgtgtgcgtgtgtgtgtgtgtgtgtatcacattttctttatctcttcgttcattaatgatcatttaggatgattccacatcaggctactgtgtatagtgctgcagtaaacatggaagtgtagacatctcttcagcatactgcttccaatctctttggatataaacccagaagtgggattgctggatcatatgtagtgctatttttgtttttttgaggaacctccatacttattttgcataatgctattctaattcacaatactaccaacagtggacatgggttcttttttctctacrtgcttgccaaccacttgttatcttttatctttttatatatctggctgcttctaaatttttttctttcttaccaattctgaaccatttgatggtttcttcctttatgctccttgtgcttgaggttcattgagcatctgggatcagtgcacttattgttttcatcaaattcagaagattaggccattatttcttcaaacttttttgtcgttctctgtctacctttgagagctccaattatacatacattaggccacttgaagttgtcattacagttcactaatgctaagttctttttttaag

SEQ ID NO: 177411 - DNA, 601 bp, Human
ccaacagtggacatgggttcttttttctctacatgcttgccaaccacttgttatcttttatctttttatatatctggctgcttctaaatttttttctttcttaccaattctgaaccatttgatggtttcttcctttatgctccttgtgcttgaggttcattgagcatctgggatcagtgcacttattgttttcatcaaattcagaagattaggccattatttcttcaaacttttttgtcgttctctgtctacctttgagagctccaattatacatacattaggccacttgaagttgtcattacagttcactaatgctaagttctttttttaagtcttgtttctgtgtttcattttggacactttctattgctacatcttcaaatttactaattttttcttctgcaatatctaatctgctcctaatcctatccagtgtattttccatattagatattgtagttttcataactagaagcatgatttggttctgttttcacccatgtatctatataacatgtccagtctttcactcagcttcttaaacatttagaatatggtcagaataactttttttgctgttttgttttagagacagggtct

SEQ ID NO: 177412 - DNA, 601 bp, Human
tacttgggaggctgaggcaggagaattgcttgaacccgggaggcagaggttgtggtgagccgagatcacaccattggactccagcctgggcaacaagagcgaaactccatctcaaaaaaaaaaaaaaaaaaaactcttagccacaatttctatcatctgtgtcacttctgagtccctttctattcagttatttttctccttgtcatgggtcatatttttctgattcttcatgtgtcctgtaattttcttttctttttttttttggagatggagtcttactctctcacccaggctgtagtgygatggcacaatcttggctcactgcaacctccacctcctgggttcaagtgattctcctgcctcagcctcccaggtagctgggattacaggtgctcaccaccatgcccagataattttttgtatttttagcagagacggggtttcaccatgatggccaagctggttttgaactcttgacctcaagtgatccgcccacctcggcctcccaaagtgctaggattacaggcatgagccaccgtgcctggccagttgttctcattggatgtcatatgttgggaactttattgggtgatggatattt

SEQ ID NO: 177413 - DNA, 601 bp, Human
tggccatctgtagctgtatgaagccaaacatgagtgtgtgctgatgtctccagccctcatctgttaccagatggatcgttctagcctcctccacttgcctacctgtcaattcaccattccttgagttcatggttcattttcagtatacctgcacagtggtatcagaactgttaacccacaccctgtgggaaaaaaactccatcagctagagcacagtgtttacagccagatccttttgcctttagtcttacagattccaatcattccaaattattcggtgcagcgcctttccgcacctgcrcccactttttcccctgagattgtttcctacattcgtagcacagttagattgttttgttacattctgcatttcaccctgggatcctccaacctcctaagttatttttgttttatttgcacacattaggttcaatctgaactataaagttctgtgggttttcacaaatgcgtagtgtcatgtatccaccactacattttccttctctctctttcttgctttctcgccttcttgtctcgctctgtcacccaggctggagtgcagtggcacaatctcggctcactacaacctccgtctcctggg

SEQ ID NO: 177414 - DNA, 601 bp, Human
aatatgcatttaagagtcatccatgtctttccatggcttgatatctcatttctttttacactgaatgagttcccactgtctgtttgtaccacagtttgtatatctattcacctatctaagggcatcttggttgcttccaatttttggcaattaataaagctggccatgcacagtggctcacacctgtaatcccagcattttgggaggccaaggcgggcagatcacttgaggtcaggagtttgagaccagcctggccaacatggtgaaacgctgtctctactaaaaatacaaaaattagccrggcgtggtaatgggcacctgtaatcccagctacttggaaggctgaggcaggagaatcacttgaacctggaggcagaggttgcagtgagctgagatcgtgccactccactccagcctgggtgacagagtgagactctgtcccaaaaagaaaaagaataaactgctgtatacatgtgtaggttttgtgtggacagaagttttcaaatcagttggacaaatacctaagagtgtgattccatcatacagtaaaactgctttgctttgtcagaaactgccagaatgtcctccaagggggctgtct

SEQ ID NO: 177415 - DNA, 601 bp, Human
gtatatctattcacctatctaagggcatcttggttgcttccaatttttggcaattaataaagctggccatgcacagtggctcacacctgtaatcccagcattttgggaggccaaggcgggcagatcacttgaggtcaggagtttgagaccagcctggccaacatggtgaaacgctgtctctactaaaaatacaaaaattagccgggcgtggtaatgggcacctgtaatcccagctacttggaaggctgaggcaggagaatcacttgaacctggaggcagaggttgcagtgagctgagatcrtgccactccactccagcctgggtgacagagtgagactctgtcccaaaaagaaaaagaataaactgctgtatacatgtgtaggttttgtgtggacagaagttttcaaatcagttggacaaatacctaagagtgtgattccatcatacagtaaaactgctttgctttgtcagaaactgccagaatgtcctccaagggggctgtctcatgttgcattcccaccagcaatgaatgggggttcctgttgctccacatcctcaccagatttgatgatgtcagttttgtggattttagtcatcctag

SEQ ID NO: 177416 - DNA, 601 bp, Human
aatttttggcaattaataaagctggccatgcacagtggctcacacctgtaatcccagcattttgggaggccaaggcgggcagatcacttgaggtcaggagtttgagaccagcctggccaacatggtgaaacgctgtctctactaaaaatacaaaaattagccgggcgtggtaatgggcacctgtaatcccagctacttggaaggctgaggcaggagaatcacttgaacctggaggcagaggttgcagtgagctgagatcgtgccactccactccagcctgggtgacagagtgagactctgwcccaaaaagaaaaagaataaactgctgtatacatgtgtaggttttgtgtggacagaagttttcaaatcagttggacaaatacctaagagtgtgattccatcatacagtaaaactgctttgctttgtcagaaactgccagaatgtcctccaagggggctgtctcatgttgcattcccaccagcaatgaatgggggttcctgttgctccacatcctcaccagatttgatgatgtcagttttgtggattttagtcatcctagtaggtgtgtggtgacaccacattgttgttctcattctcagt

SEQ ID NO: 177417 - DNA, 601 bp, Human
cacagtggctcacacctgtaatcccagcattttgggaggccaaggcgggcagatcacttgaggtcaggagtttgagaccagcctggccaacatggtgaaacgctgtctctactaaaaatacaaaaattagccgggcgtggtaatgggcacctgtaatcccagctacttggaaggctgaggcaggagaatcacttgaacctggaggcagaggttgcagtgagctgagatcgtgccactccactccagcctgggtgacagagtgagactctgtcccaaaaagaaaaagaataaactgctgtawacatgtgtaggttttgtgtggacagaagttttcaaatcagttggacaaatacctaagagtgtgattccatcatacagtaaaactgctttgctttgtcagaaactgccagaatgtcctccaagggggctgtctcatgttgcattcccaccagcaatgaatgggggttcctgttgctccacatcctcaccagatttgatgatgtcagttttgtggattttagtcatcctagtaggtgtgtggtgacaccacattgttgttctcattctcagtgccccgatgacatatcatgctgagcattgt

SEQ ID NO: 177418 - DNA, 601 bp, Human
atgttcagatcttttgcccattttctttctttttttttttttttttccttttgatacggagtcttgctctgtcgccaggctggagtgcagtggcacaatctcagctcactacaacctttgcctcccgggtccaagcgattcccctgcctcagcctcccaagtagctgggactacaggcacgcaccaccatggcaagctaactttttcttttttttttcttttcttttttttttgagatgaagtctcgctctgtcacccaggctggagtgcattggtgcgatcttggctcactgcaagctcygcctcctgggttcacgccattctcctgcctcagcctcccgagtagctgggactacaggcgcccccaccacgcccggctaatttttttgtgtttttagtagagacggagtttcaccgtgttagccaggatggtcttgatgtcctgacctcgtgatccgcttgctccggcctcccaaagtgctgggattacaggcgtgagccaccacgcctagcccccatttttcaattgagttgtttgttttaagacctctttgtatattaccacatgtgtattgaaaatattttctcccagtctgtggct

SEQ ID NO: 177419 - DNA, 601 bp, Human
cagggtgaggtatgggcggtatggcaaggcgcgggcccatagatgtgcaggtctggagatgtgtgcagcggagatgtgcgggcccgagatgtgcgggtccgatgtgtgggtccggagatgtgcgcgtacccagaggtgcagatcggaaatgtgggggtccggaggaaatgtgcggatcaggagaagtgccagtcccgagatgtgcggatcggagatgtggagggctaggagatgcgtgggtccggagatgcgcagatcaggagatgggcgaatcggagatgcgcgggtccggaaatgtgcrgagcggagatgtgtggatcaggagatgttggggggtcaggagatgcgggggtccagagatgtgggggtccggagatgtgcgggtctggagatgtgcagagcagagcaaagatgagctgatcggagatgcccaggtccggggatccacgggtccggagacgcgcgggtccggagatgcgtgggtccagagatgtgcgggtccaaagatgtgcaaatctgaagatgtgtggatgggagatgtgcaggtccggagatgcgcggggcggagatgtgtggatcggagatgctcagatcgaagatg

SEQ ID NO: 177420 - DNA, 601 bp, Human
cttcaggccaggcgcggtatctcatgcctataattccagcactttgggagaccgagatgggtggatcacctgagatcaggagttcgagaccagcctggccaacatgatgaaaccctgtctctactaaaaataccaaaaaaaattagccaggcgtggtggtgggcgcctgtaagcccagctactcgagaggcaaagacaggagaattgcttgaacccaggagccagaggttgcagtgagccaagattgcgccactgcactccagcctgggcaacaagagtgagactccatcttaaaaaaaaagaaagaaaaaaagaaaaagaaaaagaaactgacctcagtgatagattagcctctctttatagcacagaacccctgagagcgtaagccctgttgtgaactgcgtatttgaggaatctagcttgtacgccccttatgagaatctaatacttgatgttccaaggtggaacactttcatcctgaaactatccctccccacccccatctgtggaaaaattgtcttccatgaaaccggtccctggtggcaaaaaggttggggattgctgctttagagagtctaggacaaatggttcctctgtgctt

SEQ ID NO: 177421 - DNA, 601 bp, Human
tgtacgtgatatgtgggagatcatcatctgaatgtttggtttgaatcagaaatcccttctcacggtgcacgctgcaggtgttcactaacttggaaaatgccaccgcctttctggcacaatgtaccatcttggaacaccagcattctgccctgagccaggcctggcctcagaggcctgggccacagggagaacctcacagccaggacactgtggcactctgctgtctagaagcctgtctccccacccttcccattctaaccccatgcgttcctcagcctccccactgtgcaagcctaggtarggacattatgaagacgtcagcctgcctctcacattcccctgcacactgctgtccctctcccgcgggccaagcagacccactgtggcaaaaatatagaagaatgacttaaaagcaaagagaaaaaagaacccaaagcaaaaatgaactccttcgcatgttttctaaccatatacctttgaaaaagctccttataaagtggccttttccttagggccatgattaattattcatttagttttgttttttatggactatttagtaacattgtttcttgctgggtagagtttaagatgcttttac

SEQ ID NO: 177422 - DNA, 601 bp, Human
aggtcaggagtttgagaccagcctggcgaacatggcaaaaccccgtctctaataaaaatacaaaaattagctgggcatggtagtgcacacctgtaatcccagctacttgggaggatgagacaggagaatagcttgaacccgggaggcggaggttgcagtgagctgagatcgcaccactgcactccagcctgggcgacagagtgcgactccgtctcaaaaaaaaagaaaaaaaaagaaaaagtctcaaatagctgagattcagtggtgcattggactcgctgttagaaacttcagtggtaaractttgatacagaatcgaaaaaccaagtggaaggcaccaaaatgacagaatgttcacctcgtccataggaagggtgtaccacctcaaacatctcaccacgttatgaatttccttctagccaatcatttaatagtttcagaacatgctaattgtgatgtgaatgtaagtcgttcataagagttgcatgtctaccttctggaaaaagaagcagttattatataaactcatcccgaagccccgttcacctccttcactcaaaggttgatgatgcacctgatagtggtgtgcaccctactaatg

SEQ ID NO: 177423 - DNA, 601 bp, Human
gcatggtggcacatgcctatagtccccgcgacttgggaggttgaggaggatgccttgaggccaggagttcaaggctgcagcgagccacgatcgcgccactgcactccagcctaggcgacaaagcgagactctctaaaaaaaattcgaagcagagttaagttgtctttcttcctaacaacctgcccccaccatggggtgcgaatgggactcctggagtcctcctgcacctccccttggagaccaccaagctctaggaaccccatcaccctcagctgagggtcacatgcagcaactagcaggygggaatctgtttgcattttggccttaaagaaataaataataggccaggcgcggtggctcatgcctgtaatcccagcactttgggaggctgaggcaggtggatcacctgaggtcaggagttggagaccagcctgaccaatatggtgaaaccccgtctctactaaaaatacaaaaattagctaggcatggtcgtgggcacctgtaatcccaactacccaggaggctgaggcaggagaattgcttgaacctggaaggcagaggttgcagtgagccgagatcacaccactgcactccagcctgg

SEQ ID NO: 177424 - DNA, 601 bp, Human
tcacccatacagtcacacacatgcatacacacacatacaaacacatgcattcacacagatgcatacacacacacacttacaaactacacatgtgcttatacatgctcacatgcatgtatatgcacacacataccctcaccttatgcacacatgtacccacacacgtacccacacatatacaagcatgcacacatatatatatatacacatgctcacacgcatacccacactcacatgtgtgcacatatgctcacacacacgtgcacacacatgctcacacacacacttactgttgctcaggcttagctgctttgggcttaagaagcaaactgcaccttccaaaaaatgagtgtggtgttcagttaaacaaccaaataattctttagcactgaatatgtggactttagaaattcaaactataaggtgataataacgttgtcctgctactttttaatctaacaaacatatcagaactgacactcagttcaaatgaagaaagtaggaattgggcgtgccgtgttattttttcaaagattctcctattgctccaaattgttggggattatcttaaagtctttgaatagcttcagttatggaagat

SEQ ID NO: 177425 - DNA, 601 bp, Human
attaagcctcttgcaatagtcattagttcagagaatatttaagaatattaaaggtgctttgctaatgtcctcgttagttttgttttgacaaaatcagtacttcagtttcttgtttcttttttttttgagacggagtcttactctcgctctgtcgcccagactggagactggagtgcagtggcacgatcttggctcactgcaacgtccacctcccaggttcaagcgattctcctgcctcagcctcccgagtagctggggttacaggcacacactatgcctggctaattttttttttttttttgagacggagtctcgctctgtcacccaggctggagtgcagtggcgcaatgtcggctcactgcaagctctgcctcctgggttcacgccattctcctgcctcagcctcccgagtagctgggactacaggcgcccgccaccacacccagctaatttttttgtatttttagtagagacggggtttcaccatgctggccaggctggtctcgaactcttgacctcaggtaaaccacccacctcagcctcccaaagttctgggattacaggcgtgagccaccatgcccagcccagtacttcagtttct

SEQ ID NO: 177426 - DNA, 601 bp, Human
aaaggtgctttgctaatgtcctcgttagttttgttttgacaaaatcagtacttcagtttcttgtttcttttttttttgagacggagtcttactctcgctctgtcgcccagactggagactggagtgcagtggcacgatcttggctcactgcaacgtccacctcccaggttcaagcgattctcctgcctcagcctcccgagtagctggggttacaggcacacactatgcctggctaattttttttttttttttgagacggagtctcgctctgtcacccaggctggagtgcagtggcgcaatstcggctcactgcaagctctgcctcctgggttcacgccattctcctgcctcagcctcccgagtagctgggactacaggcgcccgccaccacacccagctaatttttttgtatttttagtagagacggggtttcaccatgctggccaggctggtctcgaactcttgacctcaggtaaaccacccacctcagcctcccaaagttctgggattacaggcgtgagccaccatgcccagcccagtacttcagtttcttagcgatgaaatccacccaatgtcaggcgatgactattattattttact

SEQ ID NO: 177427 - DNA, 601 bp, Human
agacggggtttcaccatgctggccaggctggtctcgaactcttgacctcaggtaaaccacccacctcagcctcccaaagttctgggattacaggcgtgagccaccatgcccagcccagtacttcagtttcttagcgatgaaatccacccaatgtcaggcgatgactattattattttactgatttatactgtttgttctctattaatgtcttattttccccaaccgattttgaagttgagtaaggactatgttccgcgggtatcttgagtcctctgaggcactgagcttggtgatttggaygcaggagctgctcattagtgagctgatagctgggagcatagcgcatcccacatcacctgacttaccttggtgtcctcctttgtagccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgct

SEQ ID NO: 177428 - DNA, 601 bp, Human
agtttcttagcgatgaaatccacccaatgtcaggcgatgactattattattttactgatttatactgtttgttctctattaatgtcttattttccccaaccgattttgaagttgagtaaggactatgttccgcgggtatcttgagtcctctgaggcactgagcttggtgatttggacgcaggagctgctcattagtgagctgatagctgggagcatagcgcatcccacatcacctgacttaccttggtgtcctcctttgtagccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccg

SEQ ID NO: 177429 - DNA, 601 bp, Human
cccagtcactgctgagaattcagtgggaattataacaatattgtataatattatagtatatattgttattatctataaatacatatttaatattatgtaaatgtatgacattttaatcataatattagccaggtgtgggggtgcacacctttagtcccagctacttactcagtagactgaggcaaaaggatctcttgagcccaggagttcaggttgcaatgagttatgaatgcaccactgcactctagcctgggcaacagaacaagacctatttctttaaaaaaaaattatatattttgcmcaaatatatatatagagaaaaagaggtcggacatgggcctgtaatcccagccctttgggaggctgaggtgggtggatcacttgagcccaggaggttgagaccagcctgggcaacatggcaagaccccgtctctacaaaaaaaaaaatagaaaaaattagtcaagtatggtggcatgtacctgtagtcccagctacttgagaggctgaggtgggaggatcacttaagcccaggagacaaaggttgcagtgagccaaggtcacgccaccacactccagcctgggcgacgaagaatgaccctg

SEQ ID NO: 177430 - DNA, 601 bp, Human
gcaagaccccgtctctacaaaaaaaaaaatagaaaaaattagtcaagtatggtggcatgtacctgtagtcccagctacttgagaggctgaggtgggaggatcacttaagcccaggagacaaaggttgcagtgagccaaggtcacgccaccacactccagcctgggcgacgaagaatgaccctgtctcaaaaaaaaaaaaaaaaaaaattatacacacacacacacacacacatttcgtttatattatatctaatattataaacagatataatttatatattatgatattcctgtatatatyatataatgatgttgtattcatattatagacaatattgtatgaagtgctatacagatgtcagtatagttgctgtcacagttggttatgttgatgaaaagtatatttcctaatgcaaaatataatatcagtcagcagccaagtggcagtgactgcaaggtttgctttgcccgaggaagcagatcccagggaaggccgatctggtcctctctgtggaagctggctctgcagcctccacatttttggctcggtgtcacgttcctttaaatagccccatctcaggtctaggaaggtcatccacct

SEQ ID NO: 177431 - DNA, 601 bp, Human
ggaaggccgatctggtcctctctgtggaagctggctctgcagcctccacatttttggctcggtgtcacgttcctttaaatagccccatctcaggtctaggaaggtcatccacctactgcaaactcggctgaccttacccagggttggtggagacagatggggtctcccacactgcctgcagccatactgcgcctgggggattgactcactgtcagcatggagctgactcagccctaccagccgtgcccgttactgtgtggctgggcacaagtcagatgaaggaagtccttgcgctctggcrtaaagtgtacaaagacaaagcagttatgcataatttgtcctttagtatggtcaggatgtagcattgtgggtaaaatgcagttgcagaactatttatatgtagcatgatcacagttttataaaggaaattataatcctatatcaatcctatgtatatagaaaaatgtccagtgagatatatgttaaacctattatggtgggattaaaattatgaggggggatttctatttttcaaaagattcctccttttttttttttttgagacagagtctccgtctgtcaccctggctggagtgcagtg

SEQ ID NO: 177432 - DNA, 601 bp, Human
gttaagaatcatagtaatgactgggtctgtaagggagcaccgcctgctgaacatggctcagggcagtattttctggaccaagaatcaggtctcatgctttgagactgtcccaggatgtctagtgccagctaccccaggcaggtcatctggtgtgaatgttgactcttcctgcaccaagtctcagacctgccccaccctcctccccactctgggtctcctgatcttggctcactgcaatctccgtctcccaggttcaagcgattctcccacctcagcctcccgagtatctgggattacaggmgtgagccaccgtgcctggcctacaaaacctagttctaacacaatcactccttaaatatggtggaacacttgaagcttgatatctagtttggattcaaaagcttcatttcccatattatgcaaaactggtggttgtgatctccagaatgtactgttcctcctactagctctaatttttctccctgacaggtggtcatcaggtaaatcacaagtgaaaaggccgcaccataaggtgtacttagggcactattgccgcctagtagtatgaatatttaggaaagagtactggtcctgtctgtcc

SEQ ID NO: 177433 - DNA, 601 bp, Human
ctcatgctttgagactgtcccaggatgtctagtgccagctaccccaggcaggtcatctggtgtgaatgttgactcttcctgcaccaagtctcagacctgccccaccctcctccccactctgggtctcctgatcttggctcactgcaatctccgtctcccaggttcaagcgattctcccacctcagcctcccgagtatctgggattacaggcgtgagccaccgtgcctggcctacaaaacctagttctaacacaatcactccttaaatatggtggaacacttgaagcttgatatctagtttsgattcaaaagcttcatttcccatattatgcaaaactggtggttgtgatctccagaatgtactgttcctcctactagctctaatttttctccctgacaggtggtcatcaggtaaatcacaagtgaaaaggccgcaccataaggtgtacttagggcactattgccgcctagtagtatgaatatttaggaaagagtactggtcctgtctgtccctacttcacctattgactttggaaaaacctatgtctatcttccagtcaagttgacaatatctaaaggcagctcagtttttttctaagaaa

SEQ ID NO: 177434 - DNA, 601 bp, Human
agcagatatagaacatttccatcatcacagaaagttctactggacagtgctgttttaaatggttatagaaaagaggatactttacagaaaaatgatttccaggtcattattaactgaacccctgcaagcaagccttttaggggcttactacagtgtttatcacaatggtttccccctacagtactttccactatgatgatcatgacatggtaaggcagttctgctcagactctaatgaggaattattctagaaatattaaaaagacctgatgataatgctatttctaactccactcccaamttccccaacccaaccagttcaacaaatacccctcctcccactgcccaagaagcaatatacaaaacattggcacccagtgttttcttttcctaaaaaaggactgcttaagttggtaaaggtagtcaaggcatctctctttggggcaaacagaaagcactttacagagtgtaagaaaataagaggtcggtgtgcctctgttgcctcatcttcaatgtatactcacaacatatgagcaaatcaaatggacaggtggcaaaccactgggttatttctcacttaagggcctgggagtgggagaaa

SEQ ID NO: 177435 - DNA, 601 bp, Human
cttccaaatagacatagttaacaagtgcagcatttagaaaaaaatgtatgaagagattcgatgcagataaaatattttacctacattggaagaatgcagcagcacaaatggaaatcatagctaataattctcaccaaaacaaaacacctgggggtttcaaaaacattctaaataagattctaaataggatcagagcctaaaacccccaataatttctgctcagttaacactgacttctcaccaaaaggatgaaaagaaagatccttaagaggggcaatatctagactccccggtaccataytaccaccatgaagctatggctttttacacagatgacaaagacattaaaaaatatatatatacattgttctagaattttattttattggaatgcttacattaatatataatttttgcatattcaaatataaatatgtagcaacttaagtttcaaaaactcttgacaaatcaaaagactaagttgtggcaaatatgcagaagttcaccaaaatattgttaattctgcctcttacttttcaaaactgcatagttccccattcccattgcaactccctgggttcaggccatcatcttatacctg

SEQ ID NO: 177436 - DNA, 601 bp, Human
agactggagttggagtacagtggcacaatcttggctcacagcaacctccacctcctgggttcaagagattcttgtgcctcaccctcccgagtagctgggactacaggcacatgccaccatgcccagctaacttttatatttttagtagagatagggtttcaccatgttggccagaatggtctttaactcctggcctcaagtgatctgcctgccttggcctcccaaagtgttgggattacaggcttgagccactgcgcccagccttaattatgactttctattttacttttgtatagctgtyaccagttgttttaggaataagttgagtttcagtattaatgggtatctaagccttcaactacttccaaatagacatagttaacaagtgcagcatttagaaaaaaatgtatgaagagattcgatgcagataaaatattttacctacattggaagaatgcagcagcacaaatggaaatcatagctaataattctcaccaaaacaaaacacctgggggtttcaaaaacattctaaataagattctaaataggatcagagcctaaaacccccaataatttctgctcagttaacactgacttctca

SEQ ID NO: 177437 - DNA, 601 bp, Human
aatctaataaacatatacaatggtctatgaataaaaagtactaaatcattaaaatcagtaccaatcacccagaattactaagaaatgtttttttaaaaaatggcatccttggaagctttcaaacataactgtaatctatttacccatataaggtaaatatttcaactatgccttttttttttttttggcgacaaagtcttgttctgttgcccagactggagttggagtacagtggcacaatcttggctcacagcaacctccacctcctgggttcaagagattcttgtgcctcaccctcccragtagctgggactacaggcacatgccaccatgcccagctaacttttatatttttagtagagatagggtttcaccatgttggccagaatggtctttaactcctggcctcaagtgatctgcctgccttggcctcccaaagtgttgggattacaggcttgagccactgcgcccagccttaattatgactttctattttacttttgtatagctgttaccagttgttttaggaataagttgagtttcagtattaatgggtatctaagccttcaactacttccaaatagacatagttaacaagtgc

SEQ ID NO: 177438 - DNA, 601 bp, Human
tttcttctttttatattcacgctgctgggcaatcatttcttttctgcatgaaaaaaagttaaatgtcaactgttaagacttatcatacaagaatgacttccttgaagacaccggcagtgcaaaaaaaaaatctaataaacatatacaatggtctatgaataaaaagtactaaatcattaaaatcagtaccaatcacccagaattactaagaaatgtttttttaaaaaatggcatccttggaagctttcaaacataactgtaatctatttacccatataaggtaaatatttcaactatgccttttttttttttttggcgacaaagtcttgttctgttgcccagactggagttggagtacagtggcacaatcttggctcacagcaacctccacctcctgggttcaagagattcttgtgcctcaccctcccgagtagctgggactacaggcacatgccaccatgcccagctaacttttatatttttagtagagatagggtttcaccatgttggccagaatggtctttaactcctggcctcaagtgatctgcctgccttggcctcccaaagtgttgggattacaggcttgagccactgcgcccag

SEQ ID NO: 177439 - DNA, 601 bp, Human
ccaacaggtagcaagctgggaacgcttagaagagggaactggagggaaggagcacatttctcctgtaatcccaagtctgaaggagcagcacttgatgggttcctttaccactaccctggggatttggcccttttaaaataatgaagtctagaaatcataacctggttttgcatggaaggaaaggaatataatctggaaagacaaccaaagaagttcttgctgggattattaagatggctatgccaagttgagagacttggcagcatgtgtccatgcatgcagccacctgctaaaagtaatygtgggctggctttcaatattctggccaagttttggacagtccaagaagattaaaaaaaaaatcagaaataggtctggcagggtataaagcagaatcaagggtttgttaaaggaataaaaatatttaggtagaattggtagtgagcggatgtggttatttgtttaaggagaaaagggaagaccatgctgtgaaagttttgcctctttaaatgatgagatcggattggttggtgggctcttaaagcaaaaaggaaaaaaaaatctgtttatctttcaagcagaatagatctttaaaaatata

SEQ ID NO: 177440 - DNA, 601 bp, Human
aaaatgttactttaggcagggtgcagtggctcacgcctgtaattccagcactttgggaggctgaggtaggtggattgcctgaggtcaggagttcgagaccagcctggccaacatgatgaaaccctgtctctactaaaaatacagaaattagccaggtgtggtagtgtgtgcctgtaatctctgctacttgggaggctgagacaggataattgctggaacttgggaggcggaggttgcagtgagctgagattgcatcactgcattccagcctgggcaacagagtgataatccaccccccccmcctcaaaaaagtaactttataaatttatgctgaaagtagttaactcctaatattataaattcctattcccctttcccccattccttaaaatcttattttcaaagaagtaaaaaggagagaaaataaatgatataatgtgatattacaaatatgttccttgcaaataccagtaattttatcatttgggatccttctgatagttggaagtggcacctataatatataattaaaataaatgcttgattttactgtggtcttggtcacagccttctggcacacttccaaaaatcaacattgcta

SEQ ID NO: 177441 - DNA, 601 bp, Human
gattaaaaaccctgcgaggcgggcagggattgagtctcttctgcttaaacatttatccctagtacttatcacagtgccccgtaaatagtatgtgtttcttaaagaatggaaggttttcaaactccaagcagactgtcttaaattgaatttcttttttgtgctgagtaccatattagactggaaggaagagtgataaaacccctgttttggcaaactctgattactttgtgttccaagggatgttaatgatacatttggaaaaacagcatgtagtatttaaagaataaaaatctctaaactstcaattcttttaaacaagcaggctacagaatgctacacttaattttgaagaacattcagtgtcatcctgtgtcatgaaaataaaataataccaaacttgcatattgaaagaaacagaagtctttcagatattggcaataaatattcatatgagcctgtgacacacacatagtaattgcattgttttaaggtaatctgggaagtagtaaatagccaatttatgctttaatttcaagttgatatatttcttctctttagtgtcctatggatactaaagaatctcataaaagcagtatctcag

SEQ ID NO: 177442 - DNA, 601 bp, Human
gggaagtagtaaatagccaatttatgctttaatttcaagttgatatatttcttctctttagtgtcctatggatactaaagaatctcataaaagcagtatctcagttccactttctaagattgaggacactaaaaaacaacttttctgttgtttataaggctttagtttaatttttcttaaactgtagaataaagaaatgctttagtcttattttagatagaattattgtattgttattttttagctttgcatccttttcagctatcttcatggatttttagtttttctggggagagggatggtggtgaattattttcctaggatagtttcaaaggattttttccagtagtaatttgagatgctttatcttctctttattctacgtgaacctatttgttcacagaagaattgaatgaagccttatttttatttttgtgtaatttttttctactattctgtgtttttcaaatttttttatattaaaaagtagtttctgggtctttgttccgtagaaaactcccaaagtttcaggacaaaaatgtagattagtagcagttaaactcttaatgatgttgttattattcttaagtattttctgcat

SEQ ID NO: 177443 - DNA, 601 bp, Human
tattattcttaagtattttctgcattttgagtgattaacacatccagtgaaatgtgttttgtgatagtctgtcttctaccaaaattgacttaaatgaaaaattcccaagaattacttatatgccttatactaaaaaaactgaggctttcctttaaatgcttctttgaagtgtaagtttgctattgctgggtttcttaaggttatattcctctatggaagtattgaaggaaacttgtatgatcatgccttgtaagtcagtaggacagctgtttctgttcctagtcgatgaaaggcatttttstcaaaatattgaatatatgatgtagaagatcacaaaatgtagaaagggaattctttagtacaattctctgatttatgaagacaaaatattatcactcattttatgattaaagcacatgtggcttagagatggtgattgcttaagccttacagctgtagatgatggttgactttattgtcaagctggattttaagcaatatatgcatcattgttataatcaggcagtactgttgactggaagaaagctttctcttctagatttctccttgcaaatgaaagaacattgcctgcttttgaata

SEQ ID NO: 177444 - DNA, 601 bp, Human
aaaaataagcttggccgggcacagtggcttacacctgtaatctcagcactttgggaggctgaggccagcagatcatgaggtcaggagatcgagaccatcctggctaacatggggaaaccctgtctctactaaaaatacaaaaaaattagccaggcatggtggcgggtgcctgtagtcccagctactcgggaggctgaggcaggagaatggtgtgaacccaagaggcagagcttgcagtgagccaagattgcaccactgcactccagcctgggtgacagagcaagactctgtctcaaaaaawaaataaataaataaataaataaataagctctattggccgggtgtggtggcttatgcctgtgttcccaacactttgggaggccgaggcaggcggatcatgaggtcaggagttctagaccagcctgaccaaaatggtgaagcccgtctctactaaaacacaaaaattagccaggcatggtggcacacgccagtaatcccagctacttgggaggctgaagcaggagaatcacttgaacccggatagtggagtctacagtgagttgagatcatgctactgcactccagcctgggcaacagagtg

SEQ ID NO: 177445 - DNA, 601 bp, Human
ataagcttggccgggcacagtggcttacacctgtaatctcagcactttgggaggctgaggccagcagatcatgaggtcaggagatcgagaccatcctggctaacatggggaaaccctgtctctactaaaaatacaaaaaaattagccaggcatggtggcgggtgcctgtagtcccagctactcgggaggctgaggcaggagaatggtgtgaacccaagaggcagagcttgcagtgagccaagattgcaccactgcactccagcctgggtgacagagcaagactctgtctcaaaaaataaawaaataaataaataaataaataagctctattggccgggtgtggtggcttatgcctgtgttcccaacactttgggaggccgaggcaggcggatcatgaggtcaggagttctagaccagcctgaccaaaatggtgaagcccgtctctactaaaacacaaaaattagccaggcatggtggcacacgccagtaatcccagctacttgggaggctgaagcaggagaatcacttgaacccggatagtggagtctacagtgagttgagatcatgctactgcactccagcctgggcaacagagtgagac

SEQ ID NO: 177446 - DNA, 601 bp, Human
gaaaccctgtctctactaaaaatacaaaaaaattagccaggcatggtggcgggtgcctgtagtcccagctactcgggaggctgaggcaggagaatggtgtgaacccaagaggcagagcttgcagtgagccaagattgcaccactgcactccagcctgggtgacagagcaagactctgtctcaaaaaataaataaataaataaataaataaataagctctattggccgggtgtggtggcttatgcctgtgttcccaacactttgggaggccgaggcaggcggatcatgaggtcaggagttckagaccagcctgaccaaaatggtgaagcccgtctctactaaaacacaaaaattagccaggcatggtggcacacgccagtaatcccagctacttgggaggctgaagcaggagaatcacttgaacccggatagtggagtctacagtgagttgagatcatgctactgcactccagcctgggcaacagagtgagactccatctcaaaaaaaatttttttctctattttcttctagcagtttataatattaggttttacatttagatttaaaattcatttagagttaatttttgtagagggtgtga

SEQ ID NO: 177447 - DNA, 601 bp, Human
agtggtactactcttgagccaaactgtaccatttcgtatagtttcatttctatggttcatttctttgactgccaccaaactacaccctaaataatcacaagtttatgtattggagctatgttgtagtcaatgaaaagtcacatatctggttaaggtagtcacatttcatagataatgactcccattcaaatagggaatacattaggatgcctctcttaaagggatgctgtttgcgaaaaagattacctgtgattcaatgataaaatgatagaaatgtctttgtcattggaagttgttaagygttcagggtaagggtgtttgaaaggaagacacaattcattagtgtttgctctcagaggtgcattttattgggagaagaaaagtgggctaactagatgggttattcagaacatctcagccttacacagggaatttatcataattgaatatttcaatggaacattattggaagggcttggttggacacatacctcagagaagcaaaggggttgtttctgaatgtgctagtgtgtgatacatttaattacttgtttatcgcctgtactgtttggattactttctctgtgtacgtataattagg

SEQ ID NO: 177448 - DNA, 601 bp, Human
cctcagagaagcaaaggggttgtttctgaatgtgctagtgtgtgatacatttaattacttgtttatcgcctgtactgtttggattactttctctgtgtacgtataattaggcatctctctctgtaatatactcctaaaccttgtactgtcctcacagctgactaaatgataaagtagcttcagtcacctatcttttctttcagtttctctttccatcattatggttgttgtttgcttatttccaggctaattcaaagtgttattgagaacctatcaatttgttgtcccatgtagtatagtkaataacgttttgggtaacataattttagtcttttaaaaaagtaataaaaatactaacagtagctagcatctattaaatacttattaggagctagatgtttttacatctgtttctctaattctcacagtaacctggccaaggcatgtgtaatactccagttttacagatgaggaaactgtaaaccagcgaggttaaataatttgtctcaaagttacacagcctgtgtgagtgacagagttaatatttagattcatgactttctttctctaacaccatgggtctttatgatctttttgtgtt

SEQ ID NO: 177449 - DNA, 601 bp, Human
tgattaaagttttagttctagtgacaggaatttaaattctccttcataaaattcctgttgttgttaatgttaagttattgcaaaagtaacacatgttaattctagggaactagtataacaattctaatagtagctaactttagagttcattatattttgctatttagcataaacctgttagtccttataacaatcatatgaggcaaatactgttatttttcctatttcatagatgaggaaaccgagcacagagaaatgaagggactttactgaggccatacagtatttggactcaggcagwttggccttagagtctgtgcccttaacctctgttcagtattgcttctcactgagtggttaagatttggggattgttaagatagacctggattgaaatcatggctgccactttatactcttgggagaggagtatatttcttgacttctctgagcttcagtattcttgattataaaacaaaggttgttttagggataaaataagatatattaactgcttatcccactgttccccagatgctgtgcttgttcaatagaaggtatcatttaaaacaaataatgagaaacaaaaggaaaaaagtca

SEQ ID NO: 177450 - DNA, 601 bp, Human
gctatttagcataaacctgttagtccttataacaatcatatgaggcaaatactgttatttttcctatttcatagatgaggaaaccgagcacagagaaatgaagggactttactgaggccatacagtatttggactcaggcagtttggccttagagtctgtgcccttaacctctgttcagtattgcttctcactgagtggttaagatttggggattgttaagatagacctggattgaaatcatggctgccactttatactcttgggagaggagtatatttcttgacttctctgagcttcagkattcttgattataaaacaaaggttgttttagggataaaataagatatattaactgcttatcccactgttccccagatgctgtgcttgttcaatagaaggtatcatttaaaacaaataatgagaaacaaaaggaaaaaagtcaccaaaactaaacaataaccattgctaacatttcgagttatccagtcttgtaaaacacgtttcttgattttattaatatattttttctttatattaattttctttcatgtataactttttcttgtttttgtttcacaaaataaggtgggaagacttgga

SEQ ID NO: 177451 - DNA, 601 bp, Human
tttacctgtgaaaataatgtaatagtgcatatgtagttgtaattttatttttcagatgtatagcccattgtgaatctgatatatatgtattttctccaaaaaatgatttaatagtaagcttatagcagctagaagacataaatacatttttaaagcttactcgaatttgagttttaggtatagcctttatttctgtctctgaaaatgagttaattgttacaagctcatggtttaaatgtagttttgctaaagggtaggatttctaaagagtaggtaataagcattacaaattggagggcaytgaatttttcttcctttgtaatttgttcattcattcattcatttattcatgcattcaacaactatttatcaaacatgagctgtatgtcagtgccaggcaggcagaatgctttatataggaaatacaagaatatatatgatagtttttgtccttaaggaattcagaactttgtaagggaaagacaggtaattaaagtactatataatgtggtaagtatggtaatggagaagcagaaggtactagagggtactgaaagatattttagaaggtcacctgatacctttttgaagggagtcttgg

SEQ ID NO: 177452 - DNA, 601 bp, Human
taataacaaactgaaatcatatgtaccagctgtttttgacaaataagatctcatgaccttcaactttttgtcctccctttaacaaaaaatatattggctagcccaactgcctcattgcaagtaagtttaaatgtcaaatccccttgaaaaggcttagcatagtttttcaggcagactcagtggcttttactactttgcacagtgctgtgttcttgtctcttattgtaaggctgaataggtagcattgtaattatttctgccaaatgactatgccccaaatgcaaagatactgttttgttcmattttgtatcctcagtgcctagcatttgaggcatgtataggagacaatggctctagtattgagtgaaggataaaactggaactcaaagttgagtggtctagtcaaagacattttggtagttagtggtagaaactccttcgttttaaagaatcttttctgccttttatttctgatttattaaagatctggatggataaaggaaggacatatctggctattttaaacataacaaaaaagactaagaaatgaaacttctgaggatcctaaaaataaaaccttaaattgaagtttactctaaat

SEQ ID NO: 177453 - DNA, 601 bp, Human
ggtcttgggagctgatatctgcccaaatccttgttggttatactgagtatgctctagatggttcagagcatttgttacctatgtaccaaccctgtccccctaggcccacaacaggtcataataggcctaggagatggaggggaagcaaaatacttcagttgttctgcattcctcaggaacctatgtgaatcatctcatggtaaacttaatgagactttgagattgaagaattaagatattactttgcccattggcttatcttacagtttgggtcctttgccagataagacacaattcagtrtcagtacagattttagattgcctcattgttttttcattttcttaattcaaattgctgatgatgttttagaaagaatcaacaactttggccaggcatggtggctcatgcctgtaatcccaacacttttgggaggctgaggcaggtggattgcttgaggccaggagtttgagactagcagggccaacatggtgaaaccccatctctactaaaaatacaaaaattagccaggcatggtggtgcatccttgtaatcccaacttcttgggaggctgaggcacaagaattgcttgaacctgggagg

SEQ ID NO: 177454 - DNA, 601 bp, Human
gcacagatggctcaacactttgcaattacttaagacatgtaattaaccacaggtaagttttcaatatattatgtggtgccagtatgtaatgtggtatgagtatttaataatggagaaagattagtctctatttagcatatgaaaagaatatacctttctttcagctggaattaccgtcttccagtaatttaccaaaataacaaacataaagggaaagaggaaagactcctgatatacgttctctgggtttcttagaaaacatggaattgttcctttggccacagacatgcgattctacaaraaagatgatattgtagatatcaaaggaatgggtactgttcaaaaagaaatgtccacaaatgttaccatggcaaaattggaagactgcgagcatgctattagcattgttgtacacaaacaagttaagggcaagttttttttttggttttttttttttttgagacggagtctcgctttgttgccctggctggagtgcaatggcgcgatcttggctcactgcaacctttgtctcccgggttcaagtgattctcctacttcaacctcccaagtagctgggattacaggcacccaccaccacacc

SEQ ID NO: 177455 - DNA, 601 bp, Human
taaaaatagttgtcagagggcagagataggcacctgttagagttagaattgaatgctatatgagataaagatgaagtaatgtgcaggttttagagataaaatagaggaaatgtagccaggataaaattacacatctaaaatgcagtctgtacaatgaagtcattgcagttgtgtctagatagattcacagtttctatactgacctttgttagaaatagttcattaagactaagctttcttctccctgacctaggttacatatacagcaaggtgacagaggctcattcggagacaaagactcaattgtaggaaccaagtgtttttagtacttcagctagccagttattaaagtttaaagcaattctacaactgatgtgtgggaagaaatgagattatgagatcttaaaaaataatcagaagtactgtaacttgaaattcagcttctaaaattttgtatagaaataaacaaataagtcagacattgaataattgacatggtatattatagcgaagttgtggtagctttttatgcaagtgattgcagagtgcctaacttaagctgtaacttgtttaagaaaacaattcttctcaaactatgaat

SEQ ID NO: 177456 - DNA, 601 bp, Human
tacaggcacccgccaccacacccagctaatgtttatatttttcatagagacggggtttcaccatgttggccaggctggtctcaaactcctgacctcgtgatccgcctgcctcagcctcccaaagtgctgggatgagccaccacgcccgtcctagtaattgatttttaaatattcttgagatcataaaattttaaacttcatccagatgaagatttcttatgtagattaatttactcaggcaaattcctgttaactttatcatattatttttctagattttaactggctttataatttgccwtaataaaattccattcatttaaaattgtagtcaacaatgttttagtttagtattagttgaatggaatataaaaaaattgatttttaaacattagcttgaggctagtgctggttagtgctttatgttaaaaattttttttttttcaaatggtggtcctcgatggagaaatgttttctagaaatggtatacagaactgtattctacttctatttaggattttttagttcggatatgaaaaagctggagctcaaatatatgtttgagtttggcaccttcaatttgcaaaatggacacatcttt

SEQ ID NO: 177457 - DNA, 601 bp, Human
tgcttagacatgagtggttattcctctgcatggttctctcttggagtttgccgtaattggtttttatcatgttttcagtatgtttaaaagggctttcaggagaaacactacatctgagtctcttttgctcttttaatcattatagttgtcacttactctggggtgaaagtgaacttgcagcttttcagcatggataagatagatataggcctgagagtacatttggagaatgtgatacaaccttcttactaatttatggtcgcttttctggtatgtctctgatgacagctaaaatacagartctttttcttttctttctttttttttttgagacagagtctcgctcagttgcccaggctggaatgcagtggcatgatctgggctcactgcaacctctgcctcccaggttcaagcagttctcctgcttcagcctcctgagtagctgggattaagggcatgtgccaccatgcccagctaatttttttgtatttttagtagagacggggtttcaccatgctggccaggctagtctcgaactcctgacctcgtgatccgcccacctcggcctcccaaagtgctgggattacaggtgtgagccacc

SEQ ID NO: 177458 - DNA, 601 bp, Human
atgtttaaaagggctttcaggagaaacactacatctgagtctcttttgctcttttaatcattatagttgtcacttactctggggtgaaagtgaacttgcagcttttcagcatggataagatagatataggcctgagagtacatttggagaatgtgatacaaccttcttactaatttatggtcgcttttctggtatgtctctgatgacagctaaaatacagagtctttttcttttctttctttttttttttgagacagagtctcgctcagttgcccaggctggaatgcagtggcatgatctkggctcactgcaacctctgcctcccaggttcaagcagttctcctgcttcagcctcctgagtagctgggattaagggcatgtgccaccatgcccagctaatttttttgtatttttagtagagacggggtttcaccatgctggccaggctagtctcgaactcctgacctcgtgatccgcccacctcggcctcccaaagtgctgggattacaggtgtgagccaccgtgcctggcctaatacagtgtcatttttaatggctgtgttttctatgaaggagtgtctacaatggttctccctcttttt

SEQ ID NO: 177459 - DNA, 601 bp, Human
atgttgggtcttattttccaaaatgtcaaagtgtccttcatatgccttttgttctgtgagataacagttgttggtgatcctgaaagatgttttagaactttcatcctgcagtatctgaaaggaaatgtagccaagattggaaaatttaacctccatactctactggcttctttagttggagtagtggtcaatatgttcttgctgttggaatatacttaggcgagagagccacacaacctgcctgatgaacaactaaaatattgactggcaatggtaacaaaataaaacatgttcccctccrcctgtctcttccttcttttctcaaatccctggaactgtatagatttttcagggctgttctcctgagctattgatgaaatgaaaataatagcacttgtgtagcagtccttagaaaactgtaatggtattgagctgaggctggaatcatataaaataaatactagagctttgattcctctctcatttaatcttttcctgggcttttctagaggagagtcaaactaagatttagacaaatataaatagaagcaagtcacacagtgtaatgttgcaacccagatataacttgaacccagtcttt

SEQ ID NO: 177460 - DNA, 601 bp, Human
gcatgttcactttctatctacctaaaagtgctaatctgtaagtgccctactatatataacactgagaaaatttctgccttatcagaggagggcatgcccaggattggtgccaggtgttgtgttatgctaggctgcctccaaaagttactctcaaaaactactcttcagttgggccctttgtggtcaggaaaaaaaaaaagtgatacagtataatgaaagagaggtcaaaacagttaagtaatttagaaataaaaagacataccaaaacattgattctctattattatcagggactatggcrtattttaaattctgtaaattttatttttccagaggttgcaaatggcctgtaaatgcttcagttattaacaacaacaacaacacatacacacatacacactggccaacaattcctctttgttaccctttttctaccgcaaattttatctcctcctcaccaaaaaacaaactgcattttgattttgggaaaattgttctaaaatgggactttaaaaataattcctggctggcttgactggattggcagatgtccagcaatgccaaaccatttgccatctgccagtagtaagcatggttacca

SEQ ID NO: 177461 - DNA, 601 bp, Human
tattaaaaaaggtgttggccggttgcggtggctcatgcctataatcctagcactttgggaggccgaggcgggcagattgcctgagctcaggagtccgaaaccaccctgggcaatatggtgaaaccccgtctctagtaaaataaaataaaaaaaaattaggcttggtggcacatgcctgtaatcccagctactcaggaggctgaggcaggataattgcttgagcctgggaggcggaggttgcagtgagccgagatcgcgccactgcactccagcttgggcaacagagtgaaactacgtctcaaaaaaaaaaaaaagtgttgactctcatcaagagttaggttggagactgttggttactctacatgtagacatctttggtggtatgcaccttattaacatttgctggtgatttcagctgcaccagaaaaaaaaaaggttaagagttctggcattcataaatagatctctcacaaatgctggcctggcatctgattatactgtttggaggtcctggtgttgattgttacctcaactttggtgagttagagagtcccagaaacatccactagaagtattacatctctcctccccactgtgtgcc

SEQ ID NO: 177462 - DNA, 601 bp, Human
gctcatgcctataatcctagcactttgggaggccgaggcgggcagattgcctgagctcaggagtccgaaaccaccctgggcaatatggtgaaaccccgtctctagtaaaataaaataaaaaaaaattaggcttggtggcacatgcctgtaatcccagctactcaggaggctgaggcaggataattgcttgagcctgggaggcggaggttgcagtgagccgagatcgcgccactgcactccagcttgggcaacagagtgaaactacgtctcaaaaaaaaaaaaaagtgttgactctcatcargagttaggttggagactgttggttactctacatgtagacatctttggtggtatgcaccttattaacatttgctggtgatttcagctgcaccagaaaaaaaaaaggttaagagttctggcattcataaatagatctctcacaaatgctggcctggcatctgattatactgtttggaggtcctggtgttgattgttacctcaactttggtgagttagagagtcccagaaacatccactagaagtattacatctctcctccccactgtgtgccagtcattctgtttatttgaaaaacagaaat

SEQ ID NO: 177463 - DNA, 601 bp, Human
tttgaacatagattcctggaggccctgggatgtagtacaggttgagcatcccaagtccacaaatctgaaatgctccaaaatctgaaacattttgagtgtcaacatgactctcaacagaaatgctcattggagcatatcagacttaggatttttggatttgggatgctcagctgagtataatgcaaatattccaaaatctgaaaaaatgagaaatccaaaacatttctggtcctaagcatttcacataaggaatactcaacctgtctgaaataatatgaaatttgaagtcttcttttaaaamcacattttgcattatctgtgtttgtttttatataaaatatttttcttccaaatttttgaaaaaattatgacttctggaaaggatagtataaccctgtggcttcaaatatcctctggctcagtgttgaatacctctagaggtatatatagcctatgctaagaactatttatattttattgaaagaaagtggttttaaaaagtctcccaagaataagtaacatgcatctcaaccattttaattcttatttgtatacagataagccctttcatgctgaggctgacaatgtgacagaataattt

SEQ ID NO: 177464 - DNA, 601 bp, Human
ctttgggaactcttcattgtgtaaccccatccctctcagcaaggggactccagttttctcacagggcacttcctgctgcagtacctaattctaactttgttttactataactcatgctaaaataggaaaggtttcagctttacagtttttattagctgttcatgtgtttttaaaaagtatgtgttaaataaaaataaagtaaatgtccaccaaggagctaaatttttaaaaatcagtttccattaagtctagttctataaatgtttcagtaccaggttttttctacttgctgtttgtctartgttcatcataatattcagaagagcagccttaactttccccaaccttctttcccttcttttactagaggtgcaggaccatgcctttcatgaatcgttattctctatgtcagctcttctctcccttggagacttgaaaaacatcatcatatgatacttgcagtttttttcctcagtgaataaggattttttttttttttttttttttggtggagtctcacactgtcacccaggctggagtgcactggcgcgatctctgctcactgcaacctctgcctcctgggttcaagcgattctcctgc

SEQ ID NO: 177465 - DNA, 601 bp, Human
ataattttgccatacaattgctgttctaagaatttgcaggagagaaaaaaaacttagacactgaggagaatcgatttttctgatttaactctttccagtttacagttacagggcatccattgctcttggaagggtacatttacctaagtggcagctaaggacatgtggtaactgtgtgcattatttggatgggactctccctcttggtcagctgctgttcttcaactgccattaaccatttgttattctactctccaaatgcctgtttcatttaaatacaaaaacttaaggaaatgacatktatcttccacaggtacacctctgtccacaagagcagaggaaataattcactgttcatctttcatattaataccgattttggaggactgtatttacaaaatatgaagaatggcatcactggcctttgtgagatatctcagggtatattttcttggtgtaagctgtatctcagagcagatgaataattatttgacaataaaatgttcagtagtggctaaaaaaaatatcttttagagcattctgccttccctgttcatttaggcatttttcaaactttggtctgggtacctcctgatttgtc

SEQ ID NO: 177466 - DNA, 601 bp, Human
ttgagtgtaaactcttaaagttaacattttttttttacttttccttctcaagcaagtgtctggaacagtgctgagtatgtaaaatccatgtaataaatacatggaatgattaaagagagaaaaaattttaatatgttagttattttcattctaggttttagcaagtatcacaaaacggaaaatagactcacctttcttttccttgatgtgaaagtttatggaatcattttgattttcctttctttcttttcttttctttttttttttttttcttcctgaggcagagtttcactctgtggckcaggcagaatgcagtggcgccatcttggctcactgcaacctccacctgctgggttcaagcgattgttgtgcctcagcctcccgagtagctgggattacaggcgtgcaccaccatgcgcagctaacttttatatttttagtagagatgaggttttactgggttggccaggctggtctcgaactcttggcctcagtctgcccaccttggcctcccaaagtgctgggattataggcatgagccaccatgcccagcccattttaagtttcttaaaaactaaaaaataaaagataattcttacat

SEQ ID NO: 177467 - DNA, 601 bp, Human
cctttctttcttttcttttctttttttttttttttcttcctgaggcagagtttcactctgtggctcaggcagaatgcagtggcgccatcttggctcactgcaacctccacctgctgggttcaagcgattgttgtgcctcagcctcccgagtagctgggattacaggcgtgcaccaccatgcgcagctaacttttatatttttagtagagatgaggttttactgggttggccaggctggtctcgaactcttggcctcagtctgcccaccttggcctcccaaagtgctgggattataggcatsagccaccatgcccagcccattttaagtttcttaaaaactaaaaaataaaagataattcttacatatactgaagttttggagttaatttgaaccaaattgacaaggtattcttgcggtaatgtgcttgttaactttactagttgctttgttgagttttttagaagactgaatttaaagcaggattgtctattagtgtagctgccagtctttgtttccacgctccagtcatattatatgagtgcagttgttatcatatgccataataatcttaatgaagagtttaaaggcactttttactct

SEQ ID NO: 177468 - DNA, 601 bp, Human
ctcactgcaacctccacctgctgggttcaagcgattgttgtgcctcagcctcccgagtagctgggattacaggcgtgcaccaccatgcgcagctaacttttatatttttagtagagatgaggttttactgggttggccaggctggtctcgaactcttggcctcagtctgcccaccttggcctcccaaagtgctgggattataggcatgagccaccatgcccagcccattttaagtttcttaaaaactaaaaaataaaagataattcttacatatactgaagttttggagttaatttgaacmaaattgacaaggtattcttgcggtaatgtgcttgttaactttactagttgctttgttgagttttttagaagactgaatttaaagcaggattgtctattagtgtagctgccagtctttgtttccacgctccagtcatattatatgagtgcagttgttatcatatgccataataatcttaatgaagagtttaaaggcactttttactctggtgttttgttgttgttgctgtttgtttgctttttttggtctgctgagcaagagcactgtggtcacatgagaatcctcacctaagaaattttc

SEQ ID NO: 177469 - DNA, 601 bp, Human
tccagttaaaaatgaaaattttgttaaaggttctatgcatttgggtagtacagcaggggaggaaagtgactttgaagttgttaaatatcattaaggagaatccattgatatacctttgatttagggattcctttatccacaccagttacgtcaggtttcagcctggacccaattattagacctgaggtactgaactcaataaagaaatttgaaatggaaatactgtcagacctttaactatagttaggttagtaggtgctagaagaatcttaattcattagccaaacctctgacctcactrcccttaatcatccttgcttgtcatgacataattggctgcttattgccttctcctacctctcttttcaaattgctagcctttgagaatttcacttgacattatttcttgtctattaagacagagaaagcgcatagtttggtgtgtgaattagcaaaaccattttagtcctctttcagaagagaatggagggtgtgtgttttgttcttgatgcagttaagacagttaccaaaagttcaattataggtctttaaggactaggggtaaactgtgaacgtatttgtggattttcttttcagatat

SEQ ID NO: 177470 - DNA, 601 bp, Human
tcaaatgattagattgagggtatacagttggggtaaggaatatcacagaaatgatgttgtgcccggtggctcatgcctgtaatcccagcactctgggaggccaaggcgggcagatcacaaggtcaggagatcgaggccatcctggctaacatggtaaaatcctgtctctactaaaaatacaaaaaattagacgggcgtggtggcaggcgcctgtagtcctagctactcgggaggctgaggcaggagaatggcgtgaacccgggaggcggagcttgcagtgagccgagatcatgccactgcrctccagcctgggcaacagagtgaggttccgtctcaaaaaaaaaaaaaagaaaagaaatgatgttgtgcctttctcaatccattgtgtcaggaagatacacgatgtcgaagtttttactactggtgatgtgaatttttatatgtagattttaaagtacaacaccctttatttctctttccatctatcctagaatatttatctttgacagagttaaagaacagaagtcaaccaaaaaagaatggtttgaattttactgattgttcttcccaaagcttccaccacatcaggcttcatatcaca

SEQ ID NO: 177471 - DNA, 601 bp, Human
gtgtgtagttgttgttgcacttttaatattaatcaataggttcaggtaaggtcattttaatacatttatataaatgtatagcctttaacttaacagttttagcaattattgcccttatttcattgggtgtcataaaatagtgattttctaattgtgtcattcctcttgtatttataaactgtttttctcctataaacattttctcatcaacttttcggttatcctgaaataaagttcatacagggaaggtgggataaatgcttggtcttggtttttgctttatcagttttccaaacagagytggtaacctagcagcttccagaagtaacaagttttggttttactattttttgattatatcatgaactcatgttttgctgtactgaatgtgttccaatccattgcagtcatccttttaaattcttttgaatgctcaaactgtcccagatttgctgagtaggagccttttaaatagttttttcatcctttttaacgcaacctttttaacacaaccctaggagttcttgtttttctgttttgttatttttctatgtaaaagtttatttttgtgtggcagttttcaagaaaagtctaccagagg

SEQ ID NO: 177472 - DNA, 601 bp, Human
ctagcggaaacctcttcttaggtctttaggttttagctgtccttcctgttacctcctccttgtacccaccccaactacctccaaatttcagagaggagggtgtattttcatcactatagctctcatttttttttagtgttcccagtgtaccttactttagcggtaccttaccaagtaccatccttatcctgagctggcaacctcctttttgtagtgttatgggggcttttagttaacatctgtggtacacttggctaaagcagtttctcattttactttgtttttttgggtttttaaaaawtttttttaaacatatttttaaattttattaaaatagagatgggccttgttgcccaagtggtctcaaactcctgggctcaagcaatcctcctgccttggcttcccaaagtgctgggattataggtgtgagccactgtgttggccatcattttactttattttgactgagttcagcatgctcttttggatagtgtgccttgttattatcttctagttgtaggttggatgagtgttcagtggtgctgggaaacaatggcttctgaagcaattcggatatagagccaatatatgaattcacaga

SEQ ID NO: 177473 - DNA, 601 bp, Human
atgagtgttcagtggtgctgggaaacaatggcttctgaagcaattcggatatagagccaatatatgaattcacagattatttggacagctgcctacattttaaaaacatctctagaatctctaaaacttttgaagcaacaagcccttttgaaaagtatattcctggaaatagcttcaccctgtccttttggcctcacaagaatccacttttttttttttttttgagagagagtgtctcgctctgtcgcctaggctggagtgcagtggcgtgatcttggctcactgcaacctctgcctcctragttcaagtgtttctgctgcgtcagcctcccaagtagctgggactataggcgcgtgccaccatgcccagctaatttttgtatttttagcctagacacggggtttcaccatattggtcaggctggtcttgaactcctgacctcgtgatccacctgcctcagcctcccaaagtgcttggccgcacccggctgaatccacttttttttttttttaaagcagttgtgattagtgtgaacccttaaaaagtcagtgccaaatgtgaaacatcaggctttgaatttaagtaaggtaactgaaaaat

SEQ ID NO: 177474 - DNA, 601 bp, Human
tttggacagctgcctacattttaaaaacatctctagaatctctaaaacttttgaagcaacaagcccttttgaaaagtatattcctggaaatagcttcaccctgtccttttggcctcacaagaatccacttttttttttttttttgagagagagtgtctcgctctgtcgcctaggctggagtgcagtggcgtgatcttggctcactgcaacctctgcctcctgagttcaagtgtttctgctgcgtcagcctcccaagtagctgggactataggcgcgtgccaccatgcccagctaatttttstatttttagcctagacacggggtttcaccatattggtcaggctggtcttgaactcctgacctcgtgatccacctgcctcagcctcccaaagtgcttggccgcacccggctgaatccacttttttttttttttaaagcagttgtgattagtgtgaacccttaaaaagtcagtgccaaatgtgaaacatcaggctttgaatttaagtaaggtaactgaaaaatcctgggtttcactctagctctgatgggagaaaacaactttttaactcctttttgtttttaacatgtgtattgatttatg

SEQ ID NO: 177475 - DNA, 601 bp, Human
ggtttcactctagctctgatgggagaaaacaactttttaactcctttttgtttttaacatgtgtattgatttatgtatattattgatgattgaatatctagtatttaacaattaagatttttttttttatttttaagagacagggtctcactctgtcacacaggctgaagtgcagtggtgagaccttggcacactgcagcctcaacctcctgggctcaagagtgatcctcccaccttggcctcccgagtagctgggactactggatcacccactatacccagctaatttttgtgttgttgttttttttttggtagaaatgaggtctcactttgttacccaggcttgtctcaaactcctgcactcaagtgatcttcctgccttagcctcccaaagtgctgggattacggacgtgagccactgcgtccagcaacattatctattgatagctgagtcaaatatgtatttgtggtgttttttttttttaatgtttggcttttaagtctgtatactaccaccaaaatggatctcactataatctgaagacttttaagtctcaggcccttatttcaagctatatttgatgcaagaaaattaaatcta

SEQ ID NO: 177476 - DNA, 601 bp, Human
aaaccacttgggggttgggaccttttaatattaagcactaattcccaaatacgccaagtgctttagggaggtccagacggactggcgtcaaaggatttaggaaatttgctgcctaaattaagaccaccactgtatatcagacattccccttggcaaaaaatattcctgtctcttcaccttgttcctctgttctccagacatcactgataataagcttgttgtgtaacatttcttatacctcttttcctcatgctgttagtttttgaaggtgcgctatactcgataattaatgttcttctttttttttttttcctttggcagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaa

SEQ ID NO: 177477 - DNA, 601 bp, Human
cagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattg

SEQ ID NO: 177478 - DNA, 601 bp, Human; identical to SEQ ID NO: 30011

SEQ ID NO: 177479 - DNA, 601 bp, Human; identical to SEQ ID NO: 30012

SEQ ID NO: 177480 - DNA, 601 bp, Human; identical to SEQ ID NO: 30013

SEQ ID NO: 177481 - DNA, 601 bp, Human; identical to SEQ ID NO: 30014

SEQ ID NO: 177482 - DNA, 601 bp, Human
tctgggcctcccaaagtgctaggattacaggtgtgagcccaccatatcctgccctggaggtttttttcttttctttttctttttttaggttcctctgttaactgtgatccacagctagaaccaccctctggaggaagggaggtcatcacttcccttctttcaactatttgctcagcttgggcctcaaattctcacttttcaagtgcatctcatgagccctaacagacaggaacccctttgtttcccagatctcaagtcccttctcctggcagtcatacaactggacttggaaagaaggcarataggatcctcttcaaactcagccaaagttagctggctgggttctccttcccatctacctctcctgccaggaggaggaaagctagtgggatgggaaacccagactcagggccatctcctacttccgcacagctagcagcccaggcctaaccagccagccagcttggccttgccacaggcccaaggccaccccccaccaaaacatgtggaatccatcctctcaggggctgtcccaagggcacatttcctatggcttgcatgccaaggaaactggagcggcttgtctgttccaggtccttcc

SEQ ID NO: 177483 - DNA, 601 bp, Human
ggcttgaggcagaggattgtttgaacctgggaggcggaggttgcagtgagctgagatcatgtcactgcactccagcctgggcgacagagtgagactccgtatcagaaaaaaaaaaattttttttttgaactttttgaactctctggagtgaacccagcaatctgaggtttttgttattttgttgcccaggctggagtgcagtggcaggatcatagctcaatgcagccttgaactcctggactcaagcaatcctcctgccacagcatcctgagtagctgggaccataagcgcacaccaccaygcttggctaaatttttttttttttttttaagagatgatggtctcactatgttgcttaggctggtcttgaactcctggtctcaagtaatccttctgtctgggcctcccaaagtgctaggattacaggtgtgagcccaccatatcctgccctggaggtttttttcttttctttttctttttttaggttcctctgttaactgtgatccacagctagaaccaccctctggaggaagggaggtcatcacttcccttctttcaactatttgctcagcttgggcctcaaattctcacttttcaagtg

SEQ ID NO: 177484 - DNA, 601 bp, Human
tccaggtttcctgggcccagagcccctggctcactcagggccccaggggaaggctgcttatagttcaagtcccagctgagccttgccaagctccatagggcttataggcgctagcaactcctcccacttcaaaaaacaaaacaaaacaaaacaaacaaaaaaaaacaactcaggagttaaagaaaaaaaaaaaagcagtccagcactctgagcctccctaactccctgcctgcagcaggaccaggtaggcctggatcaatcccctgaaccccagatgaggaatccagggctccggtgagcrtgctttgccctgccccaaatgtggccctgatgctcctggaacctgggcctgagggcctcagttggggaacataccacccactctcccatgagtaaaaaggattttgaggccgggtgcagtggctcacgcctataatcccagcactttgggaggccgaggcgggtggatcacaaggtcaggagttcgagaccatcctggccaagatggtgaaacctcgtctctactaaaaatacaaaaaaattagccgggcgtggtggtgggcgcctgtaatcccagctactcaggaggcttgaggcagag

SEQ ID NO: 177485 - DNA, 601 bp, Human
acactgtccctggcagcttcacagggctggccccagggcccagattatgcaacgagcacaaccagccaaccaagcccggcagggtggagacttgtaccaaatcaaaggaccctcccccaccccagcatcatggagatgagattcttccccaacctcttcatcccgcactaaacccatgttcccaacacagagggtcagattcttgaccagatgcggagatggaaagaaacatgacccacagacgtgaggatggggagaggaggagcagggtgggacggaagtgtttgggagaataaaaagytcaaagtggggggctctggggctttgggagtcctgccaaagtctctctgcatcaggaagagattaatcagagctgttgaaaggcaaaagacagcctctttctctgccttaaagattgttctttctctggcctgagattatagaaaaaaactaagtgtggctacagctgtaagcccaggcccagacatcccagactagtttttcctagtgcctgagacaaagacagggaagaactgaagcagtgggtcctgcagaggtgagcgagggccctgtggtccccaggaagctccctgctgcagtg

SEQ ID NO: 177486 - DNA, 601 bp, Human
ctgcctgcaaggcctgtttggcagctctgccttgcacacactgtccctggcagcttcacagggctggccccagggcccagattatgcaacgagcacaaccagccaaccaagcccggcagggtggagacttgtaccaaatcaaaggaccctcccccaccccagcatcatggagatgagattcttccccaacctcttcatcccgcactaaacccatgttcccaacacagagggtcagattcttgaccagatgcggagatggaaagaaacatgacccacagacgtgaggatggggagaggaggrgcagggtgggacggaagtgtttgggagaataaaaagttcaaagtggggggctctggggctttgggagtcctgccaaagtctctctgcatcaggaagagattaatcagagctgttgaaaggcaaaagacagcctctttctctgccttaaagattgttctttctctggcctgagattatagaaaaaaactaagtgtggctacagctgtaagcccaggcccagacatcccagactagtttttcctagtgcctgagacaaagacagggaagaactgaagcagtgggtcctgcagaggtgagcga

SEQ ID NO: 177487 - DNA, 601 bp, Human
aaggccctccgggacccatagcccatgccctccatccctctcgtcagccaggtagggcctgagcagcacaccagagccctgctggagccccaggaacaaaggggagtgggcgcctgagcacagagtgtaaaccacacctgccctgccccctgcaaccgccctggcagccatgccagcgaatgaggcctgccagaacctgggctgggaggagggtcctgcctgcagagggaagggccttggggagcttttcagggcccattgctaccttccagccccagcatgctgtgccctattccctggrcaagctggtccctattctctcagacagtcctgccaagccctgccctccttctctttctcccatcatgaagaagaagcatggctgagaggcacaggggcagtgtcactgccaggcagaggagtgtactatagtatgagtaggccaatggcgcagagccccaatccccatcctctgtggccgagggagaaaggggtctggtaggcagcagcaccccaggtgagcagggctgcaacaggatggcttggaacgtgtaccagctggtgggggtggcctcgggcagggtacagggaccctgtaccc

SEQ ID NO: 177488 - DNA, 601 bp, Human
ccagagctgagttaggcagagtgagagaagcaggatgctcttacccccggcgctgggcaggcatgggaggctgcgcctggggcacaagcaggcgttttcggaatggatccatcatggtgggtggcatgccaggtcgaagcggagctgctgcaccaaatggggagccagcagggggtcccacctgcaagccagccatgggcatccggttccctggtgacatgccaggtcgctgggggaagtgagccaacgggggtgcataggtcaggggcaaggccctccgggacccatagcccatgccctycatccctctcgtcagccaggtagggcctgagcagcacaccagagccctgctggagccccaggaacaaaggggagtgggcgcctgagcacagagtgtaaaccacacctgccctgccccctgcaaccgccctggcagccatgccagcgaatgaggcctgccagaacctgggctgggaggagggtcctgcctgcagagggaagggccttggggagcttttcagggcccattgctaccttccagccccagcatgctgtgccctattccctgggcaagctggtccctattctctcagacagtcct

SEQ ID NO: 177489 - DNA, 601 bp, Human
caggtgttgttgccttcctgcaagaaatttggtgttacatgagccagctgtaacttttctccattagattctgttactcctggaccagtattggacaagcagccttctttgatggctgctgtaaggtccagagggactcttgaaggacagggcagggtcattaggatcatactggagaatctgaaacaacatgcaggtgccctgtgcccttccctcagctcattcagacctgtgaggtcttggccaagatcctacctcctcctgtctcctgcccttgaataatggaatttgtctcttgtcygccacagctgattgtgaatgataagagccaaaacctccggaggctgcaggcacagaggaacgaactaaatgctaaaggtgagtggagaaagatgggaagccgcatgtgggcagtttgtctgaggtctgtccttatctccctgcactgtgtcttcacagcagtgcttactgttttctccctgtcatcatctagtagtttcacatgcatctctttttcctgagccctattgtagcctccttaaatacatgaattttgacctttggccttcctttaataagagtgatgcttagctcatgcacg

SEQ ID NO: 177490 - DNA, 601 bp, Human
agctgggattacaggtgcccgccaccacacccggctaatttttgtatgtttagtagagacggggtttcaccatgttggccaggctggtctcgaactcctgacctcgtgatctgccctccttgacctcccaaagtgctgggattacaaggccaccacgcccagcctagtgcagttaggtttaatggcaaaaactgcaattacttttgcaccaacctaagttcgaggttacacagctaggaagttgtagagccaagatttgaagcaggcagttggactccagtgctacattcttaacaactayatattggcctcagatacgtggcaagcagatgagccttgcttcagtgattggggctacatatagagattgaggaatcatctatttagaggcccactgagaagttgtatgcagagcaggagaaagccagaagtcagaagtcgcaaggttgaggaatggtcatgtgtttggggaggggtgggagagggcatgaacaagaggaaccagcaaagaagcagaagtggtcagagtggtagcaggttccctgtgctgggatagagtcacagaagttggaaatagagttggccacccaccagtgtgaaa

SEQ ID NO: 177491 - DNA, 601 bp, Human
ctgggattacagttgtgagccactgtgcctctggcctttaattgccattttaaatgaataaagtaaattttctcagttttaattttgaatatggtaaataccaatagatataatccacataagcaaaagctctttggggtctttaataatttttacagtgtaaattagaaccactcttgtaattcattgaactggaagagaagtctagtcccttaataccttgggaaaagggagtcctttaggcatctacccttcctttcaaactcactcccttttctgttgtctgtttgctatgtgttcytcatcttcaaatactcttaagtcctctttcttccaagccacagcctattaatttgtcttcttcaaaataatttttcttcatcgactatgacttcattctctcctttatctctattatttgctggtttcctgcccatcttacctttcttttcctctacacctgttcttctgtaatatctctctcctttccctgtcattttttaaactccctcaagttgtttgtttgcccttttgcaatatctcttcctctttaatttgttctttgtcattttaacatttctacttcctcttatttctcata

SEQ ID NO: 177492 - DNA, 601 bp, Human
tgaggccttgaagaaggaggggtatgatttgctattaggcattaatagaaagctatcctctcaaaaggcttcagaaacacctctatctagagaatccatctagatagcacctaacagtatcactgcttgggacagttgatttggaagaaaaaaatataagaattacagtctgggccgggtgtggtggctcacgcctgtaatcccagcactttgggaggctgaggcgggcagataaaaaggtcaggagttcgagaccaatatggtgaaaccccgtctctactaaaaatacaaaaattagccrggcgtggtggccggcgtctgtagtcccagctactcgggaggctaaggcaggagaatcgcttgaacctgggaggtggaagttgcagtgagccgagttcgagccactgcactccagcctgggggacagagcgagactccatcacacacacacagaaaaaagaattacagtctcaatgggtttcctagtggagatgaaactaatttggttagcagtataatttccaaaaatgaaaggtggtgatggacaaaggaaaaaaacaggaaggaattaccttcttgagatgttaggctttgcgtgaag

SEQ ID NO: 177493 - DNA, 601 bp, Human
ctccatgtgtctgtgtgttctcatcgttggaacatagtttttaaatctagtggcctcttctgtcattggcagaagagtctaagctgaagtggtagatgaatggttgggattgagcaatagttgtgggtactgttgtcaaacctgatagatgctcagagggtgaaaggtaacggtagagaagaggaaaaaaggaaacaatcgggaaaaggcaaattgagtgaaagaaaacagaatcctatgttgagaagaaaggaagaatatactcagaccattgctttttaaaccctacgttttaagtatrcaattaaccaacctttctttctgtttcttttcagaattatagcgttcagccggcctgtgaaatatgaagatgtggagcacaaggtgacaacagtatttggacaacctcttgatctacattacatgaacaatgaggtgagaaggcagatggatggggcagggacaagaggggcagatgcctaccttttttctctctgtttaccagagcctttaaagtttgttcctctaatatcatctgcaggttttcattttctagacccccttttcttaattccaacaactgtgggatctctgtttttta

SEQ ID NO: 177494 - DNA, 601 bp, Human
gtaggagtatcttatttttttccccccagcacagccttaacaagaagcagagggtttagcaggggctagggaggtgtgaaaaaccagtgagtaggtcatctattacagtcataaatgcaggattcttctcttagagtttcttctgattggagcttatttgtttcaaatgttagcacctgctccaataagttctttaactcctcctcctcctcactccaccccaacggtccttatttacttctactttgaatatcacccaggaaggaattcttttgaatgtcagtttctgggctgctttccsagctccaagaagaatattacagactacaatcagcttaggctggtgctttgcagtgtatttatgctgagtaaagaatgtgtacctcgaggaaattgagttaggggtgcaagacaagaaagctgggcaacatcatgaccctttgagaaccagatcatcactgtgtagttttattttatttgatgaggagttaaaatttttcttttagtaaagacttttctgaatcatttagtactcttttctttttcagttaatatttccattaagaattcctgatgtttctttattctaaagccaaatata

SEQ ID NO: 177495 - DNA, 601 bp, Human
aaacaaataaaggaaagaggtttaattgactcacagttcagcatggctggggaggcctagcaaacttaacaatcatgatggaagggaaagcaaacacatccttcacatggcgacaggagagagaagggccaagcaaatgagaaaaagcctcctataaaaccatcagatctcgtgagaactcactcactatcaggagaacagcagcatgggataaccacccccgtgattcagttacctcccactgggtccctgccacaacacatggggattattggaactacaaatcaatatgggatttggrtggggacacagccaaaccatatcagtgagggctgcagtttctccaccatccttaccaacatttgttattttcttcttttaatagccatcctagtaggtgtaaagtgatatgtcactgtgagttttgtttttgtttttggtttgagacagggtttcactttgttgcgcaggccagagtgcagtgtgcaatcatggctcactgcagccttgacatcctgggttcaagtgatccccccacctcagtttccccagtaactgggacaataagcacatgccaccacactgagctaattaaaaataa

SEQ ID NO: 177496 - DNA, 601 bp, Human
gtgagggctgcagtttctccaccatccttaccaacatttgttattttcttcttttaatagccatcctagtaggtgtaaagtgatatgtcactgtgagttttgtttttgtttttggtttgagacagggtttcactttgttgcgcaggccagagtgcagtgtgcaatcatggctcactgcagccttgacatcctgggttcaagtgatccccccacctcagtttccccagtaactgggacaataagcacatgccaccacactgagctaattaaaaataaatttttgtagagatgggggtctcaytattttgcccaggctggtcttaaactcctggcctcaagtgagcctcccgccacagcctcctaggattacaggtgtgagccactatccccagcctacttggttttttttatttaactcccttcccaaccattcttatttattcccactttgaatgtcacacaggaagaaattcttttgcaatataatatgatttgcagaacattctcccattccataagtagttttgagattttattttaaatatgtactgtttttggcgaggcgcgatggttcatgcctgtaatgccagcactttgggag

SEQ ID NO: 177497 - DNA, 601 bp, Human
catggatgaactaaaaaacattaagtgaaagaagctagatgaaaaagattgaatctttatgaattgaattgaatatgtatgaattgtatgagtctaaatggaatgaaatgtccagaaaaggcaaatcaatagagatagaaagtagagtagtggttgcctggggctggaggtgggaaggaggagtgactataaatgggcacaagagatcctgttggagttctggaaatgttttaaaattggattatgatgatggttgcacaactatgtaaaggtactacaaatttttggattgtacatttakagaaaaaaatctgtatggtttcaactagatctcttaagaccccatagtatccagtgagattgttttcctccaaatgtatttttattttttgtttattttatttctgcaaagtgaaacattgagataaacttctgttttatattattttccttttctatgtcttgtatcacagctctccatcctgctgaaaaaccaagatgatcttgataaagcaattgacattttagatagaagctcaagcatgaaaagccttaggatattgctgttgtcccaggacagaaaccatgtaagtagcccttg

SEQ ID NO: 177498 - DNA, 601 bp, Human
ttagattttgaccccaacaagagaaatttgattcgtttggcagtgccgattaggaaagactgtcaaagatttgagactgtcatgctttataaacccaactcccacaacaccttgcctttcccttggaacacttgtaggaaacaaacttttccttttgttcagtggaaaaagccatgggttgggggcctcttataacttatcagctgttgctttacccaatggcaggcagtctgtagggtgtcagaagtggggaattatcccttatgcacagtttcctctcctgaaggattcctggaggccygcatttcacaagaatgcttgcaatctgtatctgtcttccaattactgattcttctaccagttttcttcagatgcatgtttctgaaggtttcttggcaccatttccttttcttatgcttgacaggctttccttttctttatgtggacagccaacatggcagcataagtgtgggtgtagtgactaggacaaagtttaggtggaatgctgctcatgctgaccatttcttttctttttttttttttttttgagacagagttttgctcttgttgcccaggctggaatgcaatggtgtgatcttag

SEQ ID NO: 177499 - DNA, 601 bp, Human
gcctcctgagggagttacaggaaaaatatgtttctgaggtactgactttgccttactgagtaacttctggaatccaggcaagtactggtagtaagtattgccaggctgaaagtctgtatatgaatttcagatttctgtagataattggggaatgtgttggttgaggatggagagctagtaccctagcaaggagagcctagccacagcgtctctggccctggaatctgtgtgcctcagagcctgggaagctctgccagtttggcctcttttccgtagtccttgtagagattgaggggatggmggtgggcagcatggtcccttgtaatcagtaaggattgatggggcagtaactgggtctcttgcccccaagcaagagcctatgatatgtgcatggaggcaggggctaaatacttagccactggaccctttctccatgttaccgggagctatatatggaaatgattttcctggctgagaatgctgaggagtgagatttctgtgaagtagttcctgtttatctggaaaatgggcaacacggcctcttagcatacctagatcctggcttccttcattcagcaaagcattaagtaccagctgttgg

SEQ ID NO: 177500 - DNA, 601 bp, Human
ggaagagagcctggttccaggtgctgggaaggggcagacttaatgttttagacatgttggtattgaagtgcctctgatacagccaacaggagatatcagagaggcagttagatatataggtctctagctcagaggggagaaaatcagggctagtgaaaaaatattggaaattgttatgttgaaaccatgcacccaggcgagagtgcctaagcagagactatagaatgagaagaaaagagggtccatgattgagccttaggaacccaacacttagtggccagttagaagaggatgagcctgygaaggacacagaaaaggagtaaccagagaagtaggaaaggaaattaggagtgtggggagaaggcattacacagaaccagccaggttggtaaggacagaccaagggtaagagacagaaacctgttattttcattcacagatgtttgagtgcttgctgtgtgctggtacagacaagactttctggaagggaaacagagacagaagtcaaggtatagcatgagagacttggaaaagtcctagcagtagaaatggggtccaagaagtccttggttagtaagccttagcaattcagccttccact

SEQ ID NO: 177501 - DNA, 601 bp, Human
aaaaaaaccctactaagtaatgagttaatccaaaggaattaatctctctgtggggagatcactaggcagataggtggaatttccttacctgaagacatcctctctcataccttggcctacggaaattctacctacctttgaagctcaagcactatttttccatgatacattgggtggtgcccttaagccatgtaaccaagcctcaactaaaggacttgtcggcggggtgcagtggctcatgcctataatcttaacactttgggaggccaaggcgggcaaatcacctgaggatgggagttcragaccagcctgtccaacatggtgaaaccctgtctgtactaaaaatacaaaaattagccaggtatgatggcaggtgcctgtaattcgagctactcggctgctgaggcaggagaattgcttgaacctgggaagcagaggttgcattgagccaagatcgtgtcactgcactctagcctggacagactcttggtctgtctcaaaaaaataaaaaataaataaaaattatccaggtgtggtcgtgcgcatctgtaatcccagctacttgggaggctgaggtgggacaatcacttgaacccgggag

SEQ ID NO: 177502 - DNA, 601 bp, Human
tcttcttccttctatactcctgccttccagataaattcatgtttggagtagtgacctggagtgccattagctgcagatttcctttttgggcattttactgaccatcctttctggtttctctaaccagggcacttctggacatcagctgttctaggggtgacttgggtgtaaaatcccagagattgcagatgagcttgattgccctcagtctatgtccctcgccatggtcctatactctgcccccttcacttttttactttgcctgcatggccctggaaggcctgggaggatttgactcccagtgaggacagacttttagaaagaggccaaggaaggcagtggttggggattgccaaggtcctcccccagcgcctgcctctttagctgaagagaattgctcctggtaacaggccatttgagatcaatctgcttaacaggaacgaacactgcatagtatgtaataaaagaatattccagtgtgactttactgaaaagtgaaaatatgataagttttgttttttctttaatcaggtttaagcaataattgcatctatttactaatttttagaatgagcaaagcatgattcatgttaattttttg

SEQ ID NO: 177503 - DNA, 601 bp, Human
gcaattctctccgatgttggtttcatccactttggctatcctatatccttagcaacatttgcagttttactttgcaattaatttgccttgattggcagattttaaaaaatcatgtgtgacaacatgacttaaagcatttgaaattatgggtggggatggaccctggtattaaatgggaaaaaatatttgagttggaaactaattttatggaggtcgttagtgaattttcataattctgatactttgtttccctatgtaattttttaaaattaattaaaaaaatatttaaacagaaacaagrtctcactatgttgcccaggctggtcttgaactcctgagtgcaagtgatccttccctctcggctcccaaagtgctaggattacaggcatgagccaccaagtctggcccctatgtaatgtttaatgttggagctcggataatgaatattctgaaattgaagaccccaccccaacttttgtgcagagaaaatgaaagggaggaccttcaggacattgattggagaaaaagggattccaaaggccttttgttgctgcatttgaccaggggccagagaaatattttattatatttagatatctat

SEQ ID NO: 177504 - DNA, 601 bp, Human
aaaaatcatgtgtgacaacatgacttaaagcatttgaaattatgggtggggatggaccctggtattaaatgggaaaaaatatttgagttggaaactaattttatggaggtcgttagtgaattttcataattctgatactttgtttccctatgtaattttttaaaattaattaaaaaaatatttaaacagaaacaagatctcactatgttgcccaggctggtcttgaactcctgagtgcaagtgatccttccctctcggctcccaaagtgctaggattacaggcatgagccaccaagtctgkcccctatgtaatgtttaatgttggagctcggataatgaatattctgaaattgaagaccccaccccaacttttgtgcagagaaaatgaaagggaggaccttcaggacattgattggagaaaaagggattccaaaggccttttgttgctgcatttgaccaggggccagagaaatattttattatatttagatatctattacctctgcattggaccaggaactgggacatttttgttctggtatcagctgtgcactaactagttttatgactttagacaagtctcctaacctttctaggcctg

SEQ ID NO: 177505 - DNA, 601 bp, Human
aactattcttcccattgcatggggagaaaaaggacactttcatgttttgacaaaaaggcccatttgctggcccttgccataaagcctgggtcactggggggaattggggctgggggtgtggcttcattgtttgacttgccttacagatgctggatcccctgagcagtgcagaaaattccttgtctggaagctgccaatccttggacaggtcagcagacaggtatgggactgtgggtggtttggagggtaatgcataggcatttttggaattgatgggttgaggaagaagagttagctctgsaggcccagggttaaaacatcatgcttctaggaaaagccttctccttaatttccccaacaccacgagaatgttatgatggcataattaaatgaatgtaataatagctcataaaatagcagctcatttattaagtacttgctttgttgttctaagtgctttacatgttttgactttccatataatatatgccgctctcgtacttttggcctcactgctgtgatctgaactgagaaggagtggactgtcagtgttttagggggagaactgaattctcatccattgctttaccatcatttttta

SEQ ID NO: 177506 - DNA, 601 bp, Human
ccttgtctggaagctgccaatccttggacaggtcagcagacaggtatgggactgtgggtggtttggagggtaatgcataggcatttttggaattgatgggttgaggaagaagagttagctctggaggcccagggttaaaacatcatgcttctaggaaaagccttctccttaatttccccaacaccacgagaatgttatgatggcataattaaatgaatgtaataatagctcataaaatagcagctcatttattaagtacttgctttgttgttctaagtgctttacatgttttgactttccrtataatatatgccgctctcgtacttttggcctcactgctgtgatctgaactgagaaggagtggactgtcagtgttttagggggagaactgaattctcatccattgctttaccatcattttttattccaagtgtttttggtggagtaagaaactgaaacccaaaaacagaatatccagaatgcctagtgtaccatgccacctgcttggtgtatatcttcttcttacactttgggaggaaacaagtggtgtcctttacataccaaatcgcaagggtatgtttggagaggccttggcattgat

SEQ ID NO: 177507 - DNA, 601 bp, Human
tttgggaggctgaggtgggtggatcatgaggtcaggagttcgagaccagcctggccaacatagtgaaaccctgtctctactaaaaaatacaaaaaaaaaaaaaatagctgggcgtggtggcaggcgccgtaatcccagctccttgggaggctgaggcaggagaattgcttgaacccaggaggcggaggttgtagtgaacccagatcgccccattgcactccagtctgggcaacagtgtgagattccgtctcaaaaagaaaaaaaaaaaaagcaaaaaaaattagctgggcatggtggcacrtgcctgtagtcccagctacttgggaggctgaggcaggagaatagcttgaacccaggaggtggaggttgcagtgagccaagatcatgccactgcactccagcctgggcgacagagcgagactccatcttaaaaaaaaaaaagtctggggctgggcgcggtggctcatgcctgtagtcccagcattttgggaggccgaggcgggtggatcacaaggtcaagagatcgagaccatcttggccagtggcgcgtgcctgtagtcccagctactcgggaggctgaggcaggagaatcgcttgaacc

SEQ ID NO: 177508 - DNA, 601 bp, Human
tgaacccagatcgccccattgcactccagtctgggcaacagtgtgagattccgtctcaaaaagaaaaaaaaaaaaagcaaaaaaaattagctgggcatggtggcacatgcctgtagtcccagctacttgggaggctgaggcaggagaatagcttgaacccaggaggtggaggttgcagtgagccaagatcatgccactgcactccagcctgggcgacagagcgagactccatcttaaaaaaaaaaaagtctggggctgggcgcggtggctcatgcctgtagtcccagcattttgggaggcygaggcgggtggatcacaaggtcaagagatcgagaccatcttggccagtggcgcgtgcctgtagtcccagctactcgggaggctgaggcaggagaatcgcttgaacccgcgaggtagaggttgcggtgagctgagatgctacagcactccagcccggcagcagagcgagactccatctcaaaaaaaaaaaaagtctggccctgtcttcctagctttatctttgagcatatacataggactgtgtgtgcctaatctgtaggggtgtctgtgaagacagaaacagcctagctgctcatcaagt

SEQ ID NO: 177509 - DNA, 601 bp, Human
gggtgtggcttggccttgcaagcaattgggagcctgttggccagccatacaccttccctttggccagatctccctgaaccagactacttcctaatttctgcttttgtcctgattcttggagtgcttgggacagcagcctctgtggaatgagtcaggtgggagtgcggacgggatgggctggagctggtattatctatcacttctggctgagacctggtttgtatattccgccttgtagcccggggtgtctcagacctggtttgtacgttccgcctcgtagcctggggtgtgacttgctctmctctggcccttgcaccctttcaggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtgtgaggagctgtccctggctaggaggagactgcccaggtggtctcagacaagctacgggggcaaacagctgggcccctgggaccc

SEQ ID NO: 177510 - DNA, 601 bp, Human; identical to SEQ ID NO: 95922

SEQ ID NO: 177511 - DNA, 601 bp, Human; identical to SEQ ID NO: 95922

SEQ ID NO: 177512 - DNA, 601 bp, Human
atggcttgtgtgagtgtggggacccccccccaaggtccaggggatagggcaggaactgatggccagaggagagctgggcagatcgggagcagattctagccccagctgtgtggcctggaaccagtgccttctcttttctggacctcagtggccacatctgtaaaatgggggtgggcgccatggtccctcaaggccttctctgcattgataattgtctggattcctccagggtctgaaagcacagttatttctgcccagggttgacattctgcagctctctgagaagtgagcgtgggaaggstgtggccaactgggggacacccaggccactatccctttccccctcctccaccccaaagagcctcctgtcccctcccccctgcagctgtcccggtcaccaggccagggcagagttaccctctgctccagagaacgctgaaaagttgccaggacccgagacaagctgcccaggatgggcccttctaggtcgggggtggagggtggttgtgtccaggctggtggcggggggggcgggggaaattcccttccaccacccccaagctgggaggttggggtggcagggaggtgagaatcttcctcg

SEQ ID NO: 177513 - DNA, 601 bp, Human
aagcatctttttctggtgtgccccacttgtgctgggcaccgggaatacagagatgtacaagacaggacgggaggtcaccatctggagggagtcactgaccttgaccaaacgggctaggatgctaatgacttcaagaatcaagcgagccctcctgtgcagcccccattgtacagatgagcaaacaggggaagaggggcaggagcaggtggcatggccagagctagaatccaggtttcttgtctctgttagtgagttcttccagcaaggtgcgttcatgggatactgagtgacagattagtcrgtcagtggggctggagctggccgaggtggcctcatgcccacccgttaccccccagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgggctgcagaccggaaccggggaccagggacaggggctgggtgggctggggcggggctgggttagtgacta

SEQ ID NO: 177514 - DNA, 601 bp, Human
gacagaacaaacgtctatcgtgtgaagccacccacaatttggtggtaatttgttattgcagccctaggcaatgaatacaccatctaatcctcagaagaggcagcctgtgatccccttccacagatgtaaggaagactggggctcagagacggtcagtgacttggccaaggccacacagtaaagctgtggcagagtctggtgtagaatcaacgaatcagagacctcagtgggaatccactcaaccccttgtgatttgcagcttgtggccttgggcaatttgctctccaagacttgggttttstgtgtgggtatatgagacaaggtctcactctgttgcccaggctggagtacagtagtgcaattacggctcactgtagcctcgacctcctgggctcaagtgatcctcagcctcccaaggctgaggagtgtgccgctacccccactaattttttaaggcaaagcgtagtggcatgcacctgtagcagaaaaggtctcactatattgcccaagctgagatttttttttatctctataaagatcaatggaggccaggcacagtggctcacacctgtaatctcagcacttcgagaggccaaggcag

SEQ ID NO: 177515 - DNA, 601 bp, Human
gcctcggcctcccaaagtgctgggattacaggggtgagccaccccgcccagcctcaatgtgacctatttaaaaatagttcctttgcatatgtaatcgagttaagaggtcatactggtttagggttggtcctaaatccaatacgaccagtgttctcataagaggagagaaatatagacacagagacggagacacacagaggagtccacgtgaagttggaggcagagattggagtgatgcaagccaaggaatgcgaggagccaccagaagctggaagaggcaagaaagaaccctccccttgcrccttcagcaggagcgtagccctgtagcaccttggtttcaggtttctagtcaccaaaaccaagacagaacaaacgtctatcgtgtgaagccacccacaatttggtggtaatttgttattgcagccctaggcaatgaatacaccatctaatcctcagaagaggcagcctgtgatccccttccacagatgtaaggaagactggggctcagagacggtcagtgacttggccaaggccacacagtaaagctgtggcagagtctggtgtagaatcaacgaatcagagacctcagtgggaatccact

SEQ ID NO: 177516 - DNA, 601 bp, Human
gagatgaagtctcactctgtcacctaggctggagtacagtggctcgatctcggctcactgcaacctctgcctcccgggttcaaccgattctcctgcctcagcctcccaagtagctgggattacgggtgcccaccacaacatctgtctaattttttttcttcttcttcttcttttttgtttttgtattttcagtacagacagggtttcaccatgttggccaggctggtcttgaactcctgatctcaagtgatccgcctgcctcggcctcccaaagtgctgggattacaggggtgagccaccscgcccagcctcaatgtgacctatttaaaaatagttcctttgcatatgtaatcgagttaagaggtcatactggtttagggttggtcctaaatccaatacgaccagtgttctcataagaggagagaaatatagacacagagacggagacacacagaggagtccacgtgaagttggaggcagagattggagtgatgcaagccaaggaatgcgaggagccaccagaagctggaagaggcaagaaagaaccctccccttgcgccttcagcaggagcgtagccctgtagcaccttggtttcaggtt

SEQ ID NO: 177517 - DNA, 601 bp, Human
tgagggcatagacccttccacgcaggacccctggcacattcacatcctgcatcccccctgcacttgaatagcgtcccccgaaaattcatgtccacctggaacctgtcaatgtgacctttttttttttttttgagatgaagtctcactctgtcacctaggctggagtacagtggctcgatctcggctcactgcaacctctgcctcccgggttcaaccgattctcctgcctcagcctcccaagtagctgggattacgggtgcccaccacaacatctgtctaattttttttcttcttcttcttyttttttgtttttgtattttcagtacagacagggtttcaccatgttggccaggctggtcttgaactcctgatctcaagtgatccgcctgcctcggcctcccaaagtgctgggattacaggggtgagccaccccgcccagcctcaatgtgacctatttaaaaatagttcctttgcatatgtaatcgagttaagaggtcatactggtttagggttggtcctaaatccaatacgaccagtgttctcataagaggagagaaatatagacacagagacggagacacacagaggagtccacgtgaag

SEQ ID NO: 177518 - DNA, 601 bp, Human
tgatgagggcatagacccttccacgcaggacccctggcacattcacatcctgcatcccccctgcacttgaatagcgtcccccgaaaattcatgtccacctggaacctgtcaatgtgacctttttttttttttttgagatgaagtctcactctgtcacctaggctggagtacagtggctcgatctcggctcactgcaacctctgcctcccgggttcaaccgattctcctgcctcagcctcccaagtagctgggattacgggtgcccaccacaacatctgtctaattttttttcttcttcttyttcttttttgtttttgtattttcagtacagacagggtttcaccatgttggccaggctggtcttgaactcctgatctcaagtgatccgcctgcctcggcctcccaaagtgctgggattacaggggtgagccaccccgcccagcctcaatgtgacctatttaaaaatagttcctttgcatatgtaatcgagttaagaggtcatactggtttagggttggtcctaaatccaatacgaccagtgttctcataagaggagagaaatatagacacagagacggagacacacagaggagtccacgtg

SEQ ID NO: 177519 - DNA, 601 bp, Human
gaggcagagggtgatgagggcatagacccttccacgcaggacccctggcacattcacatcctgcatcccccctgcacttgaatagcgtcccccgaaaattcatgtccacctggaacctgtcaatgtgacctttttttttttttttgagatgaagtctcactctgtcacctaggctggagtacagtggctcgatctcggctcactgcaacctctgcctcccgggttcaaccgattctcctgcctcagcctcccaagtagctgggattacgggtgcccaccacaacatctgtctaattttttytcttcttcttcttcttttttgtttttgtattttcagtacagacagggtttcaccatgttggccaggctggtcttgaactcctgatctcaagtgatccgcctgcctcggcctcccaaagtgctgggattacaggggtgagccaccccgcccagcctcaatgtgacctatttaaaaatagttcctttgcatatgtaatcgagttaagaggtcatactggtttagggttggtcctaaatccaatacgaccagtgttctcataagaggagagaaatatagacacagagacggagacacacagag

SEQ ID NO: 177520 - DNA, 601 bp, Human
gtgggccacagcagtcctccccgagaggcagagggtgatgagggcatagacccttccacgcaggacccctggcacattcacatcctgcatcccccctgcacttgaatagcgtcccccgaaaattcatgtccacctggaacctgtcaatgtgacctttttttttttttttgagatgaagtctcactctgtcacctaggctggagtacagtggctcgatctcggctcactgcaacctctgcctcccgggttcaaccgattctcctgcctcagcctcccaagtagctgggattacgggtgcccrccacaacatctgtctaattttttttcttcttcttcttcttttttgtttttgtattttcagtacagacagggtttcaccatgttggccaggctggtcttgaactcctgatctcaagtgatccgcctgcctcggcctcccaaagtgctgggattacaggggtgagccaccccgcccagcctcaatgtgacctatttaaaaatagttcctttgcatatgtaatcgagttaagaggtcatactggtttagggttggtcctaaatccaatacgaccagtgttctcataagaggagagaaatatag

SEQ ID NO: 177521 - DNA, 601 bp, Human
gcctggggccagcttagcccctttctgggccttggttcccttatctgtcgtataagggatttggatgatatggcctctggagctggagagagaggaaagaaaaggcagaggtgagatgaccaggaaagagaaggtggggagagtccgtgggccacagcagtcctccccgagaggcagagggtgatgagggcatagacccttccacgcaggacccctggcacattcacatcctgcatcccccctgcacttgaatagcgtcccccgaaaattcatgtccacctggaacctgtcaatgtgacctttttttttttttttgagatgaagtctcactctgtcacctaggctggagtacagtggctcgatctcggctcactgcaacctctgcctcccgggttcaaccgattctcctgcctcagcctcccaagtagctgggattacgggtgcccaccacaacatctgtctaattttttttcttcttcttcttcttttttgtttttgtattttcagtacagacagggtttcaccatgttggccaggctggtcttgaactcctgatctcaagtgatccgcctgcctcggcctcccaaagtgctgggattac

SEQ ID NO: 177522 - DNA, 601 bp, Human
ctgggggggtggggagttgggggcccagactctagtgccgactctgcccctaattggcagaggggcctggggccagcttagcccctttctgggccttggttcccttatctgtcgtataagggatttggatgatatggcctctggagctggagagagaggaaagaaaaggcagaggtgagatgaccaggaaagagaaggtggggagagtccgtgggccacagcagtcctccccgagaggcagagggtgatgagggcatagacccttccacgcaggacccctggcacattcacatcctgcatyccccctgcacttgaatagcgtcccccgaaaattcatgtccacctggaacctgtcaatgtgacctttttttttttttttgagatgaagtctcactctgtcacctaggctggagtacagtggctcgatctcggctcactgcaacctctgcctcccgggttcaaccgattctcctgcctcagcctcccaagtagctgggattacgggtgcccaccacaacatctgtctaattttttttcttcttcttcttcttttttgtttttgtattttcagtacagacagggtttcaccatgttggccagg

SEQ ID NO: 177523 - DNA, 601 bp, Human
agccttgacctcttgggctcaagcaatcctcccacctcagccccccaggtagcctggaccacaggcatcccacctggcccagctgatttttttttttttcagatggggtctcactatgttgtccaggccagcctcgacctcctgagctcaaaggatcctcccacctcggcctcccaaagtgttgggattacaggtgtaagccactgtgcccggcctggcagtacattttataagagacgcctggaggaggcagcaatgcttaacccaggacagcgggccatgacggcggcatgtcagacasgaggctgctcagaccagagcttctcagccttggccgtctggacgtttggggcaggcatttctttgttggggtctgtctcttgtgttgtaggatgttgagcagtattcctggcctctacccactggatgtcagtgacaccctcccctgagcggtgacaaccaagaatgtctccagacagggtccgttgtctcctgggagcaaaacctccctgctttagagaaagtggggtttggaggctggacacctaactccccatgtctttgcttaacacaacggggttgggtccagattttggagcca

SEQ ID NO: 177524 - DNA, 601 bp, Human
ttttacattgtgggagttctgctcactgactttttatttccagaaaaagcatgatctgagatgccctgaatgagctcattggactggggcactttgccagaagtcaagggggcagtggccatgggaggaccctcagtgccctctcgctggcagccgcctcctctctgcagaggaggaagtgacccgctggttggtcacatgtaggggtaggttgttaggtattgctcaactcttccacaggcagtaagttcttttttttttttttttgagatgttgagatggagtctcactctgtcacccrtgctggagtgcagtggtgcaatcttagctcactgcaacctccacttcccaggttcaagcaattatcctgcctcagcctcccgagtcactgagattacaggctcccaccaccatagctagctaattttctttgtatttttagtagagacggggtttcaccactttggccaggttggtctcgaactcctgacctcaagtgatcctcccctctgggcctcccaaagttctgggattataggcgtgagacaccacacccagcattttttttcttttctttctttttttttttttttttgagaca

SEQ ID NO: 177525 - DNA, 601 bp, Human
gggtgagggttggtctgaccaggacgcaacaggcaccaaagatttagaacaacttatgggaggacacttttacattgtgggagttctgctcactgactttttatttccagaaaaagcatgatctgagatgccctgaatgagctcattggactggggcactttgccagaagtcaagggggcagtggccatgggaggaccctcagtgccctctcgctggcagccgcctcctctctgcagaggaggaagtgacccgctggttggtcacatgtaggggtaggttgttaggtattgctcaactctyccacaggcagtaagttcttttttttttttttttgagatgttgagatggagtctcactctgtcacccatgctggagtgcagtggtgcaatcttagctcactgcaacctccacttcccaggttcaagcaattatcctgcctcagcctcccgagtcactgagattacaggctcccaccaccatagctagctaattttctttgtatttttagtagagacggggtttcaccactttggccaggttggtctcgaactcctgacctcaagtgatcctcccctctgggcctcccaaagttctgggatt

SEQ ID NO: 177526 - DNA, 601 bp, Human
aaaaaaaaaaaaaaaaaaaactcattacccaagaccagttttcgcatctatgaccagagggtgagggttggtctgaccaggacgcaacaggcaccaaagatttagaacaacttatgggaggacacttttacattgtgggagttctgctcactgactttttatttccagaaaaagcatgatctgagatgccctgaatgagctcattggactggggcactttgccagaagtcaagggggcagtggccatgggaggaccctcagtgccctctcgctggcagccgcctcctctctgcagaggagraagtgacccgctggttggtcacatgtaggggtaggttgttaggtattgctcaactcttccacaggcagtaagttcttttttttttttttttgagatgttgagatggagtctcactctgtcacccatgctggagtgcagtggtgcaatcttagctcactgcaacctccacttcccaggttcaagcaattatcctgcctcagcctcccgagtcactgagattacaggctcccaccaccatagctagctaattttctttgtatttttagtagagacggggtttcaccactttggccaggttgg

SEQ ID NO: 177527 - DNA, 601 bp, Human
tacagtaggagcctcctctagcctcacaatggttactagggaagatttctaagctgggttttcaaagctcattacccagggctgggagcggtggctcacgcctgtaatcccagcactttgggaggctgagtcgggtagatcacctgaggtcaggagtttgagactggcctggccaacatggagaaaccctgtctctattaaaaatacaaaaattagccgggtgtggtggcacatgcctgtcgtcccagctacttgggaggctgaggcaagagaatcgcttgaacccaggaggtggaggttrcagtgagccgagattgtgccaggcgacagagcaagactctgtctaaaaaaaaaaaaaaaaaaaaactcattacccaagaccagttttcgcatctatgaccagagggtgagggttggtctgaccaggacgcaacaggcaccaaagatttagaacaacttatgggaggacacttttacattgtgggagttctgctcactgactttttatttccagaaaaagcatgatctgagatgccctgaatgagctcattggactggggcactttgccagaagtcaagggggcagtggccatgggaggac

SEQ ID NO: 177528 - DNA, 601 bp, Human
cttattttccataggaaagcagcacctgaatttctgtacagtaggagcctcctctagcctcacaatggttactagggaagatttctaagctgggttttcaaagctcattacccagggctgggagcggtggctcacgcctgtaatcccagcactttgggaggctgagtcgggtagatcacctgaggtcaggagtttgagactggcctggccaacatggagaaaccctgtctctattaaaaatacaaaaattagccgggtgtggtggcacatgcctgtcgtcccagctacttgggaggctgasgcaagagaatcgcttgaacccaggaggtggaggttgcagtgagccgagattgtgccaggcgacagagcaagactctgtctaaaaaaaaaaaaaaaaaaaaactcattacccaagaccagttttcgcatctatgaccagagggtgagggttggtctgaccaggacgcaacaggcaccaaagatttagaacaacttatgggaggacacttttacattgtgggagttctgctcactgactttttatttccagaaaaagcatgatctgagatgccctgaatgagctcattggactggggcactt

SEQ ID NO: 177529 - DNA, 601 bp, Human
tgctgggattacaggcgtgaaccaagcccagccttaattttcttttttaaattttttctttttttctggacagtggtctgcccaaatgaccatcattttgattacttgttgttaagattcatctgctccttattttccataggaaagcagcacctgaatttctgtacagtaggagcctcctctagcctcacaatggttactagggaagatttctaagctgggttttcaaagctcattacccagggctgggagcggtggctcacgcctgtaatcccagcactttgggaggctgagtcgggtrgatcacctgaggtcaggagtttgagactggcctggccaacatggagaaaccctgtctctattaaaaatacaaaaattagccgggtgtggtggcacatgcctgtcgtcccagctacttgggaggctgaggcaagagaatcgcttgaacccaggaggtggaggttgcagtgagccgagattgtgccaggcgacagagcaagactctgtctaaaaaaaaaaaaaaaaaaaaactcattacccaagaccagttttcgcatctatgaccagagggtgagggttggtctgaccaggacgcaacagg

SEQ ID NO: 177530 - DNA, 601 bp, Human
caccatgcctaatttttgcatttttagtagagacaaggtttcaccatgttggtgtggctggtctcaaactcctggcctcaattgatctgcccacctcagctccccaaagtgctgggattacaggcgtgaaccaagcccagccttaattttcttttttaaattttttctttttttctggacagtggtctgcccaaatgaccatcattttgattacttgttgttaagattcatctgctccttattttccataggaaagcagcacctgaatttctgtacagtaggagcctcctctagcctcacratggttactagggaagatttctaagctgggttttcaaagctcattacccagggctgggagcggtggctcacgcctgtaatcccagcactttgggaggctgagtcgggtagatcacctgaggtcaggagtttgagactggcctggccaacatggagaaaccctgtctctattaaaaatacaaaaattagccgggtgtggtggcacatgcctgtcgtcccagctacttgggaggctgaggcaagagaatcgcttgaacccaggaggtggaggttgcagtgagccgagattgtgccaggcgac

SEQ ID NO: 177531 - DNA, 601 bp, Human
gcgcctgtaatcccagctacttgggaggctgaggcgggagaattgcttgaattctggaagcggaggttgccatgagctgagatcgtaccattgcactccagcctgggcgacaagagtgacttttcatctcaaagaaaaacaaaaaaaaaaggccgggcacagtggctcacacctgtaatcccagcactttggaaggccgaggcagccagatcacctgaggtcaggagtttaagaccagtctgcctaacatttaaccctgtctctactaaaaatgcaaaaattagccaggtgtggtggcacgcatctatagtcccagctacttgggaggctgaggcaggagaatggcttaagcctgggaggcagaggttgcagtaagacaagatcacgccactgcactccagcctaggcaacagagcaagactctgtctcaaaaacaaaaacaaacaaacgaacaaaaactaagaatctataaaactccgcaagtcctatgtccatcaaagtctctctccaagcctcactttccccttctgtaaaattgactaatttgatttattcatttaaaaaacagttgatagcctgggtgtggaagtgtgtacctgta

SEQ ID NO: 177532 - DNA, 601 bp, Human
aaataaattatctgcgcatggtggcgggcgcctgtaatcccagctacttgggaggctgaggcgggagaattgcttgaattctggaagcggaggttgccatgagctgagatcgtaccattgcactccagcctgggcgacaagagtgacttttcatctcaaagaaaaacaaaaaaaaaaggccgggcacagtggctcacacctgtaatcccagcactttggaaggccgaggcagccagatcacctgaggtcaggagtttaagaccagtctgcctaacatttaaccctgtctctactaaaaatgcaaaaattagccaggtgtggtggcacgcatctatagtcccagctacttgggaggctgaggcaggagaatggcttaagcctgggaggcagaggttgcagtaagacaagatcacgccactgcactccagcctaggcaacagagcaagactctgtctcaaaaacaaaaacaaacaaacgaacaaaaactaagaatctataaaactccgcaagtcctatgtccatcaaagtctctctccaagcctcactttccccttctgtaaaattgactaatttgatttattcatttaaaaaacagttgata

SEQ ID NO: 177533 - DNA, 601 bp, Human
agctactcgggaggctgaggcaggagaatggtgtgaacccgggaggcggagcttgcagtgaggtgagatcgcgtcactgccctccagcctgggcgacagagcgaaactccatctcaaaaataataataataataataataataataataataaataaaataaaataaaataaattatctgcgcatggtggcgggcgcctgtaatcccagctacttgggaggctgaggcgggagaattgcttgaattctggaagcggaggttgccatgagctgagatcgtaccattgcactccagcctgggygacaagagtgacttttcatctcaaagaaaaacaaaaaaaaaaggccgggcacagtggctcacacctgtaatcccagcactttggaaggccgaggcagccagatcacctgaggtcaggagtttaagaccagtctgcctaacatttaaccctgtctctactaaaaatgcaaaaattagccaggtgtggtggcacgcatctatagtcccagctacttgggaggctgaggcaggagaatggcttaagcctgggaggcagaggttgcagtaagacaagatcacgccactgcactccagcctaggc

SEQ ID NO: 177534 - DNA, 601 bp, Human
acaggagcctgggctagacctgcagggttcctgaaagtggggcattctgggtcatggggtgtcttcatttgggagtctcagaccaagggtatcacacattttgacaaacttgagggacccaagtaggagaaataagtcacttttcccttagctcctatggcatgcacctgcccgccccctctctaaccaaaagtagataaagcacagttccaagatgcgctgacatgttctgcaggcgagagagcctttcgctggactgtgactcacggaggtggtgaggccgctggttctaaccaagagratgccagcgagaccactcagcctcccctggtggctgccctggtttaatgctcatgaaatgccagcctgtggccattctgctgggtaaagagggtggtgtctctggggatttgggcgttccctagaggcacctgccccgcagggggccagacagagttccaggggcttctccacctgccccttcaatggctgttggggcaaaagaatagagcatatggcatcaactctgaaattctgcaggtccccaaacctagcctcagacatgaagtgggggccagcaggggtgtggggagaagggtgt

SEQ ID NO: 177535 - DNA, 601 bp, Human
gattacaagcatgcgccaccacgcccggttaatttttgtatttttagtagagatggggtttcaccatgttgaccaggctggtctccaactcctgaccttagttgatccgcctgccttggccttccaaagtgctgggattacaggcatgagccattgtgcccagcccaagaggtacttttctatttttaattttttatttatttagagacagagtctcactctgtcgcccaggctggagtgccgtgatgcggtctcagctcactgcaatctcggcttcctgagttcaagcgattctcctgcytcagcctcccgggtagctgggactacaggcacgcaccaccatgcctggctaatttttgtatttttagtagagacgaggtttcaccatattggccaggctggtctccaactcctgacctcaggtgatccacccgccttggcctcccaaagtgctgagattataggcatgagccaccgtgcccggccccaagaggtgcttttctaatgctgcttgcgggggtggttggacaggaggatctagggttggactcttaactctgggtcctgattgtgtgaattccagtgtggtgggactgagggg

SEQ ID NO: 177536 - DNA, 601 bp, Human
tcggcctccccaccggggcactccgcctcgccctgggcggccttcccgttcttccgccgcctgggctggtacttgtagtccgggtggtctttcttgtgctgcatacggagccgctcagcctcctcgatgaaggggcgcttgtcactttcgttcagcagcctggggtgtggtgggaggcggagaggacagcagaggggctggcgtgaatgccagagcactccaggttggcctccctctgagtgtccatcttggaagatgtgaggccctgggatggggcacccagaggacaggacccggggtgggggctgtgccctatgatttgtggactgagagatgtgaggcccaaggaataacagcctcagagggctgcccccaaatctttcatgggctggagggtgagagaggggtcagcccgctgctcctggcagcccctgaggaggagttagaagtaggagtagaggtttcaaggggcagatgccagttcaaggaaaggaaaaactttctcatcatcaaagctgtctgcaagtggaattggctacttcagtgggggtgagctccctgggactgagggtgggcaatagaagcagcatggctgggggag

SEQ ID NO: 177537 - DNA, 601 bp, Human
cagaccagaggcagcgccaagtcctgcattggccaagggctctgtacttcaagagacctgcctaggcttttgaatcctggttctgtgtctggacaaatccccagtcttctcttaactagtttccttatcagtaaaatagagattgtaccaagcagcccaggcattgcctctttctggaagccttccttgacaagagtctggtgggcagtggggtgttcttggagacctgactggatgggatagacggccatgccacctctggatctcacacagacttcttgtgcacttgtttctctctctmtatatatactatatatatagtaagagataggaggctgggcgtgctgggtcatgcctgtaatcccagcactttgggaggctgaggtcaggaattcgagaccagcctggccaacacggtgaaaaaccatctctactaaaaatacaataattagctgggtgtggtggcgtgcatctgtaatcccagctacttaggaggctgaggcacaagaatcgcttaaacccaggaggcagacgttgcagtgaaccaagatggcaccgctgcactgcagcctgggcaacagagcaagactccatctcaaac

SEQ ID NO: 177538 - DNA, 601 bp, Human
tagaaaactggtccttgttcctttgtctgttcactttcctattcacatattaatttagcaaactcttagggagcattacaaaatgccaggtactgtgccaggtgctggggatactaatgtaaataaaatggatccctgttcccaaaagctcatagtctagtcatagatccatagatccacatgcacccagagttggaagtgctgtggtgacaatatgcaaggacttgggagatcagaggaggagtccacccgctgcctcagggatttggggaaggtttgatcagggaaggatgtctgagtsgggtggggccttgaagggtgagaaaaagtctgtgtccagtttcattctgaggtggttgctctgtatgtggtccagggtctcctgatgtgtgtgtgtgtgtccctgaatctttgaaggtgaagagtatgtacacgtgtgtgggagggatgactgcctggcatcccaatggagacagaacatgtccatggtcttaagagactaggagctccccaaggacaggcctgtgcctccttcatcagaccagaggcagcgccaagtcctgcattggccaagggctctgtacttcaagagacctgccta

SEQ ID NO: 177539 - DNA, 601 bp, Human
tcctgagggctgatggtcagagtagtcaaactgggggcgggagatggaggggaaggctgagccatagtggggcaggctgagggaggtgtaggcgatctgtgaggtggatggctggtcggtgtagtgtgggggcccctggggccccgcggtctctgtcttcacctgggctttggcatccacaccaggtggtgagaccgtgggcagagccacgcctggtggcttggagatccaggcggagtgtccactggccacggccagggcactgcccagcccatagccggctgctgagtagctgctcacrtggcctgggtgcccattgggcggcaggtactggtccaactcagccacatcaaaggtctccatgttggacattacctcgtggctgatctcaccaatgtccacgttgccgaagtcgatgtgaggcttcccgccctcccccatggagcgcccgtcccgcttcgggtctgccttgcccgactgcagctctgtcttcggggtggttggaggggtgggtgggccatggctctggcctgggtagaagggagacagagagagagagcgcaagggggaagcaggttagaggcaggtgggcgcacgtgaa

SEQ ID NO: 177540 - DNA, 601 bp, Human
aagagaacatatacagaagagcctgactcacaagaggtgatgaacaaacactgccaaatgatacactgaaagacaagggacctcctgctcatccttctctccttgtcttctcattctagccctttccctttccactcctttcaattctgcctatgacccaacagtaaaatcatgtatttgtacagggccatactggttataaagctttaccttctacattttctcattcaaattttgaacctcatggcagacttacgagggcaggaggtacagttcccctgtcacagatgaggaaactgaracttggacagaaaacaggttccaaactccaggcagaaactctaacaaaaacaatgcattcaaaaacaatgcattcagcccaagggtgcagcctcaacgttgccaaaccgaacctgcctgacatcctgttgggcgggtaagaggcaggtgagggaaagacccagaagctagggggaggtattcgttggggtcatgtgggtagcccattaaaaatacggccacaggtccccttgccctgtgccctccctgtcccacacccacaggcttgccccgacccagtcccatgatcaccctggtcaca

SEQ ID NO: 177541 - DNA, 601 bp, Human
agaaacagagaggcatcatagataatctcacagctttgacctgagcaactgaatgaacaatactcctatgtcctaagatgagaaagagagtgggagggacatgttttggtgaagagtggggtcagggatggagggcagaactaacaggagctcaattctaaactcttaagtttgaggcctggcgcggtggctcacacctgtaatcccaccactttgggaggccaaggcaggtggatcacttgagatcaggagttcgagaccagcctggccaacacggtgaaaccccgcctctacaaaaatrcaaaaattagttgggcatgatggcgcatgcttgtaatcccagctacttgggaggctgaggcaggagaatcaggaggtggaggttgcagtgagccgagatcgtgccattgcattccagcctgggtgacagagtgagactctgtctcaaaaaataaataaatcaataaataaatacttcaagtttgaaaagcctaagtttgaggtgctgagtaagcaactagatttgagtatgtcattccagggaaaggtctggactggactggggatataaatttgtgggctgacagaatagagacggcac

SEQ ID NO: 177542 - DNA, 601 bp, Human
tagcgagttccaggaaaagcaaggaagccagtgacatcagagaggcaacagggggccaggcatgtgccatgagaggagaggccactgcaaagaaacaacattttaacaagatcactctggctgggtgtggggtaagaaacagagaggcatcatagataatctcacagctttgacctgagcaactgaatgaacaatactcctatgtcctaagatgagaaagagagtgggagggacatgttttggtgaagagtggggtcagggatggagggcagaactaacaggagctcaattctaaactcttaagtttgaggcctggcgcggtggctcacacctgtaatcccaccactttgggaggccaaggcaggtggatcacttgagatcaggagttcgagaccagcctggccaacacggtgaaaccccgcctctacaaaaatacaaaaattagttgggcatgatggcgcatgcttgtaatcccagctacttgggaggctgaggcaggagaatcaggaggtggaggttgcagtgagccgagatcgtgccattgcattccagcctgggtgacagagtgagactctgtctcaaaaaataaataaatcaataa

SEQ ID NO: 177543 - DNA, 601 bp, Human
attgatcttaaataaatacctgatggagagagatgaaagtcatatgaatagctaggcaaagagagcgtgtgcaaaggccatggggctggaacatgtttagcgagttccaggaaaagcaaggaagccagtgacatcagagaggcaacagggggccaggcatgtgccatgagaggagaggccactgcaaagaaacaacattttaacaagatcactctggctgggtgtggggtaagaaacagagaggcatcatagataatctcacagctttgacctgagcaactgaatgaacaatactcctatktcctaagatgagaaagagagtgggagggacatgttttggtgaagagtggggtcagggatggagggcagaactaacaggagctcaattctaaactcttaagtttgaggcctggcgcggtggctcacacctgtaatcccaccactttgggaggccaaggcaggtggatcacttgagatcaggagttcgagaccagcctggccaacacggtgaaaccccgcctctacaaaaatacaaaaattagttgggcatgatggcgcatgcttgtaatcccagctacttgggaggctgaggcaggagaat

SEQ ID NO: 177544 - DNA, 601 bp, Human
cggccgaattgccacatttaaccctccaaacacctgtaagaaaaggtccaggtctctccacattacacaggaaactggggcacaggttacacagtttgccaggatctgaacccaattaggtggaatccagagcatcaggctcttaatcctcaaactgccttcaggagaaagctgaaagaaggtggctgagcgaggcttgctcaacaggctcttagattccaaaagccaaggccctcgtctcaaaatgcactgctgctcacgtgagccagagcaaaacgtcctttcacaaaaggaaaaagcrtctctttcattcactcggcttggctggaccacagctggaagcaaactgccccgaaactgtcactggagctcccaagcacatgagacaggggtgactttaagagatctttgggctggtggcacggtacagtgtggcccatgttatgactcactccacaaatatttactgagatggattgtggcaggcattgttctaaccgctgaggatacaatcgtaaacaaaacagactggtcaggcacggcagttcactcctgtaatcccagcactttaggaggccaaggaaggaggatcacttaagct

SEQ ID NO: 177545 - DNA, 601 bp, Human
gagactgtctcaaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatccatgggtgagaaaacactgaatgaacacaggggtcatctgagcctctgaacctccaaggcagcctcccggcaaaatgtccccgcaaatgttccctctgaccccagctcaytccaacctctttcctaagttagtgggaaagggcttgatcccatcccctcacaccccatcagcacccactgctgcccagcacccacagggcgccagacgcttcaccacagtttcgggtaaattgccactttttttttttttttttttttgagacagagtttcactcttgttgcccaagctggagtgcaatggcgtgatcttggctcactgcaacctctgcctcccgggttcaagcgattctcctgcctcagtctccagactagctgggattacaggcgcgcaccaccacactcggctaatt

SEQ ID NO: 177546 - DNA, 601 bp, Human
taatcacagctacttgggaggctgaagcaggagaatctttgaacccgagaggcagaggctgcagtgagccgagatcatgccactgcactaaagcttggatgacaaagtgagactgtctcaaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatccrtgggtgagaaaacactgaatgaacacaggggtcatctgagcctctgaacctccaaggcagcctcccggcaaaatgtccccgcaaatgttccctctgaccccagctcactccaacctctttcctaagttagtgggaaagggcttgatcccatcccctcacaccccatcagcacccactgctgcccagcacccacagggcgccagacgcttcaccacagtttcgggtaaattgccactttttttttttttttttttttgagacagagtttcactcttgttgcccaagctggagtgcaatggc

SEQ ID NO: 177547 - DNA, 601 bp, Human
ataatcacagctacttgggaggctgaagcaggagaatctttgaacccgagaggcagaggctgcagtgagccgagatcatgccactgcactaaagcttggatgacaaagtgagactgtctcaaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatcyatgggtgagaaaacactgaatgaacacaggggtcatctgagcctctgaacctccaaggcagcctcccggcaaaatgtccccgcaaatgttccctctgaccccagctcactccaacctctttcctaagttagtgggaaagggcttgatcccatcccctcacaccccatcagcacccactgctgcccagcacccacagggcgccagacgcttcaccacagtttcgggtaaattgccactttttttttttttttttttttgagacagagtttcactcttgttgcccaagctggagtgcaatgg

SEQ ID NO: 177548 - DNA, 601 bp, Human
caagctcacaaagaaacagggaaggcacagccgggcgcggtggctcacacctgtaatcccagcactttgggagggtgagatgggcagatcacctgaggtcagaagttcaagaccagcctggccaacgtgtgagaaaaaaaccccatctctactaaaactacaaaaaaaattagcctggcgtgatggtgggtgcctataatcacagctacttgggaggctgaagcaggagaatctttgaacccgagaggcagaggctgcagtgagccgagatcatgccactgcactaaagcttggatgacaragtgagactgtctcaaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatccatgggtgagaaaacactgaatgaacacaggggtcatctgagcctctgaacctccaaggcagcctcccggcaaaatgtccccgcaaatgttccctctgaccccagc

SEQ ID NO: 177549 - DNA, 601 bp, Human
ctcacaaggccaccatgcctcacggttggcaaagggtttcacacttgtgatccacctccaagctcacaaagaaacagggaaggcacagccgggcgcggtggctcacacctgtaatcccagcactttgggagggtgagatgggcagatcacctgaggtcagaagttcaagaccagcctggccaacgtgtgagaaaaaaaccccatctctactaaaactacaaaaaaaattagcctggcgtgatggtgggtgcctataatcacagctacttgggaggctgaagcaggagaatctttgaacccragaggcagaggctgcagtgagccgagatcatgccactgcactaaagcttggatgacaaagtgagactgtctcaaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatccatgggtgagaaaacactgaatgaacacaggggtcatctgagcctctg

SEQ ID NO: 177550 - DNA, 601 bp, Human
ggatgtcccatgattggaacaactgttggatggtcctggcagcagaacctggcagcagtgacaccctcctgagcaccctcctcccacccagtcaagacagagcaggctggaaactcagggtccactcagagtgccaagctgccccaacttccttcctgtagctccgtctgtgccacacagcacgggagcatgccaccacacaccggcctccgtcctctcacaaggccaccatgcctcacggttggcaaagggtttcacacttgtgatccacctccaagctcacaaagaaacagggaaggcrcagccgggcgcggtggctcacacctgtaatcccagcactttgggagggtgagatgggcagatcacctgaggtcagaagttcaagaccagcctggccaacgtgtgagaaaaaaaccccatctctactaaaactacaaaaaaaattagcctggcgtgatggtgggtgcctataatcacagctacttgggaggctgaagcaggagaatctttgaacccgagaggcagaggctgcagtgagccgagatcatgccactgcactaaagcttggatgacaaagtgagactgtctcaaaaaaaaaaaa

SEQ ID NO: 177551 - DNA, 601 bp, Human
gaacccacaggcagcaggccaggaagcagacctcacaggcttggccacgtgggggattccaggagcacacacagaactgcccgaggtggaaatcaggcctcacgagccccagctgctgacgacaggatgtcccatgattggaacaactgttggatggtcctggcagcagaacctggcagcagtgacaccctcctgagcaccctcctcccacccagtcaagacagagcaggctggaaactcagggtccactcagagtgccaagctgccccaacttccttcctgtagctccgtctgtgccacmcagcacgggagcatgccaccacacaccggcctccgtcctctcacaaggccaccatgcctcacggttggcaaagggtttcacacttgtgatccacctccaagctcacaaagaaacagggaaggcacagccgggcgcggtggctcacacctgtaatcccagcactttgggagggtgagatgggcagatcacctgaggtcagaagttcaagaccagcctggccaacgtgtgagaaaaaaaccccatctctactaaaactacaaaaaaaattagcctggcgtgatggtgggtgcctataatcac

SEQ ID NO: 177552 - DNA, 601 bp, Human
cttgactaagccgagagcagaggagccggacagctgcccgagaggtgcgtgacaggaacccacaggcagcaggccaggaagcagacctcacaggcttggccacgtgggggattccaggagcacacacagaactgcccgaggtggaaatcaggcctcacgagccccagctgctgacgacaggatgtcccatgattggaacaactgttggatggtcctggcagcagaacctggcagcagtgacaccctcctgagcaccctcctcccacccagtcaagacagagcaggctggaaactcagggtycactcagagtgccaagctgccccaacttccttcctgtagctccgtctgtgccacacagcacgggagcatgccaccacacaccggcctccgtcctctcacaaggccaccatgcctcacggttggcaaagggtttcacacttgtgatccacctccaagctcacaaagaaacagggaaggcacagccgggcgcggtggctcacacctgtaatcccagcactttgggagggtgagatgggcagatcacctgaggtcagaagttcaagaccagcctggccaacgtgtgagaaaaaaaccccatct

SEQ ID NO: 177553 - DNA, 601 bp, Human
taggctgagctcactcctagtccaagcaggaaagactccaagccttctgcttccttcttgactaagccgagagcagaggagccggacagctgcccgagaggtgcgtgacaggaacccacaggcagcaggccaggaagcagacctcacaggcttggccacgtgggggattccaggagcacacacagaactgcccgaggtggaaatcaggcctcacgagccccagctgctgacgacaggatgtcccatgattggaacaactgttggatggtcctggcagcagaacctggcagcagtgacaccstcctgagcaccctcctcccacccagtcaagacagagcaggctggaaactcagggtccactcagagtgccaagctgccccaacttccttcctgtagctccgtctgtgccacacagcacgggagcatgccaccacacaccggcctccgtcctctcacaaggccaccatgcctcacggttggcaaagggtttcacacttgtgatccacctccaagctcacaaagaaacagggaaggcacagccgggcgcggtggctcacacctgtaatcccagcactttgggagggtgagatgggcagatcac

SEQ ID NO: 177554 - DNA, 601 bp, Human
ccttcaggagcggccctaagtgatcggactgatccatccccaggcttcggtctggaaagttcagctttatatatagtcagggcacttaggctgagctcactcctagtccaagcaggaaagactccaagccttctgcttccttcttgactaagccgagagcagaggagccggacagctgcccgagaggtgcgtgacaggaacccacaggcagcaggccaggaagcagacctcacaggcttggccacgtgggggattccaggagcacacacagaactgcccgaggtggaaatcaggcctcacsagccccagctgctgacgacaggatgtcccatgattggaacaactgttggatggtcctggcagcagaacctggcagcagtgacaccctcctgagcaccctcctcccacccagtcaagacagagcaggctggaaactcagggtccactcagagtgccaagctgccccaacttccttcctgtagctccgtctgtgccacacagcacgggagcatgccaccacacaccggcctccgtcctctcacaaggccaccatgcctcacggttggcaaagggtttcacacttgtgatccacctccaagct

SEQ ID NO: 177555 - DNA, 601 bp, Human
acaggaacacacaccatgtgagaatgggggtgcatctgttggcttgggctgctcacccaacccgctttgatttgtttccctaagcacctggcatgatgttcctgactcacagtgggtgtttaataagtttggtgaatgaatgaatgagaatgaatgaatgaaccacctataagcccatggggccagcacctctgaagcccccagacacactttattcccttgaaggtgataacagggaccacacactgttcccacccactctgagctgccatgctcctctccacaacggatagggaaataycatgctcaaatcccaccagtagctaacggcccacaaggggttcgctcctccaccgggagaacctgtatctagcacctgcactccttcaggagcggccctaagtgatcggactgatccatccccaggcttcggtctggaaagttcagctttatatatagtcagggcacttaggctgagctcactcctagtccaagcaggaaagactccaagccttctgcttccttcttgactaagccgagagcagaggagccggacagctgcccgagaggtgcgtgacaggaacccacaggcagcaggcca

SEQ ID NO: 177556 - DNA, 601 bp, Human
ctgaatgctcagagcaccagagtgcccttccagcctgcacggttcccaacccagcctgacacccctccatgcccactgtacgatgcaaatccagctgcaggtctccctgctgaccctggccagtggcgccccatgacctcccagggaaagcccagactccagcatccatgagagctggcccaactcacccctccaactcatccctcacctctactccagccacgccgcaccatcgatcttcccagaacacgtcaaactcgtgtctcagtgcacttggggataccacacatacgctccatcrgcgtagcccatcctccccactttcttaacctgaatgtgtgctccacaaaggacaaatgaacaaatctcttcttatccatgaagatacagctcaggtgccatctcctctgaaaattcatacccgcacctccgccctgcagcctggtgtgccttcctcttctccccagcaccccacaccacccagggcccagcccacaggaacacacaccatgtgagaatgggggtgcatctgttggcttgggctgctcacccaacccgctttgatttgtttccctaagcacctggcatgatgttcctgact

SEQ ID NO: 177557 - DNA, 601 bp, Human
agaaactgaggcccagagaggccctgaattgtacatgttcaaagggcaaattaaggccgggcacagtggctcgtgcctgtaattccagcattttgggaggctgaggcagacggattgcttgagcccaggaatttgagaccagcctggggaacatggcaaaaccctgtctctacaaaatataaaataaaattagctgggcatggtggtgtgcgcctgtggtcccagctactcgggaggctaaggcaagaggattgcttgatcctcttgaggtcgagactgcagtgagccaagattgcactaytgcactccagcctgggagacagagcaagaccctgcctcaaaaacaaaacaaaacaaagggcaaattaaagttgatgtccaccaaaaaacaaaaacaaacgggctgggcgcagtggctcacgcctgtaatcccagcactttgggaggttaaggcgggcggatcacgaaatcaggagattgagaccatcctggctaacatggtgaaaccccgtctctactaaaaatacaaaaaaaattagctgggcgtggtggcgggtgcctgtagtcccagctattcgggaggctgaggcaggagaatggc

SEQ ID NO: 177558 - DNA, 601 bp, Human
gcacccccaggatgcccaggtcacctgacacagaccgcacctcggctgtgtcaagcagctctctcaaacaccacaagcagaaagacaaagacccaagacctttggtggtgggggttgacagtgacaattctgcctgtccaagccaggcaatttccaggtaccaattttggtgcccctgctgagggaagccagatatttctggccgttttccttatctctgctcacccatcctctgtcaaaaccaagcttgcctgctgggttcattgagggaagactgacagagagtgtgctggtgtgaggstcccctggaggagctgaaggacgggaggaacaagtattattatcccatcttcccatctcagagatcaagaaactgaggcccagagaggccctgaattgtacatgttcaaagggcaaattaaggccgggcacagtggctcgtgcctgtaattccagcattttgggaggctgaggcagacggattgcttgagcccaggaatttgagaccagcctggggaacatggcaaaaccctgtctctacaaaatataaaataaaattagctgggcatggtggtgtgcgcctgtggtcccagctactcgg

SEQ ID NO: 177559 - DNA, 601 bp, Human
tgcctcacttcatctctccccctggcttctcacagcgtcctacccttgaccttcccgtggggtagacaatcacttttccccactgatgaccggcccctcctcctccttacctgggcttctccctgcacccccaggatgcccaggtcacctgacacagaccgcacctcggctgtgtcaagcagctctctcaaacaccacaagcagaaagacaaagacccaagacctttggtggtgggggttgacagtgacaattctgcctgtccaagccaggcaatttccaggtaccaattttggtgccccygctgagggaagccagatatttctggccgttttccttatctctgctcacccatcctctgtcaaaaccaagcttgcctgctgggttcattgagggaagactgacagagagtgtgctggtgtgagggtcccctggaggagctgaaggacgggaggaacaagtattattatcccatcttcccatctcagagatcaagaaactgaggcccagagaggccctgaattgtacatgttcaaagggcaaattaaggccgggcacagtggctcgtgcctgtaattccagcattttgggaggctgaggcag

SEQ ID NO: 177560 - DNA, 601 bp, Human
ggatgccccccacacacccacgacagcatggccacagaaacgacaggcttggctggcatccagccttcagggtaggcaggaggacgagatgacgcaatggagggaaggtgtctgggacacaggccgactgtgggcacacaaacagtggccattgttatcactaggtggaagaaaggaaatgacagccacggggccacatcctggaacactcacggcattgccaaccaggaaggcgggccagcagggagaaagtgctcacacgtgcttccttctgtccctgccaccttggaccctggagccyaggctcttcccagcacagctgcaagagggggatggtggatgagggccccccgcatcatgcctcacttcatctctccccctggcttctcacagcgtcctacccttgaccttcccgtggggtagacaatcacttttccccactgatgaccggcccctcctcctccttacctgggcttctccctgcacccccaggatgcccaggtcacctgacacagaccgcacctcggctgtgtcaagcagctctctcaaacaccacaagcagaaagacaaagacccaagacctttggtggtgggggttgac

SEQ ID NO: 177561 - DNA, 601 bp, Human
gaggggtgcgcccaggaagggcagagagtcaagagcatccagcacccatgagcctcagattgagggagaaagtcaccaggggtgcagtgaaatcaaagaaagattccacacaccccttcgtcaatggcccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggccgactgtgggcrcacaaacagtggccattgttatcactaggtggaagaaaggaaatgacagccacggggccacatcctggaacactcacggcattgccaaccaggaaggcgggccagcagggagaaagtgctcacacgtgcttccttctgtccctgccaccttggaccctggagcctaggctcttcccagcacagctgcaagagggggatggtggatgagggccccccgcatcatgcctcacttcatctctccccctggcttctcacagcgtcctacccttgaccttcccgtggggtagacaatcacttttc

SEQ ID NO: 177562 - DNA, 601 bp, Human
tccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccacagggacgcggaggggtgcgcccaggaagggcagagagtcaagagcatccagcacccatgagcctcagattgagggagaaagtcaccaggggtgcagtgaaatcaaagaaagattccacacaccccttcgtcaatggsccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggccgactgtgggcacacaaacagtggccattgttatcactaggtggaagaaaggaaatgacagccacggggccacatcctggaacactcacggcattgccaaccaggaaggcgggccagcagggagaaagtgctcacacgt

SEQ ID NO: 177563 - DNA, 601 bp, Human
actgagtaaatattatgcatagaaaaaacaaagcctgatagaaaacaaaccaagatagactgacagaaaacatgccattgagtagatgagggtgctgggtttatgggcttttgttttttccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccacagggacgcggaggggtgckcccaggaagggcagagagtcaagagcatccagcacccatgagcctcagattgagggagaaagtcaccaggggtgcagtgaaatcaaagaaagattccacacaccccttcgtcaatggcccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggccgactgtgggcacacaaacag

SEQ ID NO: 177564 - DNA, 601 bp, Human
aacaaaaatttaactgagtaaatattatgcatagaaaaaacaaagcctgatagaaaacaaaccaagatagactgacagaaaacatgccattgagtagatgagggtgctgggtttatgggcttttgttttttccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccacagggacrcggaggggtgcgcccaggaagggcagagagtcaagagcatccagcacccatgagcctcagattgagggagaaagtcaccaggggtgcagtgaaatcaaagaaagattccacacaccccttcgtcaatggcccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggccgactgtgg

SEQ ID NO: 177565 - DNA, 601 bp, Human
tttgtcaaaacaaaaatttaactgagtaaatattatgcatagaaaaaacaaagcctgatagaaaacaaaccaagatagactgacagaaaacatgccattgagtagatgagggtgctgggtttatgggcttttgttttttccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccrcagggacgcggaggggtgcgcccaggaagggcagagagtcaagagcatccagcacccatgagcctcagattgagggagaaagtcaccaggggtgcagtgaaatcaaagaaagattccacacaccccttcgtcaatggcccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggcc

SEQ ID NO: 177566 - DNA, 601 bp, Human
cattaatcattctgtctgacaaccactctatgaactggttactattattatcctcattttacatatgagaacaccaaagaacagaggggtaaagtcacgggcccagggtcacccagctagtgggtggagcagtgaaagctggcacccagatgggctggcccagagtctgagtttctcaaaggcagctgctcgtcttttcatctccgtccacaagcttggctcacagaaagtttgtcaaaacaaaaatttaactgagtaaatattatgcatagaaaaaacaaagcctgatagaaaacaaacmaagatagactgacagaaaacatgccattgagtagatgagggtgctgggtttatgggcttttgttttttccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccacagggacgcggaggggtgcgcccaggaagggcagagagtcaagagcatccagcacccatgagcctcagat

SEQ ID NO: 177567 - DNA, 601 bp, Human
ctccagcctaggtgacagagtgaagactccgtctcagaaaaaaaaaaaaaaaaattataaagacagggtcttaccacgttgctcaggctggtctcgaacgcccgggttcaagcgatctgcctgcctcagcctctcaaagtgctgggattacaggtgtgagtcaccgtgtctggcctaaaatgttcttgatacaccatcaccagatgccaggttctctctccttgctctgggctctccctcactttaaacacatctgtactatcacagcccagcatgttacaactgcccctcctgccagackgtaagcttcgtcatcctcctaccaaacactcctgtgcatcttgctggcaccatcctgaaagctttacgtacattaatcattctgtctgacaaccactctatgaactggttactattattatcctcattttacatatgagaacaccaaagaacagaggggtaaagtcacgggcccagggtcacccagctagtgggtggagcagtgaaagctggcacccagatgggctggcccagagtctgagtttctcaaaggcagctgctcgtcttttcatctccgtccacaagcttggctcacagaaag

SEQ ID NO: 177568 - DNA, 601 bp, Human
tcgcttgaacctgggaggcggaggttgcggtgagctgagatggcgccattgcactccagcctgggcaacaagagcgaaactccgtctcaaaaaaaaaaaaaaaaagatcataacaactgaagaaaagttcgcagtgtcccattacaaggctcagtgccatctctcaatgatgtctatctggaatgttcttcctctccttttctgtctgagaaagccctgatccttcttcaaatccaagcttggttctcgtggttctcagcctcctccttaaaaatgtttttgttgttgttgttttgaaacwgggtctggctctgttgcccaggctggagtacagtggctcaatcatggctcactgcagcctctacctccttccacctcagcctcctgagtagctaggactacaggtgtgtatcaccaggcctaggtaatttcttccaaacaatttttatagaggccaggcatggtggctcatgcccgtaatcccagcactctgggaggctgaggagggcagatcacttgaggtcaggaatttgagaccagcctgaccaacatggtgaaactccgtctctactaaaaatataaaaaaattagctgggcatgg

SEQ ID NO: 177569 - DNA, 601 bp, Human
agaggacatctgagtggacactgggtcacagccacattcttccctggcctatgtgctgagcacaggatcaaccctggggacagaaggaagacaaaagcaaggggcccactaagaggcacatgaaaaggaaaaaagatcaatactaataattataccaacaaggcacggtggttcacgcctgtaatcccagcactttgggaggccgactcgggcggatcacctgaggtcaggagtttgagaccagcctgaccaacatggagaaaccccgtctctactaaaaatacaaaaaattagccaggcrtggtggcgcatgcctgtaatcccagctacttgggaggctgaggcagaagaatcgcttgaacctgggaggcggaggttgcggtgagctgagatggcgccattgcactccagcctgggcaacaagagcgaaactccgtctcaaaaaaaaaaaaaaaaagatcataacaactgaagaaaagttcgcagtgtcccattacaaggctcagtgccatctctcaatgatgtctatctggaatgttcttcctctccttttctgtctgagaaagccctgatccttcttcaaatccaagcttggttctcg

SEQ ID NO: 177570 - DNA, 601 bp, Human
ggtttcccaaagagctccgagagacagcacacaaaagcaagctccttggaaatgaacgaactgcaccttctgcaggggcaggtgggggagcccctgcagaagatgccattcgagactcaggagcagcagtgtctgggtggtaactttacgctgcatattcagagtcatagtttctgccatggaaattgtccccagtgttgatgatggaattagataccttgttatttcctaggttcccagaaaatacactgccttcctaaggtactgtcaccaaagccaggcgccaatcagacggaggccrccctctgcctctgtgccaagatgtcaccagacaaaagacactaaggacagagtatgggtgccctgggggagagaggacatctgagtggacactgggtcacagccacattcttccctggcctatgtgctgagcacaggatcaaccctggggacagaaggaagacaaaagcaaggggcccactaagaggcacatgaaaaggaaaaaagatcaatactaataattataccaacaaggcacggtggttcacgcctgtaatcccagcactttgggaggccgactcgggcggatcacctgaggtca

SEQ ID NO: 177571 - DNA, 601 bp, Human
tgtggagtctcggaagcccttccctctggtccaagagtacagtctcccctctctcccacccctctccagacccctcagacagagactcaaagaaactgcttctcggccaataagacctccaatccgagacgtgggggagtgaaaggagagaagtatgttcccgctgagcatcacccaccggaatccactctgtgagttcctggggttgaccaggacgcagtcccaggtgcggttgggagtgttctggaacagaatcagctgcccttcctcccgaactcggtcactcgaggtgtagtcggcyacagccacctccttcacccggaatgggttagagaacaagttggtgacgccactgaaggtattgaccaggcggccaaagaactgcatcttctgcggggcaggtggggaggccccaccgtcttccccctctgtctggaagaaaacgaggtctctggtcagccaggcacagtctcccatgcccatctcacccagtgcagcggtttcctgcacagacacccagatcactccccaccagcgttgtccccagatcctgggcctggagggatcttaaaaggaggggaaagaaagagaaacaacactg

SEQ ID NO: 177572 - DNA, 601 bp, Human
tgggccttatctgatgtggacactctcagtctccctgtccttccttcttccctttgtccatataggtcgagcctccaggccagaaacaacccaggcttccatcctcagcctcgtgctgggacactgatgggccagaagtgtggagtctcggaagcccttccctctggtccaagagtacagtctcccctctctcccacccctctccagacccctcagacagagactcaaagaaactgcttctcggccaataagacctccaatccgagacgtgggggagtgaaaggagagaagtatgttcccrctgagcatcacccaccggaatccactctgtgagttcctggggttgaccaggacgcagtcccaggtgcggttgggagtgttctggaacagaatcagctgcccttcctcccgaactcggtcactcgaggtgtagtcggccacagccacctccttcacccggaatgggttagagaacaagttggtgacgccactgaaggtattgaccaggcggccaaagaactgcatcttctgcggggcaggtggggaggccccaccgtcttccccctctgtctggaagaaaacgaggtctctggtcagccag

SEQ ID NO: 177573 - DNA, 601 bp, Human
gcccttaaagagccagggctaggccaggtgcagtggctcacgcctgcaatcccagcactttgggaggccaaggtgggcagatcacctgaggtcaggagtttgagaccagcctggccaatatgatgaaaccccgtctctgctaaaaatacaaaaatcagctgggcgtggtggtgggtgcctgtaatcccagctactcaggaggctgaggcaggagaatcgcttgaacctgggaggcagaggttgcagtgagccgagattgcgccactgcactccagcctgggcaacagagcaagactgtctsaaaaaacaaaaaccaaaaccaaaaataaagagccagggctaaaggttctccccatgggccttatctgatgtggacactctcagtctccctgtccttccttcttccctttgtccatataggtcgagcctccaggccagaaacaacccaggcttccatcctcagcctcgtgctgggacactgatgggccagaagtgtggagtctcggaagcccttccctctggtccaagagtacagtctcccctctctcccacccctctccagacccctcagacagagactcaaagaaactgcttctcggcc

SEQ ID NO: 177574 - DNA, 601 bp, Human
actgtacgttccttaaagacacaggacatgtttgtcatctcacaggccagccaggactggcccgaagcccaggactctggagacactggaggtgcttggtgcatgttgaatggatggctgacaggacagccagatggataggtgagcggaaacagggatatctgtctgagcccaactagatgccagtctgccaagcactgctggggcctgcatttggaaccttggctgcttctccccttttcccaaccagctctgccgttggcccggttccctcaggcctgtcctggcttttgagccttcycttcaggcccaggggagtcccagcatgccccaagaggcaacagctctgtccagccttcctaagcaaaccctgggcagcccctatgagaacggccatgcccttaaagagccagggctaggccaggtgcagtggctcacgcctgcaatcccagcactttgggaggccaaggtgggcagatcacctgaggtcaggagtttgagaccagcctggccaatatgatgaaaccccgtctctgctaaaaatacaaaaatcagctgggcgtggtggtgggtgcctgtaatcccagctactcaggaggct

SEQ ID NO: 177575 - DNA, 601 bp, Human
aacatacttaaaaacatcctgtaaaattgtaatcccagcactttgggaggccgaggcaggcggatcacgaggtcaggagattgagaccatcctggctaacatggtgaaaccccatctctactaaaaatacaaaatattagccaggcgtggtggcgggtgcctgtagtcccagctacttgggaggctgaggcaggagaatggcgtgaacctgggaggcggagcttgcagtaagccgagatcgcgtcactgtactccagcctgggtgacagagcgagactctgtctcaaaaaaaaaaaaaaaagaaaacaaaaaatcctgtaaactataaagtaccacagaatagcttacgtgtagctaagaagctgctgacaaaggactaaatcctcctgggatggaggtctgcccacactggggcttaagctggctgagacaaatctggaatcctgtcaagggattttacaactgacagaacttggtgattattggtacgtggagattagtggtatccccagggccgtgtacctcaaaagtggggctgtccagctctccaaggagtggacccgctgccctggtcagctgtgcctgcagtggagctctgaag

SEQ ID NO: 177576 - DNA, 601 bp, Human
ctcaaaaaaataaatacatacatacatacatggaaacaacacagcagcacagagaaatgaattgggaaccagaagacactgattctgtttcttcactgcttcctgtgtataagtgggatgaatcacttatcatcccaaggctattttctcatgcataaaatggaatactgccttccttgcccacctccacggattggcagagaatgtgctaacccaacatacttaaaaacatcctgtaaaattgtaatcccagcactttgggaggccgaggcaggcggatcacgaggtcaggagattgagwccatcctggctaacatggtgaaaccccatctctactaaaaatacaaaatattagccaggcgtggtggcgggtgcctgtagtcccagctacttgggaggctgaggcaggagaatggcgtgaacctgggaggcggagcttgcagtaagccgagatcgcgtcactgtactccagcctgggtgacagagcgagactctgtctcaaaaaaaaaaaaaaaagaaaacaaaaaatcctgtaaactataaagtaccacagaatagcttacgtgtagctaagaagctgctgacaaaggactaaatcctc

SEQ ID NO: 177577 - DNA, 601 bp, Human
tcgctgtctgtatcagcagggtccagtctctccgcccagcagcagtgctgtgggactctccggccttaggttatacaacccaagaattcagaagctcctaattccatcccccaggtccatccagaagctcagcctggcagctcactgcagcaacagcagcaaaagaacaacagaaactcctccacctggagcggaaggctagcagcccatgctcactctaacacgcgtcaagtactcaggacagtccagaggcctctagggcaacacaggaggaagatcgtttagaaggcagaaactcagycctggccagaggcaagtccagtgcaccaggcctgctctccacagaccgcagggtgttgagaggagctgggagaacactgcaatgaccacccccggccctggagaaccccagggctccagcagtgccctgatgaccctcctccacagcctcgaccccaccccaccccatcgcagccctcactccaggtcacagcctaggccttggcattactgcttctgggacccctgataacctcaaaccctgcatcccagtccccatcctccacctcccacttcccagctcactccttcaactgccctc

SEQ ID NO: 177578 - DNA, 601 bp, Human
ctcacgctagagcagtacctgagtccccagtttcaaagcccagcacaggcccttcctgcccacaggctccccacagggcccctcctctgtcctctgggcctttcctagtaccttgtctctgtagggcctttccctccagctggtggagtcttctggaccccttaaggtctatctctaccccagccaccccagtggagcctttcccacgccctctggtcaacacacttggccttcagcaaccatggatacatctagccactcggcagatatttaccgtgcacccacggagagcgtggcacamcaccaggcatcaggaacgcagaggagacttggccccaggccctgtccctcaggagccctgcagtctggaggggaaacagatgtggaaacagacccacggcaacctaaggcaagaggggctgtgtcttggccacatggggggtgctgaggctctgagtgggaacaggacaggcccacagagcaggagccgtgtgtccagccaaggagttgggaaggagcattcttagcagaaggagaagcaagggcaaagaggccgtgtcggggacaaggcctgtgtagggaatacaaggccccactctaa

SEQ ID NO: 177579 - DNA, 601 bp, Human
acctcagggggtcctggaccaaaaaaaatgccaaggaccctcacgctagagcagtacctgagtccccagtttcaaagcccagcacaggcccttcctgcccacaggctccccacagggcccctcctctgtcctctgggcctttcctagtaccttgtctctgtagggcctttccctccagctggtggagtcttctggaccccttaaggtctatctctaccccagccaccccagtggagcctttcccacgccctctggtcaacacacttggccttcagcaaccatggatacatctagccactcrgcagatatttaccgtgcacccacggagagcgtggcacaccaccaggcatcaggaacgcagaggagacttggccccaggccctgtccctcaggagccctgcagtctggaggggaaacagatgtggaaacagacccacggcaacctaaggcaagaggggctgtgtcttggccacatggggggtgctgaggctctgagtgggaacaggacaggcccacagagcaggagccgtgtgtccagccaaggagttgggaaggagcattcttagcagaaggagaagcaagggcaaagaggccgtgtcgg

SEQ ID NO: 177580 - DNA, 601 bp, Human
tgagctgagagtgtgccactgcactccagcctgggcaacagagcgagactctgtgtcaaaaaaaaaaaaaagaaaaaaaaaaaaaaagaaagtgagagcagtcagcaaaaaggtatgttcccctagccatggtggagaactgaaaccaagcagttctggggtggtgatgccaggatgacgaagagagagagaagcaaggaggcaggaagtataggtgaaggagtgacaatgacaggccatggagtccatgctgggtacaaagcaaggcacatgaacgggatggggctgggaaaagcggccrggagcaattccctgtcaatggggaaaagcactgtgtgggtggaggactagagggaatgaactggaaagacagaaggcagagactggaaagtggggtgcttgaaacttgtatttacgggagagctgctgtcactggcgatgataaaggccagcgcgtggtcatgtgaatgtggagggtcaggaaccagaggcaacgctgagtcaggggctcacatctttgaggatgtgggggagcaccccaggctcgtagatacctatcaccggggtgacagcaagtggtattgtagggtgacagaagatt

SEQ ID NO: 177581 - DNA, 601 bp, Human
catagcaaaaaatatatagtagaaaaggggaaagtgttatgtaggaaagaggggagataattgttcaaatggtgtcaagaagtagatgacaggagatgatggccttgaatggggggaccaccctcagctaaacacatcggtgctgacaacagggaatgtggagtaggcggggacagaggtgtgtgcatggggtagagggaattctcctctggctatttctattttctcagcgagacagcagcagggctatcagctgagagtaagcgtggaggggaaggggctgcaggctgaggggagggarggaggcatgccttctgggagaggggtgaacagagaaatgcagaaagacgtcaaaccacatcataggctcactgtggctcatgtcgtgatttcaaagtgagagcaatagggccgggcagggtggttcatgcctgtaatcccagcactttgggaggccaaggcaggcatatcacctgaggtcaggagttcaagaccagcctggccaccatggcaaaaccctgtctgtactaaaaaaaatacaaaaattagccgggtgtggtggcgggtgcctataataccagctactcaggaggctgaggca

SEQ ID NO: 177582 - DNA, 601 bp, Human
gactgggaggcttaaacaacctttatttctcacagttctagaggctaggaagtctatgatcaaggtgctggctgatagagttcctgatgagggttcacttcctggtttgcagacggctatcttctcgttgtgccctcacatggcagagacagatcatctctttcttgcctcttcgtctaagggcactaatcccattcatgagggctccatcctcatgacctaatcacccccatagtgctctacctcctaataccatcacacgagggattggggcttcaacatatgatttcggggggatacwttcaatccatagcaaaaaatatatagtagaaaaggggaaagtgttatgtaggaaagaggggagataattgttcaaatggtgtcaagaagtagatgacaggagatgatggccttgaatggggggaccaccctcagctaaacacatcggtgctgacaacagggaatgtggagtaggcggggacagaggtgtgtgcatggggtagagggaattctcctctggctatttctattttctcagcgagacagcagcagggctatcagctgagagtaagcgtggaggggaaggggctgcaggctgagg

SEQ ID NO: 177583 - DNA, 601 bp, Human
cactgagctgtatatcattttctctatatgtgttatattttgctatttttgaaaagtttaaagagagaaaacaggaggagaagaatgaagacagtggaatataagcagtctctggaggaaaaagtagagtcaagaaataatttttttttaaagaaaaaaataacccattgtatagcgatggaaaataacttaggtcaggacattataacagaaaactacagactgggaggcttaaacaacctttatttctcacagttctagaggctaggaagtctatgatcaaggtgctggctgatagagytcctgatgagggttcacttcctggtttgcagacggctatcttctcgttgtgccctcacatggcagagacagatcatctctttcttgcctcttcgtctaagggcactaatcccattcatgagggctccatcctcatgacctaatcacccccatagtgctctacctcctaataccatcacacgagggattggggcttcaacatatgatttcggggggatacattcaatccatagcaaaaaatatatagtagaaaaggggaaagtgttatgtaggaaagaggggagataattgttcaaatggt

SEQ ID NO: 177584 - DNA, 601 bp, Human
cctggctaacacggtgaaacctcgtctctactaaaatacaaaaaattagccgggcgtggtggcgggcacctgtagtcccagctactcaggaggctgaggcaggagaatggcgtgaacccaggaggcagagcttgcagtaagcagagattgcgccaccgcactccaacctgggcaacacagtgagactccatctcaaaaaaaaaaagcctttatcataaaaggcaagttattggttacccttctttgggaagaggggacaaaaggagggcttctggggtgctgtaatgtcctatctctagaktcgagtggtggttacacaggtgtttgtgataaatcactgagctgtatatcattttctctatatgtgttatattttgctatttttgaaaagtttaaagagagaaaacaggaggagaagaatgaagacagtggaatataagcagtctctggaggaaaaagtagagtcaagaaataatttttttttaaagaaaaaaataacccattgtatagcgatggaaaataacttaggtcaggacattataacagaaaactacagactgggaggcttaaacaacctttatttctcacagttctagaggct

SEQ ID NO: 177585 - DNA, 601 bp, Human
tgctaacaaagaagccagatagaaaagcctttatcttggccgggggcggtggctcacgcctgtaatcccagcactttgggaggctgaggcaggtggatcacgaggtcaggagatcaagaccatcctggctaacacggtgaaacctcgtctctactaaaatacaaaaaattagccgggcgtggtggcgggcacctgtagtcccagctactcaggaggctgaggcaggagaatggcgtgaacccaggaggcagagcttgcagtaagcagagattgcgccaccgcactccaacctgggcaacasagtgagactccatctcaaaaaaaaaaagcctttatcataaaaggcaagttattggttacccttctttgggaagaggggacaaaaggagggcttctggggtgctgtaatgtcctatctctagattcgagtggtggttacacaggtgtttgtgataaatcactgagctgtatatcattttctctatatgtgttatattttgctatttttgaaaagtttaaagagagaaaacaggaggagaagaatgaagacagtggaatataagcagtctctggaggaaaaagtagagtcaagaaataattt

SEQ ID NO: 177586 - DNA, 601 bp, Human
acccaaattttcatcagtagtagaatgagtaactaaaactgtgatatagtagacaatggaattctattgcaatgaaaatgacagacagctgcacacaaaacgtatcaatctcgccaacaaaatgctaacaaagaagccagatagaaaagcctttatcttggccgggggcggtggctcacgcctgtaatcccagcactttgggaggctgaggcaggtggatcacgaggtcaggagatcaagaccatcctggctaacacggtgaaacctcgtctctactaaaatacaaaaaattagccgggcktggtggcgggcacctgtagtcccagctactcaggaggctgaggcaggagaatggcgtgaacccaggaggcagagcttgcagtaagcagagattgcgccaccgcactccaacctgggcaacacagtgagactccatctcaaaaaaaaaaagcctttatcataaaaggcaagttattggttacccttctttgggaagaggggacaaaaggagggcttctggggtgctgtaatgtcctatctctagattcgagtggtggttacacaggtgtttgtgataaatcactgagctgtatatcatttt

SEQ ID NO: 177587 - DNA, 601 bp, Human
accaagtaacagaagataggaagtaacagaaagtgccatttactgctgcttggaaaacagacgggcggtattatttactaacgttgaagacaagttatggcccataatgcagccagttcacttctaggtatgtctaccagaaatgtatgcatgtatgcaccaaaaaaactagaaataacccaaattttcatcagtagtagaatgagtaactaaaactgtgatatagtagacaatggaattctattgcaatgaaaatgacagacagctgcacacaaaacgtatcaatctcgccaacaaaatkctaacaaagaagccagatagaaaagcctttatcttggccgggggcggtggctcacgcctgtaatcccagcactttgggaggctgaggcaggtggatcacgaggtcaggagatcaagaccatcctggctaacacggtgaaacctcgtctctactaaaatacaaaaaattagccgggcgtggtggcgggcacctgtagtcccagctactcaggaggctgaggcaggagaatggcgtgaacccaggaggcagagcttgcagtaagcagagattgcgccaccgcactccaacctgggcaacaca

SEQ ID NO: 177588 - DNA, 601 bp, Human
gtgcgtgcctgtagtcctggctactcaggaggctgaggcaggaggatcacttgagcctgggaagttgaggctgcagtgagccatgatcatgccactgaagtttggcctgggtgagagagagatagatgaaaggaaggaaggaaggaaggaaggaaggaaggaaggagatcttcaacaatttttagaaaataggagaaagaaggaatgcttctcaaagctttaagatagagaaggacttccttaaacaagacacaaaaagtacaccgtaaagaagatgaacaaatttgacttcattaaaacwaagaactcatgtttatcaatagataccattaaaagaataaaaaggcaaaacaccgtgtgtgcagctgaacacgtatcactgacaaaaggtgtgtatttggactgcacatgtaccaaaaaactcctcctaaaactctgtaagaaaaagataaacaactttattttttaaatagtcaagagaattgagctgatacttcactgaagaggatatccaaatggttaatcactgtatcaaaaagtgctcaacttcatttgcaatcaggcaaatgcaaaataaaaccacaataacatactactagac

SEQ ID NO: 177589 - DNA, 601 bp, Human
gacatgtgactcatgcctgtaatcccagcactttgggaggctgaggtgggaggattgtttgagcccaggagttcaagaccagcctgggtaacttgatgagaccgtgtctctacaaaaaatttttaaaattagccaggtatggtggtgcgtgcctgtagtcctggctactcaggaggctgaggcaggaggatcacttgagcctgggaagttgaggctgcagtgagccatgatcatgccactgaagtttggcctgggtgagagagagatagatgaaaggaaggaaggaaggaaggaaggaaggaaggaaggagatcttcaacaatttttagaaaataggagaaagaaggaatgcttctcaaagctttaagatagagaaggacttccttaaacaagacacaaaaagtacaccgtaaagaagatgaacaaatttgacttcattaaaactaagaactcatgtttatcaatagataccattaaaagaataaaaaggcaaaacaccgtgtgtgcagctgaacacgtatcactgacaaaaggtgtgtatttggactgcacatgtaccaaaaaactcctcctaaaactctgtaagaaaaagataaacaac

SEQ ID NO: 177590 - DNA, 601 bp, Human
tagacatgtgactcatgcctgtaatcccagcactttgggaggctgaggtgggaggattgtttgagcccaggagttcaagaccagcctgggtaacttgatgagaccgtgtctctacaaaaaatttttaaaattagccaggtatggtggtgcgtgcctgtagtcctggctactcaggaggctgaggcaggaggatcacttgagcctgggaagttgaggctgcagtgagccatgatcatgccactgaagtttggcctgggtgagagagagatagatgaaaggaaggaaggaaggaaggaaggaaggaaggaaggagatcttcaacaatttttagaaaataggagaaagaaggaatgcttctcaaagctttaagatagagaaggacttccttaaacaagacacaaaaagtacaccgtaaagaagatgaacaaatttgacttcattaaaactaagaactcatgtttatcaatagataccattaaaagaataaaaaggcaaaacaccgtgtgtgcagctgaacacgtatcactgacaaaaggtgtgtatttggactgcacatgtaccaaaaaactcctcctaaaactctgtaagaaaaagataaaca

SEQ ID NO: 177591 - DNA, 601 bp, Human
aatgggattggtgccatttaaaaagcggcttgccaggcacactggctcacacttgtaatcccagcactttgggaggccgaggcgggtggatcatctgaggtcaggagttcgagaccagcctggccaatatggtgaaaccccacctctactaaaaataaaaaaaattagccgggtgtggtggtgggcgcctgtaatcccagctactcaggttttcaaaaaataaacaaagccaaaagttggttctttggaaagattttttaaattggcaaatcactagcaaaaccaaacaagaaatagagamaacacaaagtaccatcccttcagatcctccatacattaaaaaggaaataaggggacctgcagacaaatttgacaacttcgataaaatagaaaaattccttgaaaacacaacatacccaaaccgacatgagatgaaaatctcatagtcctatatttgttaaagaaatcgaatccatgttttaaaagcttcccacaaataaactccagggtcacatggttttacccatgaattcttccaaacatttaagaaagaaagaatacaggctagacatgtgactcatgcctgtaatcccagcacttt

SEQ ID NO: 177592 - DNA, 601 bp, Human
ctgttttatatatgttccatggtctgaatgtttgtgtcttcctaaaattcttatgttaaaacttaattctcagtgtgatagtattaagaaatggggccattaggaggtaattcgatcatcagggctctgccctcatgaatgggattggtgccatttaaaaagcggcttgccaggcacactggctcacacttgtaatcccagcactttgggaggccgaggcgggtggatcatctgaggtcaggagttcgagaccagcctggccaatatggtgaaaccccacctctactaaaaataaaaaaaattagccgggtgtggtggtgggcgcctgtaatcccagctactcaggttttcaaaaaataaacaaagccaaaagttggttctttggaaagattttttaaattggcaaatcactagcaaaaccaaacaagaaatagagaaaacacaaagtaccatcccttcagatcctccatacattaaaaaggaaataaggggacctgcagacaaatttgacaacttcgataaaatagaaaaattccttgaaaacacaacatacccaaaccgacatgagatgaaaatctcatagtcctatatttgttaaaga

SEQ ID NO: 177593 - DNA, 601 bp, Human
acgaacacatggaaatgaaataatatgctcttgaatggtcaatgaagaaattaagaaggaaatttaaaaacatcctgaaacaaatgataatggaaacacaacatatcaaaacctgtgagatacagggaaagaagtactaagaggaaagttgtacctataagcacctacatcaagtaagtagaaaaacttcaaaataatctaatgatgtctcttaaagaactagaaaagagcaaaccaaacccaaaattagtagaagaaaagaaataataaagatcatagcagaaataaatgaaattgaaayaaaacaatacaaaagatcaacaaaataaagttttttgaaaagataaacaaaatcaataaatctttaactagactaacaaaaaaagagagaaaacccaaacaaaaaaatcagaaatgacaaaagagatattacaaccaatatcacagaaactcaaaggattattagaggttactgtgaacaattatatgccaataaattgaaaaccctagaagaaatggataaattcctaggcatacacaacctaccaagatggaaccgtgaagaaatccaaaacctaaatagaccaataacaagtaatga

SEQ ID NO: 177594 - DNA, 601 bp, Human
ggttcacaccattctcctgcctcagcctcctgagtagctgggactacaggcacctgccaccatgcctggctaattttttgtatttttagtagagacggggtttcactgtgttagccaggatggtctcgatctcctgacctcgtgatctgcctgcctcggcctcccaaagcgctgggattacaagcatgagccacttctcccagccaaattactttttaaatttgaaatcatatcaagtatcttctgtgatcacaatgaaataaaactacaaatcaaaaacaaggtattttgcacaccataygaacacatggaaatgaaataatatgctcttgaatggtcaatgaagaaattaagaaggaaatttaaaaacatcctgaaacaaatgataatggaaacacaacatatcaaaacctgtgagatacagggaaagaagtactaagaggaaagttgtacctataagcacctacatcaagtaagtagaaaaacttcaaaataatctaatgatgtctcttaaagaactagaaaagagcaaaccaaacccaaaattagtagaagaaaagaaataataaagatcatagcagaaataaatgaaattgaaaca

SEQ ID NO: 177595 - DNA, 601 bp, Human
tagaaacctccaccaattgtcctccctggaggaaaaccaaattgaactatacacacaaaaaagtaccttcataaaaagcaaaaatcagcctaggtaccagctcagctacagtgtggcagagcaccaagagggctcttggggtcccagattctaagtgttggctgtggggtggcagttctggacctgccctgggtcagaggggagcccactaccctaaagggagagtcccaggcctggcagtgttcagttgcttcaagagcccttaggccctgaatgaacgttggcagtggcctggcagcaytgccacagggctggggcagtggtggccatggagagagacttctctgcttgtggaaaggggagggaagagcaggaaggactttgccttatggcttgggtatcagccaggctgtaatagaatagagcactggggagattactaaggtttctgactgcaggccctgcctcccagatggcatctaaggaccttcccaggatgggggtagggggaacttgctgccttgaagggaaggacataatctcactggcttcaccacctgctgactgtagagccctagtgccttaagcaaacgtaggcagt

SEQ ID NO: 177596 - DNA, 601 bp, Human
aaagatgcccaaatagaaacctccaccaattgtcctccctggaggaaaaccaaattgaactatacacacaaaaaagtaccttcataaaaagcaaaaatcagcctaggtaccagctcagctacagtgtggcagagcaccaagagggctcttggggtcccagattctaagtgttggctgtggggtggcagttctggacctgccctgggtcagaggggagcccactaccctaaagggagagtcccaggcctggcagtgttcagttgcttcaagagcccttaggccctgaatgaacgttggcagyggcctggcagcactgccacagggctggggcagtggtggccatggagagagacttctctgcttgtggaaaggggagggaagagcaggaaggactttgccttatggcttgggtatcagccaggctgtaatagaatagagcactggggagattactaaggtttctgactgcaggccctgcctcccagatggcatctaaggaccttcccaggatgggggtagggggaacttgctgccttgaagggaaggacataatctcactggcttcaccacctgctgactgtagagccctagtgccttaagc

SEQ ID NO: 177597 - DNA, 601 bp, Human
aaaaaaaaaaagatgcccaaatagaaacctccaccaattgtcctccctggaggaaaaccaaattgaactatacacacaaaaaagtaccttcataaaaagcaaaaatcagcctaggtaccagctcagctacagtgtggcagagcaccaagagggctcttggggtcccagattctaagtgttggctgtggggtggcagttctggacctgccctgggtcagaggggagcccactaccctaaagggagagtcccaggcctggcagtgttcagttgcttcaagagcccttaggccctgaatgaacrttggcagtggcctggcagcactgccacagggctggggcagtggtggccatggagagagacttctctgcttgtggaaaggggagggaagagcaggaaggactttgccttatggcttgggtatcagccaggctgtaatagaatagagcactggggagattactaaggtttctgactgcaggccctgcctcccagatggcatctaaggaccttcccaggatgggggtagggggaacttgctgccttgaagggaaggacataatctcactggcttcaccacctgctgactgtagagccctagtg

SEQ ID NO: 177598 - DNA, 601 bp, Human
aggtattcctttatagcaacactaaacagacaaaaacaggtagtcaatgtctctgctagcaggatgtatggaaatatgagagagactcttggagaacgatctcccaacagttactactaaaaagtgtataacttccaagctaagagacagaaaaaacagaatcatatgaaaacgctcaatcacaaattgcaaaagcattatgctaagtgaaaaagtcagactcataagactacacgctatatgattaaaagcagcagtgatggaatgcacataggtataggaagacgtcctcctgcggggwaaaaaaaaaaggaagcacataggtgttgcccagggatggggtgggtgccatggactataaaggagggtgaaggaaatttggagaataacagaaatgtcttatatcttgattgtggtggtggttacatgggggtgttctgttatcaaatgaaggtggaggcaaagcaagatggccaaatagggctgggcgcggtggctcatgcctgtaatcccagcactttgggaggccgaggtgcgtggatcacctgaagtcaggagtttgagaccagcctggccaacacggagaatccccgtccctact

SEQ ID NO: 177599 - DNA, 601 bp, Human
cctccacctcctggattcaagaaattctcctgcctcagcctcccgagtagctaggattacaggcatgcaccaccatgcccagctaatttttttgtattttttttagtagagacagggtttctccatgttggtcaggctggtctcaaaactcccgacctcaggtgatccactcgccttggccacccaaagtgctgggattacaggcacgagccactgtgcctggcccgtgcctggcactttttaacaaccagttaacaacttattttctcttcctcacttcctttcttgccatgtgacactrgtaagatgctggcaccatgtttcttgtatggcctgaggagccatgagacaaataaaacctcttttctatgtataatactcagacttaggtattcctttatagcaacactaaacagacaaaaacaggtagtcaatgtctctgctagcaggatgtatggaaatatgagagagactcttggagaacgatctcccaacagttactactaaaaagtgtataacttccaagctaagagacagaaaaaacagaatcatatgaaaacgctcaatcacaaattgcaaaagcattatgctaagtgaaaaa

SEQ ID NO: 177600 - DNA, 601 bp, Human
agagcctggcactttttttttctttgagacagagtttcgctcttgtcgcccaggtgatcttggctcactgcaacctccacctcctggattcaagaaattctcctgcctcagcctcccgagtagctaggattacaggcatgcaccaccatgcccagctaatttttttgtattttttttagtagagacagggtttctccatgttggtcaggctggtctcaaaactcccgacctcaggtgatccactcgccttggccacccaaagtgctgggattacaggcacgagccactgtgcctggcccgkgcctggcactttttaacaaccagttaacaacttattttctcttcctcacttcctttcttgccatgtgacactggtaagatgctggcaccatgtttcttgtatggcctgaggagccatgagacaaataaaacctcttttctatgtataatactcagacttaggtattcctttatagcaacactaaacagacaaaaacaggtagtcaatgtctctgctagcaggatgtatggaaatatgagagagactcttggagaacgatctcccaacagttactactaaaaagtgtataacttccaagct

SEQ ID NO: 177601 - DNA, 601 bp, Human
catgaatgaatgccctccctgtggggtgggggtgagtgagttttcactctattagttcctgtaagaactggttgttaaaaagagcctggcactttttttttctttgagacagagtttcgctcttgtcgcccaggtgatcttggctcactgcaacctccacctcctggattcaagaaattctcctgcctcagcctcccgagtagctaggattacaggcatgcaccaccatgcccagctaatttttttgtattttttttagtagagacagggtttctccatgttggtcaggctggtctcaaaactcccgacctcaggtgatccactcgccttggccacccaaagtgctgggattacaggcacgagccactgtgcctggcccgtgcctggcactttttaacaaccagttaacaacttattttctcttcctcacttcctttcttgccatgtgacactggtaagatgctggcaccatgtttcttgtatggcctgaggagccatgagacaaataaaacctcttttctatgtataatactcagacttaggtattcctttatagcaacactaaacagacaaaaacaggtagtcaatgtctctgctagca

SEQ ID NO: 177602 - DNA, 601 bp, Human
atgagaattctgtacttagcacacaaaacaaaatgaaaacaaaaacaaaaccttcaagaataaggttaaaattaaaacatttctctagtcaaacaaaaaacccagagactttgtcattagcagacctacacgaaaggaaatacaaaagctttttctttccttcttttttttttttggagacatggtctcactcctgtcacccacgctggagtgcagtggtgcaatcaacgctcactgcagcctcaacctcccaggtttaagtaatcctcccacctcagcctcccgagtagcagggacgtgmaccaccacacctggctaattttttgtattttcagtagagacagggttttgccacgtagcccaggctggtctggaaatcctgggctcaagcgatcctcccgcctaggcttcccaaagtgctgggattacaggtgtgagccatcgtgctgggccaaaagctttctcttcatgtggaatgaacacgatcctagatggatgcttaaagaggcatgaaagaatgaagcaccatggcaagttaaatatgtggggggatctaaataagtattgatggtatagcgtcttgttgggtttaaaataaaaa

SEQ ID NO: 177603 - DNA, 601 bp, Human
agctactcaggaggttgagggaggagaatcgcttgaacctgggaggcggagatcgtgccactgtactctagcctgggccacagagcaagactctgtctctaaataaataaatgccaatgagaattctgtacttagcacacaaaacaaaatgaaaacaaaaacaaaaccttcaagaataaggttaaaattaaaacatttctctagtcaaacaaaaaacccagagactttgtcattagcagacctacacgaaaggaaatacaaaagctttttctttccttcttttttttttttggagacatgrtctcactcctgtcacccacgctggagtgcagtggtgcaatcaacgctcactgcagcctcaacctcccaggtttaagtaatcctcccacctcagcctcccgagtagcagggacgtgaaccaccacacctggctaattttttgtattttcagtagagacagggttttgccacgtagcccaggctggtctggaaatcctgggctcaagcgatcctcccgcctaggcttcccaaagtgctgggattacaggtgtgagccatcgtgctgggccaaaagctttctcttcatgtggaatgaacacga

SEQ ID NO: 177604 - DNA, 601 bp, Human
tcacttgagctcaggagtttgagatcagcctgggcaacacggtgaaaccccgtctctactaaaaatacaaaaattagtcaggtgtagtggtgcatgcctgtagccccagctactcaggaggttgagggaggagaatcgcttgaacctgggaggcggagatcgtgccactgtactctagcctgggccacagagcaagactctgtctctaaataaataaatgccaatgagaattctgtacttagcacacaaaacaaaatgaaaacaaaaacaaaaccttcaagaataaggttaaaattaaaayatttctctagtcaaacaaaaaacccagagactttgtcattagcagacctacacgaaaggaaatacaaaagctttttctttccttcttttttttttttggagacatggtctcactcctgtcacccacgctggagtgcagtggtgcaatcaacgctcactgcagcctcaacctcccaggtttaagtaatcctcccacctcagcctcccgagtagcagggacgtgaaccaccacacctggctaattttttgtattttcagtagagacagggttttgccacgtagcccaggctggtctggaaat

SEQ ID NO: 177605 - DNA, 601 bp, Human
aaagggcaaccattagaatgacagctggcttctcaacaatggaacccagagataatggaatgacttccttaaagagctgaaaagaaaataaatgctggccaggcacggcggctcatgcctataatcccagcactttgggaggccaaggcaggcaaatcacttgagctcaggagtttgagatcagcctgggcaacacggtgaaaccccgtctctactaaaaatacaaaaattagtcaggtgtagtggtgcatgcctgtagccccagctactcaggaggttgagggaggagaatcgcttgaamctgggaggcggagatcgtgccactgtactctagcctgggccacagagcaagactctgtctctaaataaataaatgccaatgagaattctgtacttagcacacaaaacaaaatgaaaacaaaaacaaaaccttcaagaataaggttaaaattaaaacatttctctagtcaaacaaaaaacccagagactttgtcattagcagacctacacgaaaggaaatacaaaagctttttctttccttcttttttttttttggagacatggtctcactcctgtcacccacgctggagtgcagtggtgc

SEQ ID NO: 177606 - DNA, 601 bp, Human
gcagaggaaaaaaagttatcttcaaagggcaaccattagaatgacagctggcttctcaacaatggaacccagagataatggaatgacttccttaaagagctgaaaagaaaataaatgctggccaggcacggcggctcatgcctataatcccagcactttgggaggccaaggcaggcaaatcacttgagctcaggagtttgagatcagcctgggcaacacggtgaaaccccgtctctactaaaaatacaaaaattagtcaggtgtagtggtgcatgcctgtagccccagctactcaggaggytgagggaggagaatcgcttgaacctgggaggcggagatcgtgccactgtactctagcctgggccacagagcaagactctgtctctaaataaataaatgccaatgagaattctgtacttagcacacaaaacaaaatgaaaacaaaaacaaaaccttcaagaataaggttaaaattaaaacatttctctagtcaaacaaaaaacccagagactttgtcattagcagacctacacgaaaggaaatacaaaagctttttctttccttcttttttttttttggagacatggtctcactcctgtca

SEQ ID NO: 177607 - DNA, 601 bp, Human
aactaccagccaacagccagcaccaacttgccagttgcgagttaccttatatggtgccatataaagtaaagctgaggctttcccactgagctctgctcaaattgcagatttaaggactaaataaatgattccttttataagccactgtgttctggagtagtttgttacacagcaataactgataatgatacatatgttgcacaatatgtattgtatgtaacataacaattgctgatatatgtgccacattacacctgttgaaaataaaatacaaggaggaaatatttaaaatagcagaggraaaaaagttatcttcaaagggcaaccattagaatgacagctggcttctcaacaatggaacccagagataatggaatgacttccttaaagagctgaaaagaaaataaatgctggccaggcacggcggctcatgcctataatcccagcactttgggaggccaaggcaggcaaatcacttgagctcaggagtttgagatcagcctgggcaacacggtgaaaccccgtctctactaaaaatacaaaaattagtcaggtgtagtggtgcatgcctgtagccccagctactcaggaggttgaggga

SEQ ID NO: 177608 - DNA, 601 bp, Human
tataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagccccagaaatccaygcttagcaccttgtaggggttttaaaacagggccccctaaaatcactgatattccttgcactgagcagtgggaatttgtatctctttaccctttaatctggcgatgtaactgcgttaccaacagaatatggcaaaagtgatgccgtcccagcttccagaccaatgccttaagagactggaagtttctatttctcttctcttgggacccagccatcatgcctcaaggaggctgaagcaagccatggtgacgactcttggtcctgggccctgagccctgaatgaactaccagccaacagcca

SEQ ID NO: 177609 - DNA, 601 bp, Human
ctactaaaaatataaaaattagccgggcgtggcagtgggtgcctataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagccccagaaatccacgcttagcaccttgtaggggttttaaaacagggccccctaaaatcactgatattccttgcactgagcagtgggaatttgtatctctttaccctttaatctggcgatgtaactgcgttaccaacagaatatggcaaaagtgatgccgtcccagcttccagaccaatgccttaagagactggaagtttctatttctcttctcttgggacccagccatcatgcctcaaggaggctgaagcaagccatggtgacgactcttg

SEQ ID NO: 177610 - DNA, 601 bp, Human
tgaggtcaggaattccagactagccatggcgaaaccccatgtctactaaaaatataaaaattagccgggcgtggcagtgggtgcctataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacatacccyataagccctccctgaccccaccaccaaaaaaaaaaaaaaaaacacatagaaaaaaacaaaaaacaagaaagccccagaaatccacgcttagcaccttgtaggggttttaaaacagggccccctaaaatcactgatattccttgcactgagcagtgggaatttgtatctctttaccctttaatctggcgatgtaactgcgttaccaacagaatatggcaaaagtgatgccgtcccagcttccagaccaatgccttaagagactggaagtttctatttctcttctcttgggacccagccatc

SEQ ID NO: 177611 - DNA, 601 bp, Human
aaaactgatttttaaaaaacattataggtcaggcacagtggctcatacctgtaatcccaccactttgggaggccaaggtgggtggatcacctgaggtcaggaattccagactagccatggcgaaaccccatgtctactaaaaatataaaaattagccgggcgtggcagtgggtgcctataatcccagctacttgggaggctaaggcaggggaattgcttgaaccagcggggcggaggttgcagtgagccgagatcacgctacttcactccagcttaggcaaaagagtgaaactccatctcygatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagccccagaaatccacgcttagcaccttgtaggggttttaaaacagggccccctaaaatcactgatattccttgcactgagcagtgggaatttgtatctctttaccctttaatctggcgatgtaactgcgttaccaacag

SEQ ID NO: 177612 - DNA, 601 bp, Human
tagtagagtacataagagacacagactatctaataaaagatctagcatacatacataagtggaggatcagaggcagagtagaaaaagaatcaaatggaagctacatttgaaaagttaatgtctgcaaactttccaaaactgatttttaaaaaacattataggtcaggcacagtggctcatacctgtaatcccaccactttgggaggccaaggtgggtggatcacctgaggtcaggaattccagactagccatggcgaaaccccatgtctactaaaaatataaaaattagccgggcgtggcrgtgggtgcctataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagcccc

SEQ ID NO: 177613 - DNA, 601 bp, Human
tttaagttatccaaaatagactttaaagtaactgtgataacattcgagaggttaaaaaaggaaatttagaattttggtgaagagttttgaatgatcaaaaaagcatcaaatggaaattacaaaattaaaaaatataatcaggaaagagtaaacagaataaagcatggagagacagaagaatacaaaatatagtagagtacataagagacacagactatctaataaaagatctagcatacatacataagtggaggatcagaggcagagtagaaaaagaatcaaatggaagctacatttgaaragttaatgtctgcaaactttccaaaactgatttttaaaaaacattataggtcaggcacagtggctcatacctgtaatcccaccactttgggaggccaaggtgggtggatcacctgaggtcaggaattccagactagccatggcgaaaccccatgtctactaaaaatataaaaattagccgggcgtggcagtgggtgcctataatcccagctacttgggaggctaaggcaggggaattgcttgaaccagcggggcggaggttgcagtgagccgagatcacgctacttcactccagcttagg

SEQ ID NO: 177614 - DNA, 601 bp, Human
cggaaggaagccattcctcattgcccttggctgggtttttccttcatctcaccagcctctcaacatcagggtactccacatcaagtgttgccgatatgtcagagaatgacaactgaaaactcatcactggaattagcatcacggaggcatgcacgaccttgacaacattacttttagtggaatggagggaaccaaggcctgattaaagtgggtttaaggacacaatgtgagaatctgaagattgcaaagatagatatttttgaggagttttgctgtggtgaggagcaaataaaggaaaggrtagcgaatggggaaagtgtaatcaggcatttgaatgctgacgggaacgatgattctctctcagaacttccactttccattaacagcagactagggaatgtgaaacagaccacctactgaggacagccagaaatgctggacaaattattaaaaaacatctgctggcaggcactggatacctcaaaagacactgatgactcaccaggctggaaggaatgatggaaacccaggaattgcagtgttcaggtggctgttactggagaggatgggcagacgagcagcaccagtaacagcctcatgg

SEQ ID NO: 177615 - DNA, 601 bp, Human
catgttggccaggctgatcttaaactcctggcctcaggtgacctgcctgcctgggcctcccaaagtgctaggattacaggcatgagccactgcgcccggccagctttgttcatttttaagtgttgaggttgagtccaagttttgctactaaggtgctgtgtgatcttgggaaatccttttccctctctgagccccatttgaaacatgagactaactgtacctgtcctacctacctcccagaggtgctgtgaggacagatgaaaaaccactataaaagcactttcaaaaccataaccattayatgtcagtgatggttacttaaagttctgaccagggcttttaacataccaaaaggttttgtcttgcatacctctacaagcgcagcagccagccagagtctagtgaaggcagtgcccagagagtgttggctcaacgggaccagcctgttgttccacagagagtgcgttgattaacagttaactactgggcatgtgatctgtgccaaatggaggggtcaattaatgaacaattgcataaaatgctctgccctcctgaagccttttttttttttttttttttgagacagagtctcactctgtta

SEQ ID NO: 177616 - DNA, 601 bp, Human
ggatttcaggcactagccaccgtgagccactgtgcctggcctaatttttttttatttttgttgacagggggtcttgctatgttgcccaggctggtcttgaactcctggcctcaagtgttcctcctgcctcagcctccaaaagtactgggattacaggtgtgagccactatgcttgtctagattttcctttattttgaaaaactttccttttctttggtaatatcatttattatttttatattttattttaccacagccctgccatatccactttctaatttcattgccacatgtgagagcyccagcctcgagtacttggcccctcttcatagtaggaactaagtaagtattgtttaacctaaatgtacagcaacaaaatattatataaattatggtataactatgtaataaactattatgcagtcattaaaatgagatatttaaaaaaagggaaacttttctttttcttttcttttcttttttttttttttgagatggagtttcattcttgttgcccaggctggagtacaatggcacgatctcggctcactgcagcctccatctcccaggttcaagtgattctcctgcctcagcctcctga

SEQ ID NO: 177617 - DNA, 601 bp, Human
cacctggctaattttttgtgtttttagtagagatggggtttggccatgttgcccaggctggtctcgaactcctgagctcaggcaatccacccccctcagcctctcaaagtgctaggatttcaggcactagccaccgtgagccactgtgcctggcctaatttttttttatttttgttgacagggggtcttgctatgttgcccaggctggtcttgaactcctggcctcaagtgttcctcctgcctcagcctccaaaagtactgggattacaggtgtgagccactatgcttgtctagattttcytttattttgaaaaactttccttttctttggtaatatcatttattatttttatattttattttaccacagccctgccatatccactttctaatttcattgccacatgtgagagctccagcctcgagtacttggcccctcttcatagtaggaactaagtaagtattgtttaacctaaatgtacagcaacaaaatattatataaattatggtataactatgtaataaactattatgcagtcattaaaatgagatatttaaaaaaagggaaacttttctttttcttttcttttctttttttttt

SEQ ID NO: 177618 - DNA, 601 bp, Human
attttttttttttttgagatagagtctcattttgtcacccaggctggagtgcagtgttgtaatctcacctcactgcgaccttcacctcccgggttcaagcaattctcctacctcagtctccagagtagctgggattaaaggcgtgtgctgccacacctggctaattttttgtgtttttagtagagatggggtttggccatgttgcccaggctggtctcgaactcctgagctcaggcaatccacccccctcagcctctcaaagtgctaggatttcaggcactagccaccgtgagccactgtrcctggcctaatttttttttatttttgttgacagggggtcttgctatgttgcccaggctggtcttgaactcctggcctcaagtgttcctcctgcctcagcctccaaaagtactgggattacaggtgtgagccactatgcttgtctagattttcctttattttgaaaaactttccttttctttggtaatatcatttattatttttatattttattttaccacagccctgccatatccactttctaatttcattgccacatgtgagagctccagcctcgagtacttggcccctcttcatagta

SEQ ID NO: 177619 - DNA, 601 bp, Human
aatcccggcattttgggaggctgaggcaggtggatcacttaaggccaggagttggagaccagcctgggcaacatggcaaaaccccatccctactaaaaatacggaaactacccaggcatggtggcacatgcctgtaatcccagctactcaggaagctgaggcacgagcatcacttcaacccaggaggtggaggttgcagtgagccgagatcgcaccactgcactctagcctgggagacatagggaaactctgtctcaaaaaaaaaaaaaaaaaaaaaaaaaaaggaatccacattttctgstataacgtagttgcattctgatgccaaggcagagagaacatgatctttagaagaattttctaattctagacaataaaacataatccaacatcctgccttttctgttcaatctaatatatgaaatagctatttaatagtatcaccccatctgcttgcccacaattaaaaaatcacatcttttgcccaggtaatcaaaaacgttaacaggagggcctctggcacaaatgcctacaggaactggagacagtttggtttgcttggtttgaattcctgtaaaatagggttgtccaatattttggc

SEQ ID NO: 177620 - DNA, 601 bp, Human
gactccgtctcaaaaaaaaaaaaaattagcccatgtggtggcacgagcctgtagtcccagctgctcaggaggctgaggtgggaggatcacctgagtccaggaggttgaggctgcagtgagccacaatcacaccactgcactccagcctgggcgacagagctagatgctgtctcaaaaaaaagaaagtgctaggagggttttactgtctcacttttggctcagtgctgtccccatgaggttcattacaaccacagtgtacccatgtgacaccagggtcacctcacagcagtcccactggacytgaaggcaggccagagacacagcaggaagagcaaagggctggcatcgaggccaatgtaaggtcaagccccactctctcagctttgtggccctccctgggcacgcttcttaattaacaacactgaacctcagtttcttcggagaggaaaggggaataatgacctccaccccatgagtgtattctaagaattaactggaacacatacaacactcagttcaaggtcaggcaccaatcagcaccggataaaggacagctgcagtcgtgcatgactatcgagaagcgggtgtgcacacccccgca

SEQ ID NO: 177621 - DNA, 601 bp, Human
cactgggaggtgagaggatcacttgagaccaagagtgtgataccagcctcggcaacatagggagaccccatctttaccaaaaaaattttaaaaattagctggcgtggcctgggtgtggtggctcacgcctgtaatcccagcactttgggaggccgaggcaggcggatcacaaggtcaggagaccaagaccatcctggcgaacacggtgaaaccctgtctctactaaaaatacaaaaaaaattagccgggtgtggtggcgggcgcctgtagtcccagctactctggaggctgaggcaggagratggcatgaacccgggaggcagagcttgcagtgagccaagatcgcgccactgcactccagcctgggcgacagagcaagactccgtctcaaaaaaaaaaaaaattagcccatgtggtggcacgagcctgtagtcccagctgctcaggaggctgaggtgggaggatcacctgagtccaggaggttgaggctgcagtgagccacaatcacaccactgcactccagcctgggcgacagagctagatgctgtctcaaaaaaaagaaagtgctaggagggttttactgtctcacttttggctcagt

SEQ ID NO: 177622 - DNA, 601 bp, Human
ctctgggtagagaagagcatcacctggtgtccactcaggtcacaacctgcaaatggggaacctgactgcggggctgggggtgttggtatcttctctgtttggtcaagtatttctgaaagctctagctcattctggctgtgcttgggagattcaaggaaaggagggtttgtccaggcttggtccagcccttagaagggctagcaatgccccatggggctagcaaggtggatgcagctcccagaggaaggaacaacctgaggacaggcacaagtgccagcctccctgcctgagtgctgcccgyccatgccttctcactgcttgtctggcactgcgctatgagattctgggtggctggggtgtctcctgtcctggagtggcttattcatttcggtgaggctggtgctttagcacagtgccaggatcgaaggactcattggctcattcattcattctagatgttgttcctgttagatagtattttttttcttgagatggagtcttgttctgtcgccctggctggagtgctgtggcacaatctcgaatcactgcaacctctgcctcccagtttcaaacaattctcctgtctcagcctcctgagtag

SEQ ID NO: 177623 - DNA, 601 bp, Human
gaaccacttgtcagtaacactgaggccgtgggattcttggagtagggctgtgctggctgccaagtcgataagggatctccctgctccactcaaggtaggagcctcttcctttgtcttctgtgcaaagatcctcttatgtgatgggacgctggacccacccaggatggcctgtgtggggacagagggaccggtgagggctgaggttgtttgaagagagagaaaactggtcaattacagctcctgcccagtacagctcagggtggctggagacaagcaagagtggggccatgtgccagccctytgggtagagaagagcatcacctggtgtccactcaggtcacaacctgcaaatggggaacctgactgcggggctgggggtgttggtatcttctctgtttggtcaagtatttctgaaagctctagctcattctggctgtgcttgggagattcaaggaaaggagggtttgtccaggcttggtccagcccttagaagggctagcaatgccccatggggctagcaaggtggatgcagctcccagaggaaggaacaacctgaggacaggcacaagtgccagcctccctgcctgagtgctgcccgtcc

SEQ ID NO: 177624 - DNA, 601 bp, Human
aacatcagactccaagtccttcagctctgggacttggactggcttccttgctcctcagcttgcgatggcctattgtgggaccttgtgatcgtgtgagttaatgctccttaataaatccccctttaggccaggcacggtggctcacgcctataatcccagcactttgggaggccaaggcaggcagatcacgaggtcaggagatcgagaccatcctggctaacacggtgaaacctcgtctctactaaaaatacaaaaaaattagccgggtgtggtggcgggcgcctgtagtcccagctactcrggaggctgaggcaggagaatggcatgaacctgggaggcagagcttgcagtgagccaagattgtgccactgcactccagcctgggcgacagagcgagactccgtctcaaaaaaaataaaataaaaaaataaacccccctctctctctatatatatatctcctgttagttctggccctctagagaatcctgactaataatacaatcatcatcacgccaccttctatttgggaagcactttacaatttgtgccgagttttgtcacacactgccttgctgacttcatcacatcgccaaagcaga

SEQ ID NO: 177625 - DNA, 601 bp, Human
tacataattgtaaaggtggttgatgaatatgccaaaaactgtgaagatgggatgaagatgaccaaagtctatcagcagttcttaaagtaagacctggggacccctgtgaacacgtgataccctttcagaggtctcacacccagctaattttgcatttttagtagagatgggctttcgccatgttggccaggctggtctcgaactcctggcctcaggtgatctgaccatcttggcctcccaaagtgctggtgtacacgagccactgcagctggccagttattttttaagttttttaaaaaawttttaattttaatttttgtgggtacatagtaggcatatatatttattattgttatttttaaatgaattaatattttgaaattttcacactttaaatttctaaaatggtaaatatagataaagaaaatccagatgattaaaaaatctttgtgatcctcaataatttttcagagtataaagggatcaaataggccaaaaaacttgagaactgctgagttagatcattccaagggcccacccagtgctaaaaatgtccacagtttcaaaaatgaaactatttatagtttcagccttttgggca

SEQ ID NO: 177626 - DNA, 601 bp, Human
atttgatggctggggacctgacaaacaggcttaaaagcacccacaggggagggtgtaagaacccaggcagaaactagaagtgactcgcccctgctctgccagctccgcctccaaagatgcagtgcatctgtgaccccgacccaggagccatggggacacagtaggtcagctgctgatggctttcaggagtagcaaggagagggtgggtgagggcagggaaggccatcttgcccacccagtccagggtgtcatccctgaggggtaaccgaacacacgtgcccctaatggcagccttcgggggagtgtccccacgaagaacgtcacacatttccacacctggaggccgggcaggggcgcagagcatggcatggtttcagaggacacactggccacctggaactgtgggctctggccttgtcaccttcctcttcttgggacccgatttccctgcctagagaatgaagctgtgggtctagaatggggttttccaaacagttcttcacattctattaggacttctatggctacagatatgtgtgtgttttcagcattaactgtgattttttgttgttgttactgttttgttttgttttttttgaga

SEQ ID NO: 177627 - DNA, 601 bp, Human
ggattagggagtgagagctagagctaatgccgcatggctaggctcggtggcctctccaggcccagggcgttacccatctgacgccgcaccccaggcccaccatccggcctggcttgggtgactgcctgcaaaattgagagataaagatgggaggtggagggggagttcctgggaggggagagagaggtggagccaggactagaagccacagtcacggtgcctctccagagttccaggcttggtcgggctaccctggctgaaggtgctgccgcctccacagtgaagtctggctcaccaaggmctggctcctggctgccctctgttcaggggaccccgctcccaaacaatggaggtccctgagtgggccagcccacagaaagtccagagaagggtcctgtctagtctggggatgtctccctgggcaccaaggaatgcaccggggcagatgctggctgcctggccacattcaacgtctgaaagtcaccacggggccaggaagggggcacacaggtctcaggcccaaccgagattcaaacagtgtgatagaggtgaagccagagggacaggtgaagccagagggcccgggcccccagtcccccga

SEQ ID NO: 177628 - DNA, 601 bp, Human
gtccatggatgaaaggagacatccctcgtcctgatcccaggtctggaaatcccagtggcctccgggatcaggcccaccatccactctgtccatgtcttcctttgtgtccaaggcctgcctgacgtccacccaactgactagctgcccctcctgacaagcagcccagtccccaggtgcctggtgcagcagcccgcgtgaccccaactctgacagccccccaccactgtgcagagtctagaagcagcaaagcagaaccgagggctgcgaagcggtgtctccccctccccagggcacacggctscacagtgaacaagggaagcagaagagtggctgagagaggccggggacagggtgcaggggagggggcgtgtggtgtgtgcgcagctaagaaggacggattagggagtgagagctagagctaatgccgcatggctaggctcggtggcctctccaggcccagggcgttacccatctgacgccgcaccccaggcccaccatccggcctggcttgggtgactgcctgcaaaattgagagataaagatgggaggtggagggggagttcctgggaggggagagagaggtggagccaggactagaagc

SEQ ID NO: 177629 - DNA, 601 bp, Human
caaaaggctgagtcaggacgttcctcggggtttaagtccatggatgaaaggagacatccctcgtcctgatcccaggtctggaaatcccagtggcctccgggatcaggcccaccatccactctgtccatgtcttcctttgtgtccaaggcctgcctgacgtccacccaactgactagctgcccctcctgacaagcagcccagtccccaggtgcctggtgcagcagcccgcgtgaccccaactctgacagccccccaccactgtgcagagtctagaagcagcaaagcagaaccgagggctgcraagcggtgtctccccctccccagggcacacggctccacagtgaacaagggaagcagaagagtggctgagagaggccggggacagggtgcaggggagggggcgtgtggtgtgtgcgcagctaagaaggacggattagggagtgagagctagagctaatgccgcatggctaggctcggtggcctctccaggcccagggcgttacccatctgacgccgcaccccaggcccaccatccggcctggcttgggtgactgcctgcaaaattgagagataaagatgggaggtggagggggagttcctg

SEQ ID NO: 177630 - DNA, 601 bp, Human
atgactctcctcctccgcccatgggactctgtccccagcacctcctggactggctgagccccctgctcctgaggctggggtatgcctggctcagctctgcatccccagcatccaacacaggcctggcccacaggccctgatacccaccctagggtggggagtcctccccgggcacctccaagactttgcatgaccaggatccagatgtgggggcgctctggagaaaatggaatctgaccagcacaggggcaggggcaccagtcagacatgttgagtcccaggacaatgtccagggggttgsggggagctgaggaccctgatctggcagtgcccctccccacctgtcagcacctagaagctcagacagctccacagaggagccgtcacaacactgaccacccggctatctgtccagcaagccaggcgccttcgcaaagcggcagtgaaaggagactacacagtgccctgtggcctaggaggtgccaggctgggagtctaggggactgtgctccagcccagcgaccccatggatgagctatgtgacttcacgtcatccctccccacctgggaacttaatttcccagtaaaatttcccagtaaa

SEQ ID NO: 177631 - DNA, 601 bp, Human
ctggctgatcctctctggttctcagtttccccatctgctcaccccgcagggctatggtgagaatcatcaaaaggaaatgaaataccagtcaataaaccgccgtggacactaacgtcccggcaacttgacagatgactctcctcctccgcccatgggactctgtccccagcacctcctggactggctgagccccctgctcctgaggctggggtatgcctggctcagctctgcatccccagcatccaacacaggcctggcccacaggccctgatacccaccctagggtggggagtcctcccckggcacctccaagactttgcatgaccaggatccagatgtgggggcgctctggagaaaatggaatctgaccagcacaggggcaggggcaccagtcagacatgttgagtcccaggacaatgtccagggggttggggggagctgaggaccctgatctggcagtgcccctccccacctgtcagcacctagaagctcagacagctccacagaggagccgtcacaacactgaccacccggctatctgtccagcaagccaggcgccttcgcaaagcggcagtgaaaggagactacacagtgccctgtg

SEQ ID NO: 177632 - DNA, 601 bp, Human
gggtagagagctgggcacactgctggagacccagtcctgactgcccaattcactggctgatcctctctggttctcagtttccccatctgctcaccccgcagggctatggtgagaatcatcaaaaggaaatgaaataccagtcaataaaccgccgtggacactaacgtcccggcaacttgacagatgactctcctcctccgcccatgggactctgtccccagcacctcctggactggctgagccccctgctcctgaggctggggtatgcctggctcagctctgcatccccagcatccaacayaggcctggcccacaggccctgatacccaccctagggtggggagtcctccccgggcacctccaagactttgcatgaccaggatccagatgtgggggcgctctggagaaaatggaatctgaccagcacaggggcaggggcaccagtcagacatgttgagtcccaggacaatgtccagggggttggggggagctgaggaccctgatctggcagtgcccctccccacctgtcagcacctagaagctcagacagctccacagaggagccgtcacaacactgaccacccggctatctgtccagcaa

SEQ ID NO: 177633 - DNA, 601 bp, Human
agctaggactctgcccagtctgcctgctcagacctcgtgcccgcccttggaccctgtggaagaccagagaggggatgctgggaccctgaggctggggtagagagctgggcacactgctggagacccagtcctgactgcccaattcactggctgatcctctctggttctcagtttccccatctgctcaccccgcagggctatggtgagaatcatcaaaaggaaatgaaataccagtcaataaaccgccgtggacactaacgtcccggcaacttgacagatgactctcctcctccgcccatgrgactctgtccccagcacctcctggactggctgagccccctgctcctgaggctggggtatgcctggctcagctctgcatccccagcatccaacacaggcctggcccacaggccctgatacccaccctagggtggggagtcctccccgggcacctccaagactttgcatgaccaggatccagatgtgggggcgctctggagaaaatggaatctgaccagcacaggggcaggggcaccagtcagacatgttgagtcccaggacaatgtccagggggttggggggagctgaggaccctgatctg

SEQ ID NO: 177634 - DNA, 601 bp, Human
gctgccccacttcccccgtgaggcagtgagttccccagggccagggatgtacaagcagagggtagctgaaaggaggccatctgcccacaccggaggatcagccaggagacctctcaaatcccctccatggcccctgggagtctcaagaccccggatggggaagaaatggtccctgaagaaggacgtggcccttttggagaagaagctaggactctgcccagtctgcctgctcagacctcgtgcccgcccttggaccctgtggaagaccagagaggggatgctgggaccctgaggctggggkagagagctgggcacactgctggagacccagtcctgactgcccaattcactggctgatcctctctggttctcagtttccccatctgctcaccccgcagggctatggtgagaatcatcaaaaggaaatgaaataccagtcaataaaccgccgtggacactaacgtcccggcaacttgacagatgactctcctcctccgcccatgggactctgtccccagcacctcctggactggctgagccccctgctcctgaggctggggtatgcctggctcagctctgcatccccagcatccaacacagg

SEQ ID NO: 177635 - DNA, 601 bp, Human
ctggacatggtggctcgcgcctgtaatcccagcactttgggaggctgaggcaggtggatcacttgaggtcaggagtttgagaccagcctgcccaacatggtgaaaccccgtctattaaaaatacaaaaattcgccaggtgtggtggcgggcgcctgtagtcccagctactcgggaggctgagaggcaggagaatcgcttgaacccgggagcggaggttgcagtgagccaagatgcaccactgcactccagcctgggcaacggagagactcaaaaaccactgaagccccacggctctgcacytcatcttgtattcatgattttgtattattttccttaaagaagagcccctcaagagtaaaagcttataaaagctagacccacgttgtttgtcacagaaaacaaggaatagccctgtcctttgagccttcagaacagacagggccaaggggccggctgcacctccaggaaggagaagctgccccacttcccccgtgaggcagtgagttccccagggccagggatgtacaagcagagggtagctgaaaggaggccatctgcccacaccggaggatcagccaggagacctctcaaatcccctcc

SEQ ID NO: 177636 - DNA, 601 bp, Human
aggccatggacttacctaggaacaaaggggtcagaggcggggagatgcagcggccacacgcagggctcccgtagaacagcctgcagagcgcctgaacgcaggaggtggcaggaggaagcgggtttaccgaggcctaagcaaacccaaattctgggcccttcctttgcaacctcccagacagacagagagaaacctccttccggctggacatggtggctcgcgcctgtaatcccagcactttgggaggctgaggcaggtggatcacttgaggtcaggagtttgagaccagcctgcccaacayggtgaaaccccgtctattaaaaatacaaaaattcgccaggtgtggtggcgggcgcctgtagtcccagctactcgggaggctgagaggcaggagaatcgcttgaacccgggagcggaggttgcagtgagccaagatgcaccactgcactccagcctgggcaacggagagactcaaaaaccactgaagccccacggctctgcacttcatcttgtattcatgattttgtattattttccttaaagaagagcccctcaagagtaaaagcttataaaagctagacccacgttgtttgtcacagaa

SEQ ID NO: 177637 - DNA, 601 bp, Human
agagcagagggatgcttgacccactgctgaggaagcggagggaaggacagacttcacagatggggctgggaaaaattggccaatcacgtggaaaacattaaattggatcttggatttcaccctcatacaaaaatcaattccaggttgataaaagacctcaatgtaaaaggcagatctagagagctttccagctcgacacaggagaatcgtgtgctgcttgggggcagcaaaggggtttatgaacgagaaataaaaagcacaaactaggctgggcatggtggctgatgcctgtaatgggaarccaaggcgggaggatcgcctcagctcaggagttcaagactagcctggacaacatggtgaaaccccatctctacaaaaaatacatgtgttggcacatgctagtagtcccaggcactcaggcggctgagatgggaggactgcttgaacccaggaggtcgaggctgcagtaagccgtgttcacagcaatatactccagcatgggccccacagcaagaccctgtttcaaaaaaaagaaagaaagaaaggaaaaaatcacaaactacaagaagaaaaatatttataaatattatctacctcatta

SEQ ID NO: 177638 - DNA, 601 bp, Human
caatggaaaaacctgttgcaagactgataaaacatggctgttatctgttatcaaaatcaggaaagaaaagggggccgcaccaacacacactgcagacgttagaaaaaggagaatcggctgggcatggtggctcatgtctgtaatcccagcactttgggaggccgaggcaggtggatcacctgaggtcaggagttcgagaccagcctggccaacatggggaaaccccgtctctactaataatacaaaaattaggtgtggttgcgcatgcctgtaatcccagctacttgggaggctgaagcargagaattgcttgaacccaggaggcagaggttgcagtgagccgagatcacgtcattgcactccagcctgggcgataagagtgaaactccgtctcaaaaaaaaaaaaaaaaaaaaaaaaacagaatattttgaacaactctaagccaataagcttaaagatttagatgaaatggacacattcctagaaaaacctcacttaaccaaaactaactcaaaaaggtatttagaaaccccgagtggtcagtctcacaaccactatagaaattaattccatcatcaaaaatcctcccaccaagcaaac

SEQ ID NO: 177639 - DNA, 601 bp, Human
tccacctttccctttccccacaattcacaccccagggccttgggtagcagagtgcccactccaacctctgttcgggataggtgggcttctccccgcaccatccccgcaaaacaggctctctccggcagtgctggaggagtgtcagattggtccaaccttgggggcacaattcagcaaaagttggtttttttgaaaggctaatccaatggaaaaacctgttgcaagactgataaaacatggctgttatctgttatcaaaatcaggaaagaaaagggggccgcaccaacacacactgcagacrttagaaaaaggagaatcggctgggcatggtggctcatgtctgtaatcccagcactttgggaggccgaggcaggtggatcacctgaggtcaggagttcgagaccagcctggccaacatggggaaaccccgtctctactaataatacaaaaattaggtgtggttgcgcatgcctgtaatcccagctacttgggaggctgaagcaagagaattgcttgaacccaggaggcagaggttgcagtgagccgagatcacgtcattgcactccagcctgggcgataagagtgaaactccgtctcaaaa

SEQ ID NO: 177640 - DNA, 601 bp, Human
catgccgccctccccactcatgcacacttagagcacagtggtcctcagatcccccttagcacagtgcttcaggcagatcccacccatggaacaggttccagtgagatcaatttgccctgtgtgcacatatgaatgagtgcgtgtgtaaaagccacctgctgtcctgggggtcggtccctagcatggtttgctgacacaggattggctccagggagcagtgggtccaggccctctggcctacggcactcaccttgcggatcaggtcctgattgtactcatggatctcggtcatggcatccarcgtggggttgttggccagcagcccaccgtccaggaagcgcccattgggtcggaagtaagtaggagctgccccgctgcttcgggccgcccgccacaccagctggtctaggggcggggaaggagggcggcccagtggcacaagggactggcataaaacccatgcactccagatctcagggtgtgcgtgttgggggctgggggtgcgggaagaggggaggctgggaactcttcagaagcaggacccacgaagccacactctctggctagttcgtcctggtggaaggcaggtacagctgaggac

SEQ ID NO: 177641 - DNA, 601 bp, Human
agtcaagtcgtggccaggggaggaaaggcagacggtgttccttggtgttggtgatttgccaggtatttgcatcattacttcatttaatctccagccagtctgtggagagggcactgatcacccagtttgcaaatgagggctctcagcgaagctcaggccgggaagcagctgcaggggccacgtggtagggaagtaggggctaaggcttgaacctgagccctgggtgctgcctttttttttttttttttgagacggagtctcgctctgtctcccagtctggagtgcagtggcgcgatctcgrctcactgcaagctccgcctcctgggttcacaccattctcctgcctcagcatcccgagtagctgggactacaggctcctgccactatgcccgcctggctaatttttttgtatttttagtagagacagggtttcaccgtgttagccaggatggtctcgatctcctgacctcatgatccacttgcctcggcctcccaaagtgctgggattacaggcgtgagccgctgcgcccggccgctgcctctcttatttgcttccgaacaagctctgctgccgatttgctggatgatcttgggtgatgcc

SEQ ID NO: 177642 - DNA, 601 bp, Human
aggacagaacctggctcaaatctcagagatcgaataaatgaaagggaagggggacctatttttatggagtgcctgctatggactgggttgctgttagtgccctccatgcatggttagaagaactctgataagggtgctcatccacattttatggatgaggaaattgagatgcacagaggctgacttacccaagtcccatagctggccaggcacggtggctcacgcctgtaatcccagcactttgggaggctgaggcaggcggatcaactgaggtcaggagttcaagaccagcctggccaamatggtgaaaccccgtctctactaaaaatacaaaaaaatcagccaggcgtggtggcaggcacctgtagtcccagctacttgggcgactgaggcaggagaatcacttgaacccgggaggcggaggttgcagtgagccgagattgcgccattgcactctagcctgggcaacaagagtaagactccatctcaaaaaaaaaccaagttccacagctgataaatggcagagctggggtttgatcccacatctgcttaactccaagagctgtgcatgttccagcacaaaatgttgttttgtccaagg

SEQ ID NO: 177643 - DNA, 601 bp, Human
agttttagagggcccacccgctccagtcatccttctgccaggagagtcagcctagcttgctttcctttctagcggaatcccgactgtgcctgggaaggtgaccctgcagaaggatgctcagaacctgatcgggatcagcattggaggaggggcccagtactgtccctgcctctatatcgtccaggtattgggcgctttggaggggggcacaaggtacatccctacttgggcatgacaaaggcaggttcatttctccacactgcatagctgactccttctcattcttgaggtctgaccctcwcagaggggctttctgaccacctgcgctgcgttgctctgccctgtcttctcccctgtgtcgctctgtttttttccttctcggcacttattacttgttatttgccctctgtctagtagagtagactctttgcactgagggcagtgtcctggtttgctttttcactgcagtaagcaccaggtacagtgcctggcacatagtggacatgcaatagaaattgactattgaatcaacaaaaccatcagccttgcgtactagccaaaatgaagtgtcataggaacacgatgaaataatggcctgagt

SEQ ID NO: 177644 - DNA, 601 bp, Human
tgggttcttgtgagaagtcaacaaaacgacctaacacactagaagttaagaaacgtgcattggccaggcatagtggctcacacctgtaatcccagcactttgggaggccgaggtgggtggatcacgaggtcaggagttcgagaccagcctggccaacatggtgaaaccccgtctctactaaaatacaaaaattagctgggcgtggtggtgcacgcctgtacttccagctacttgggaggctgaagtaggagaatcgcttgaacctggaaagtagaggttgcagtgagctgagatcacgccrctgcattccgtgcattccagcctgggtgaccgagtgagaccctgtttcaaaaaaaagaaagaaccatgcattaagcagtagctgctgctattttccaggtagctgtacattttcccagatgctctgccagtggtgaggaacactcttgtgtctcttgcagaggaagctgcactggtgatattctgtccactgtaactcaggagtggtgacaggcctgctgtggggcctccttcactgtgtggctcatccaagtcagtgaccttgctgtagccttgggaatacctgttctaaccctctcac

SEQ ID NO: 177645 - DNA, 601 bp, Human
gttaagaaacgtgcattggccaggcatagtggctcacacctgtaatcccagcactttgggaggccgaggtgggtggatcacgaggtcaggagttcgagaccagcctggccaacatggtgaaaccccgtctctactaaaatacaaaaattagctgggcgtggtggtgcacgcctgtacttccagctacttgggaggctgaagtaggagaatcgcttgaacctggaaagtagaggttgcagtgagctgagatcacgccactgcattccgtgcattccagcctgggtgaccgagtgagaccctrtttcaaaaaaaagaaagaaccatgcattaagcagtagctgctgctattttccaggtagctgtacattttcccagatgctctgccagtggtgaggaacactcttgtgtctcttgcagaggaagctgcactggtgatattctgtccactgtaactcaggagtggtgacaggcctgctgtggggcctccttcactgtgtggctcatccaagtcagtgaccttgctgtagccttgggaatacctgttctaaccctctcactggtggcagatgggaaactggcctctgtgaggatcttgctcagg

SEQ ID NO: 177646 - DNA, 601 bp, Human
tgctctgccagtggtgaggaacactcttgtgtctcttgcagaggaagctgcactggtgatattctgtccactgtaactcaggagtggtgacaggcctgctgtggggcctccttcactgtgtggctcatccaagtcagtgaccttgctgtagccttgggaatacctgttctaaccctctcactggtggcagatgggaaactggcctctgtgaggatcttgctcaggagtcgcttgtaggcctcgaagacagattcccaggatcgacctggtcttgcttctgctcacagtgctgcctccttcrtgagccattcggcctcctgtgacccaggaggcattagcaagacctcccccaggcctggcctcctggccgtgtgtctgctcagcctctcgccacctccctctacctacctcaggtgcaagtttgcttagaatgaacagacatcataaaatagtataattgattttttttttttttttgagacagagtctcactgtgttgcccaggctggagtgcagtggcgtgatctcagctcactgcaacctctgcctcctggattcaaacgattctcatgcctcagcctcccgagtagctggtattaca

SEQ ID NO: 177647 - DNA, 601 bp, Human
cacctcagcctcccaaagtgctaggattacaggcatgaaccaccagccaataaaataatagaactggccgggtgcggtggctcacacctgtaatcccagcactttgggaggctgaggtgggcagatcacctgaggtgaaaacttccagacaagcttggccaacatggtgaaaccctgtctctactaaaatacaaaaattagccaggcatgatggcgggttcctgtaatcccagctacttgggaggctgagacaggagaatcgcttgaacccgggagatggtggttgcagtaagccgagatygtgccattgcactccagcctgggcagctgagtgagactccgtctcaaaaataataataatcatcatcatcatagaattgatttttttaaattcaattttgtttttatcaaagtgccatatgacttgcctctaccaagtcaagagcattaaaagccctgtatcaaataatagcaatccactgcccttcccctgggcacctcacccggctttctctgtctcttcatgcatgggcttccatttttctcaatagtctcactctgtcgcccaggctggagtgcagtggtgcaagcatgggtcact

SEQ ID NO: 177648 - DNA, 601 bp, Human
caataaaataatagaactggccgggtgcggtggctcacacctgtaatcccagcactttgggaggctgaggtgggcagatcacctgaggtgaaaacttccagacaagcttggccaacatggtgaaaccctgtctctactaaaatacaaaaattagccaggcatgatggcgggttcctgtaatcccagctacttgggaggctgagacaggagaatcgcttgaacccgggagatggtggttgcagtaagccgagatcgtgccattgcactccagcctgggcagctgagtgagactccgtctcataaataataataatcatcatcatcatagaattgatttttttaaattcaattttgtttttatcaaagtgccatatgacttgcctctaccaagtcaagagcattaaaagccctgtatcaaataatagcaatccactgcccttcccctgggcacctcacccggctttctctgtctcttcatgcatgggcttccatttttctcaatagtctcactctgtcgcccaggctggagtgcagtggtgcaagcatgggtcactgcagccttgatttccccagactcagatgattctcccacttgagcctc

SEQ ID NO: 177649 - DNA, 601 bp, Human
ataaaataatagaactggccgggtgcggtggctcacacctgtaatcccagcactttgggaggctgaggtgggcagatcacctgaggtgaaaacttccagacaagcttggccaacatggtgaaaccctgtctctactaaaatacaaaaattagccaggcatgatggcgggttcctgtaatcccagctacttgggaggctgagacaggagaatcgcttgaacccgggagatggtggttgcagtaagccgagatcgtgccattgcactccagcctgggcagctgagtgagactccgtctcaaatataataataatcatcatcatcatagaattgatttttttaaattcaattttgtttttatcaaagtgccatatgacttgcctctaccaagtcaagagcattaaaagccctgtatcaaataatagcaatccactgcccttcccctgggcacctcacccggctttctctgtctcttcatgcatgggcttccatttttctcaatagtctcactctgtcgcccaggctggagtgcagtggtgcaagcatgggtcactgcagccttgatttccccagactcagatgattctcccacttgagcctcca

SEQ ID NO: 177650 - DNA, 601 bp, Human
tcaaagtgccatatgacttgcctctaccaagtcaagagcattaaaagccctgtatcaaataatagcaatccactgcccttcccctgggcacctcacccggctttctctgtctcttcatgcatgggcttccatttttctcaatagtctcactctgtcgcccaggctggagtgcagtggtgcaagcatgggtcactgcagccttgatttccccagactcagatgattctcccacttgagcctccaagtagctgggattacaggcacgtgccaccaaacctggctaatttttgtgtattttttktagagacggtgttttgccatgttgcccaggcttgtctcaaactcttgggttcaagtgatccacccgcctcagcctcccaaagtgctgggattacaggcgtgagccaccgtgctcagcctatcctgttgtttcttgatctatcacctgtaaatatctattgactttgcctcgtctggtagatgagaatttagttcttcccatgaccagtctgtttcctctcatcccacctttccaacatagttatttttctatttttggctaaattaatattagtacaacggagattttgttcgggaaatc

SEQ ID NO: 177651 - DNA, 601 bp, Human
tttttgtccctggtgttgggaggagtcgtgatggtagctgcaggcacaggcttttgtttattgtgccagatcctcagagggcgtcatcgggaacaccatgtccttcttgtcatgtatctcgatgatgacatcctgctttctgtattctctgttctgcttttttctatttttttattgtggtaaaatttaccatcttaactttttttttttttgagacaggatcttgctctgtcgcccaggctggagtgcaggggtgcgatcatggctcactgcagcctcaacctcctgggctcaagcgatmctcccacctcagacccccgagtagctgggactacaggcacgcgccaccatgcctggctcatttttgtattttttttgtagagacagagttttgccatattgcccaggcgatcttcccacctcggtttcccaaaatgctgggattacaggtgcgcaccaccgtgcccagcccttggtctatttttgaattaggttgtttggtttttgttgttgagttttaagaattctctacaaagcacaatcggctaagaggaaaaaaagaaaaaagagttttaggaattctgcatatattctggatatt

SEQ ID NO: 177652 - DNA, 601 bp, Human
tttctatttttttattgtggtaaaatttaccatcttaactttttttttttttgagacaggatcttgctctgtcgcccaggctggagtgcaggggtgcgatcatggctcactgcagcctcaacctcctgggctcaagcgatcctcccacctcagacccccgagtagctgggactacaggcacgcgccaccatgcctggctcatttttgtattttttttgtagagacagagttttgccatattgcccaggcgatcttcccacctcggtttcccaaaatgctgggattacaggtgcgcaccacygtgcccagcccttggtctatttttgaattaggttgtttggtttttgttgttgagttttaagaattctctacaaagcacaatcggctaagaggaaaaaaagaaaaaagagttttaggaattctgcatatattctggatattaatcccttatcaaaaatgtgatttgcaaatattttctcccattctgtgggttgcctttcttttcttctcttctctgttctttttttttttttttttcgagacagtgtctcactctgttgcccaagctggagtacagtgacgggatctcagctcactgcag

SEQ ID NO: 177653 - DNA, 601 bp, Human
ggtccctccctgtcctctcaggcttggtcataccagcacctcaggttgcccatgaggacaagagctctttgtatttgcacacagccatgacagggatgcagcattggcccagctcccctgtttgggtgctgggcagggattactctcccatcttacaggtgtccacaggcggggagtgacctgcttgtggtcacacagctgaactggagcccgggcccgactcccactgcagcccgcttgccgttggcctacagctgctccctgtggggtggcccctgagcacgcctgtgtttcattctgygggagcagttcacaccccacctctgactctgattgcatctgctcattttggtttccctttgggacttgattttaaaatcctgttttatatttggatgaatgtggtcccaagttcaagggcttttggtttgcaaggatgagagtgaacacagcgccctcccgtgctcaggcaagtcctcttgggagaagcctttgtctcctgagcagtcgttagaaagtggtttgtgtaattccctgattcgcatcagccttgcggggctggggctgcccctgcccctccccttggtgccccagcaccagg

SEQ ID NO: 177654 - DNA, 601 bp, Human
gtgctcaggcaagtcctcttgggagaagcctttgtctcctgagcagtcgttagaaagtggtttgtgtaattccctgattcgcatcagccttgcggggctggggctgcccctgcccctccccttggtgccccagcaccaggcacagagcaagtgctcagatgtgctgttcgatgagtagagggattcctggggatggggtgttttggggtggaggagggaataatcagtgtagggaaatgacacggcaaaggcttggagtgtggtttgcgtggggagggaagaaggagagcctgacctggcmgaagcacaagacatcagagaccgccaggctgtgggcccggtgccggccctgtccccactgattccccagggcttggatgtagagtaggaagggaggggcctgggatcagacagggtcacaaggtggggccatgtcacagcgctcagcctggcccttactggggcttaggattctttttttttttttttttttttgagacagaatctcattctgtcatccaggctggagtgcaatggtgtgatctcagctcactgcaacctccgcctcccaggttcaagtgattctttgcctcagcctcct

SEQ ID NO: 177655 - DNA, 601 bp, Human
gtagagggattcctggggatggggtgttttggggtggaggagggaataatcagtgtagggaaatgacacggcaaaggcttggagtgtggtttgcgtggggagggaagaaggagagcctgacctggccgaagcacaagacatcagagaccgccaggctgtgggcccggtgccggccctgtccccactgattccccagggcttggatgtagagtaggaagggaggggcctgggatcagacagggtcacaaggtggggccatgtcacagcgctcagcctggcccttactggggcttaggattctttttttttttttttttttttgagacagaatctcattctgtcatccaggctggagtgcaatggtgtgatctcagctcactgcaacctccgcctcccaggttcaagtgattctttgcctcagcctcctgagcagctgggattacaggcacgcgccactacgcccagctaatttttgtatttttaatagagatggggttttgccatgttgcccaagctggtctcaaactcctgacctcaagtgatctgcctgcctcagcctcccaaattgttgggattacaggtgtgagccaccgcacccggc

SEQ ID NO: 177656 - DNA, 601 bp, Human
ggggcctgggatcagacagggtcacaaggtggggccatgtcacagcgctcagcctggcccttactggggcttaggattctttttttttttttttttttttgagacagaatctcattctgtcatccaggctggagtgcaatggtgtgatctcagctcactgcaacctccgcctcccaggttcaagtgattctttgcctcagcctcctgagcagctgggattacaggcacgcgccactacgcccagctaatttttgtatttttaatagagatggggttttgccatgttgcccaagctggtctyaaactcctgacctcaagtgatctgcctgcctcagcctcccaaattgttgggattacaggtgtgagccaccgcacccggccttgggctcaggagtctcagtccagaacagtcttggcggggaaggggctcagggtgtggagcctcgctcactagtctgtgtgtgctgctcttccagggggaggtgaccatccactacaacaagctgcaggcggaccccaagcagggcatgtccctggacattggtaagctggtcagagcagttacgggtgtccagcagcctccctggatgggccctggccc

SEQ ID NO: 177657 - DNA, 601 bp, Human
tgtcatccaggctggagtgcaatggtgtgatctcagctcactgcaacctccgcctcccaggttcaagtgattctttgcctcagcctcctgagcagctgggattacaggcacgcgccactacgcccagctaatttttgtatttttaatagagatggggttttgccatgttgcccaagctggtctcaaactcctgacctcaagtgatctgcctgcctcagcctcccaaattgttgggattacaggtgtgagccaccgcacccggccttgggctcaggagtctcagtccagaacagtcttggckgggaaggggctcagggtgtggagcctcgctcactagtctgtgtgtgctgctcttccagggggaggtgaccatccactacaacaagctgcaggcggaccccaagcagggcatgtccctggacattggtaagctggtcagagcagttacgggtgtccagcagcctccctggatgggccctggcccaaaggagaagtgccacagccagccctgccctcccctttatgacaggagaatccagagttacatggctgtgggctctgacctctgaccaagcaaatctgaaaggcctgggaggcctcc

SEQ ID NO: 177658 - DNA, 601 bp, Human
gtgtggagcctcgctcactagtctgtgtgtgctgctcttccagggggaggtgaccatccactacaacaagctgcaggcggaccccaagcagggcatgtccctggacattggtaagctggtcagagcagttacgggtgtccagcagcctccctggatgggccctggcccaaaggagaagtgccacagccagccctgccctcccctttatgacaggagaatccagagttacatggctgtgggctctgacctctgaccaagcaaatctgaaaggcctgggaggcctcccggtgctctccctgcrtctgttcttgtactctgtccctggtttctcactcccccgcgtttcacccctacctccctgcttctgccatctcctctggggacttgctaccctagggttgtcctttgcaggccagcgcctcggcttccatggcccagggcctcactcttcataaagggagagcagcctaaccctggcctggcgcctcatgccctctagcacagcgcactcctccctggcctctcctgccatcagctcccagggggactctggatctgaactggacctcaggcattgggcagagggtctgcgccctgggac

SEQ ID NO: 177659 - DNA, 601 bp, Human
gcccacagcaggctgtgtacccctgcatcttacaaaatgctggcgcccctgtctgatggggctcctcacgggttgggtcggactgagcttttacccctgggctgtggttgggcggtggggaaaggccatgtatcagggcctagcagaggccttgggtggcatgggcaattggaggccttgccctgggccagtgtggtccccgccatgcgtccccattccgcatcactcggtctctcccacagggatgacggaacacaccaagaacctcctacgggccttttatgagctgtcgcagactcaycggggtaatggcatcccccaaagctgtggtgtgaccctgggcaatccctggggcctctcactcccatgctgaggtgggtcagacccacagcgcctgacctcaggctccctctgggctgggcctggtcccaggtgctgggatttgcgatgggcctgcggggaacatctagatcagctggtctcttaagggccgcaacgatgaacaggccccaccctgtctcctcacactgccactggcagtacacaaggcccttgcttatttatatttctgacaacctgtaactctgggcaggccgactgc

SEQ ID NO: 177660 - DNA, 601 bp, Human
tccccgccatgcgtccccattccgcatcactcggtctctcccacagggatgacggaacacaccaagaacctcctacgggccttttatgagctgtcgcagactcaccggggtaatggcatcccccaaagctgtggtgtgaccctgggcaatccctggggcctctcactcccatgctgaggtgggtcagacccacagcgcctgacctcaggctccctctgggctgggcctggtcccaggtgctgggatttgcgatgggcctgcggggaacatctagatcagctggtctcttaagggccgcaasgatgaacaggccccaccctgtctcctcacactgccactggcagtacacaaggcccttgcttatttatatttctgacaacctgtaactctgggcaggccgactgcagctgaccccagctactgcagaaaatgaagcccagacaaaggagagggccacactgctcccaagtggtggagctgttgttccaatccaggtgtctagactcggaccagtgttctgcctcaggcggcgccacctccacaaaccttgacccagtcttctctcactggtccctctggggaatgagggccaactcccttg

SEQ ID NO: 177661 - DNA, 601 bp, Human
ctcccttggtgtgtacactcaggactctagggggcacagaccagctcttggaggtgtcaatccagtttcctccaggtgtagactcagctccttcagggggtttagaccagctctcttggaggtgtagcccctgtgcagacattggcttccagcctgccaggccccctgccctgcttctccccaacaaacccctggcttctcttagggggccaagtaggggcagccttcaaggcaaacttgtcctgcagcctttggggacgtgttctccgtgatcggggtgcgggagccccagccagctgcragcgaggcttttgtgaagttcgccgatgcccaccgcagcatcgagaagttcggcattcggcttctgaaaaccatcaagccggtaggtcctattgagcatgtgtgtgtctggcgtgtgagggtggggaggggagagtgtggcatgcagagaaggtcgtatgctggagtcctgtgcctgggtacagcctctggctcagtcacccacacagtggactgtgggtgagtcactgtgcccccttgggccttgccattgacctctgggctggcttctgaccctggctcgccactgagtcacagcttg

SEQ ID NO: 177662 - DNA, 601 bp, Human
ggactctgtgagtgaccgtcttcttgccttcctgtccaggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaaggtcagtgtctggtcccagctggagctgggtgagcgggcccaggcccacccacaaggctgggyctgcagggacatcggggtggtgggaggaggcatccctggccccaggctgctgagaaagtgagggtgctgaaacggtgggatttgatccggatggggagcttggagaatgggctgtaatcctgtggccaccactggattggttgaggcccagccaggccttcaccctctcagggcctccacttcctcacaggaaaaatggggcagtaacctcagccccgctgagggtcatttttggaataaaaatggggtgatgtggatatgaccatttttgataaaatgtagattgacatccaaatgtaa

SEQ ID NO: 177663 - DNA, 601 bp, Human
cctgggcacctgccttcagcccacacccttcacccacaggctcgctatgtttttgttctttccagtacagtggccattcgccggcccctcacaggcctggctggggagatgcacggagaatggagaatgtccccaggcctgggagctcagggtgtccgtcctcctcgctcagggcccgggacctggtaggcggcctcctgtcaccctgtgggggcaacatcccctcatccagcatgctgtctctcccacatctgggtatgagcctggaggtcctttggtggaatgcacaggggacaaggtrgggtgggggagggggactaatgaacagacactggttttggaacctgcagaattcccctagtgcagtctcgggggccccagcctcagcccagtcccggggactcttgcccatcaagccatttcctggagatggccctactcctcggctccctgaacataaggccttttcatgccacagaacagtcagtttgcagcaaggcctggcagcgggggcacacccagccgaactgcccaggaatgacccccttctgggcatgtgctcagagatggggttcagtggggtcagggagagctttcagag

SEQ ID NO: 177664 - DNA, 601 bp, Human
tggggagatgcacggagaatggagaatgtccccaggcctgggagctcagggtgtccgtcctcctcgctcagggcccgggacctggtaggcggcctcctgtcaccctgtgggggcaacatcccctcatccagcatgctgtctctcccacatctgggtatgagcctggaggtcctttggtggaatgcacaggggacaaggtggggtgggggagggggactaatgaacagacactggttttggaacctgcagaattcccctagtgcagtctcgggggccccagcctcagcccagtcccggggamtcttgcccatcaagccatttcctggagatggccctactcctcggctccctgaacataaggccttttcatgccacagaacagtcagtttgcagcaaggcctggcagcgggggcacacccagccgaactgcccaggaatgacccccttctgggcatgtgctcagagatggggttcagtggggtcagggagagctttcagaggccttgaagggtgcggactgccatggaggagaaggaggtagggctgggggagggcaagtcttctgcagaggggatgggctgtaggctacaactccctttcc

SEQ ID NO: 177665 - DNA, 601 bp, Human
tgtacaccaggaatagaaacctgaatttcttgttgtgccacgaagggagaagggaggtgggctgggctgtggcctgtcaggtagagttggtctaacaggctgggatgggctgagcaggggagcggtgactgcaggtgcagaatgctgtcctagagctgtgttgcctggagaaatggtcaacccccagccctcaggggtagcccctgtacagcccaatcctgtgcaccactttgtcccccctccctcccagggacctgtctgtagccccagtggaacctgccaagctttgctaagcctagargtgggcaaagtcaggcctgggccctgcttaggagctcacaggctggtggtggggaccctaaggaaacctagagagtgtggacagggatggaagggagcacaggtggctggcaccagataaagggcccctggcacccgaggaccatttcggaggcagtgtctgcctcaggacacttcgggtccccatttccctcctgaacctccctgcttaccagcactctccatgcctgctctgccagcatcactgcctccaggcagcctcctctgttttctctctggctcctgctgtcacagctctgct

SEQ ID NO: 177666 - DNA, 601 bp, Human
cctcctcctctctgggatggggcagttgtgtgtctgtcttaggacactggctgggaggatctgaagtggagggacacctgagtcacttcctgctgtaaaccctggtgatgccaggtggtagctgtttctctttccatggcatgatgtggctggggtcctccgtatatggaagcccctctcccttcccggtcttgcctgccctcctggcctcagggaacagatgctaagtcatagctccctctgggtcagaggatgggctggatgtggggtgtggtccagggctgggagggaagacaggagrgcagcggggaggagagggaaagtcccttcttcctgcctgtgcttcctgacggggtgccgttggggatggatgagaccaggcggcctcactgggtttcctagacctgtgctctgcagaagccgccgtgcaggttggccgtggtgcaccctgtagtgccaactggaaggaggggccaggtctcaggagctgctcatgcccttgggggaattctagccctttctctgaccctctaaaactctggttcttccgggcagaggggacagcagggtccccatcttggtgggaactaggagccctctt

SEQ ID NO: 177667 - DNA, 601 bp, Human
tctgaagtggagggacacctgagtcacttcctgctgtaaaccctggtgatgccaggtggtagctgtttctctttccatggcatgatgtggctggggtcctccgtatatggaagcccctctcccttcccggtcttgcctgccctcctggcctcagggaacagatgctaagtcatagctccctctgggtcagaggatgggctggatgtggggtgtggtccagggctgggagggaagacaggagggcagcggggaggagagggaaagtcccttcttcctgcctgtgcttcctgacggggtgcckttggggatggatgagaccaggcggcctcactgggtttcctagacctgtgctctgcagaagccgccgtgcaggttggccgtggtgcaccctgtagtgccaactggaaggaggggccaggtctcaggagctgctcatgcccttgggggaattctagccctttctctgaccctctaaaactctggttcttccgggcagaggggacagcagggtccccatcttggtgggaactaggagccctcttccccattctcccttgcaactgctctgctccacgatctgtagagtccctacacagccctg

SEQ ID NO: 177668 - DNA, 601 bp, Human
tgcctgccctcctggcctcagggaacagatgctaagtcatagctccctctgggtcagaggatgggctggatgtggggtgtggtccagggctgggagggaagacaggagggcagcggggaggagagggaaagtcccttcttcctgcctgtgcttcctgacggggtgccgttggggatggatgagaccaggcggcctcactgggtttcctagacctgtgctctgcagaagccgccgtgcaggttggccgtggtgcaccctgtagtgccaactggaaggaggggccaggtctcaggagctgctyatgcccttgggggaattctagccctttctctgaccctctaaaactctggttcttccgggcagaggggacagcagggtccccatcttggtgggaactaggagccctcttccccattctcccttgcaactgctctgctccacgatctgtagagtccctacacagccctgctgggatgaccatttatctcctctgcacaggtgaggcccaaagttgcacagcagggagcagacattcaaattcggtcttcctgcctctgccaccctctgctggccgcctgtggtaggaccgcagaagctcttg

SEQ ID NO: 177669 - DNA, 601 bp, Human
ccctttctctgaccctctaaaactctggttcttccgggcagaggggacagcagggtccccatcttggtgggaactaggagccctcttccccattctcccttgcaactgctctgctccacgatctgtagagtccctacacagccctgctgggatgaccatttatctcctctgcacaggtgaggcccaaagttgcacagcagggagcagacattcaaattcggtcttcctgcctctgccaccctctgctggccgcctgtggtaggaccgcagaagctcttgggatggaactagctcaggagcscctgctggagtggaggcaggcagagggctgctgccatctgcccatgctgtgtggcggggacatggtattacacctccctgggcctcagtttccttatctgtaaaaggggatattgcccacttctcagtgccttggtgaggatggattgtggtgtcagcaggatgcctggtacatgaaaggcatgtctcagtgtttgcctgtccccaccctccaccatacccacagccactggggagcagtggcttcctcagctcagtgaggcgatgggagaggaagaggggcctgctctgttccctgggc

SEQ ID NO: 177670 - DNA, 601 bp, Human
gcagaggggacagcagggtccccatcttggtgggaactaggagccctcttccccattctcccttgcaactgctctgctccacgatctgtagagtccctacacagccctgctgggatgaccatttatctcctctgcacaggtgaggcccaaagttgcacagcagggagcagacattcaaattcggtcttcctgcctctgccaccctctgctggccgcctgtggtaggaccgcagaagctcttgggatggaactagctcaggagcgcctgctggagtggaggcaggcagagggctgctgccayctgcccatgctgtgtggcggggacatggtattacacctccctgggcctcagtttccttatctgtaaaaggggatattgcccacttctcagtgccttggtgaggatggattgtggtgtcagcaggatgcctggtacatgaaaggcatgtctcagtgtttgcctgtccccaccctccaccatacccacagccactggggagcagtggcttcctcagctcagtgaggcgatgggagaggaagaggggcctgctctgttccctgggccagggctagggatcaggccaggccccacccccagctc

SEQ ID NO: 177671 - DNA, 601 bp, Human
ccagctattcgtgaggcttaggccagaggatcgcttgagcctaggaggttgaggctgcagtgagctgtgattgtgactgcactccagtttgggtgacagacgagaccatgcctcaaaaagacaaaaacaaaaacaaaaaaccccaaaatccaacaacataaagcaattgttgtttctattgtataaatcagaaagccgaggctcagagagctcgccagattgccgattgaggagctggaattcagtctccagtctgaagccaaagcccatgcttttccctttcacagcactgcctcagggkgcttttaaggaaaatacccccacagcaagaagaggtggaaagcccaggccagagctccttgggcagggtcaggtgcagagggcacctggtactggagcccccctgggctgcctctctcttggcaggcagagcaaggggcttccagaaattaggaagggctgagcctgagagcagccagttgctcatggatcattcccgggtcagcggctgccctggccggattccctggctgcgtctcatggagcagcctcttgggccgtgcccaccagtctctgtagaaaataaaaatggaggctgggt

SEQ ID NO: 177672 - DNA, 601 bp, Human
ggagaaaccctgtctctactaaaaatataaaaattagctgggcgtggtggtgggtgcctgtaatcccagctactcaggaaggtgaggcaggagaattgcttgaacccaggagctggaggttgcagtgagctgaggttgcactactgcattccatgcactccagcctgggcaaaagagcgagactgtctctaaagaaaaaaagaaagaaaaaaggaaaaaaaggagtttttgctccacttgagcatttgcttgctgtgtgcctttgacaagtcacagtccatctctgaacctccattcctcrcccatacaatggaatgacaactcctcgctccttgggtggcgtgaagacctgatgagattatgcgaggcaagtgccatgcggggcctggcccaccgctccccactggcccctcgctttgtgctccccagctgggatatgggtgtttgtcccatgcccgcacccccaccccacttgaacctgctgtacccctgtgggctggcgggggtgggcactcaggctgctggtgctagagaaggaagggaatggagctcttgctggttagggaggggcgcagcgggtaggaggaaggcagtgccccgg

SEQ ID NO: 177673 - DNA, 601 bp, Human
ctgttggggacacttggcagattaatacacacctgtgaaatgtggaagctgtgtgcatcacatttagtgtgcagacaccactgatggggctcaggagacccctgacagacacagacctgctgtgtgactcagctggttgctgtcctcctctgggcctgacttttcccagttgttcagcaagggtggtttggtgatccccagcttcatgactcccagttccaagctgctggtgttctggaccagggccaaagggtttgggtgggaaagaatgggctctggtcctgcaacccaacctcctatyccagcacagttccaagctgctggtgttctggaccagggccaaagggtttgggttggaaagaataggctctggtcctgcaacccaacctcctatcccagcacttggcagcagggccttagattccgtgcacaggaggcagggaggctggagtggaggcagaccctggctccctgaagaattattggcagggactgcagggggactctggtcattgccccttgctcatccctgcccttctgccatcccttgggaggggctggcagtggggctgaggagcactggacatctgcatctcccagg

SEQ ID NO: 177674 - DNA, 601 bp, Human
gccacccgttggctcatttcaattctacgcctcaaggcccagagagggctggggcctggttctgtgctctgggtgtagggccagtcctcactctccagcttccaggctcccacccccttctctgagctcagaacaaggtccccctgccttagagcccacccccccactagatgagggctcagtcaggggctgaaggggcacatgggcattctgtagggctgccccccacctcccactttgccctgcaattgcctgtttatctttcacctcccccgtgaggtgagctccccacaggcagaaytggcccaacgtatatgtccctgctgagcccactagggacctggagtagagaaggctcaggagagttttgggaacagagctcctttccaaattgttggactcagctaccacccagcagccccacggtcggccttgctcccccagacctcccagggccttgtggtgctgggcctgactccagtctccccaggagaggccatctgtctggccgtttgtaggtgggagcctatgtgtcctgccctgggcttgggcccaagtggttcctggtgcagctccacctctcaacagtgaagaacaggcc

SEQ ID NO: 177675 - DNA, 601 bp, Human
acttgaaatcaggttgcgacagtttggctgaacatttgccattggtcctggcctggcctaagccaagatctgctgtgagctcacctctctggagcctggagcagccacaggggcagacctgatgcctgctctgagccacagagccgggcctgggcccaggaggagtcaggcagctcctggccaaaaaaaagcatggaagtgaccagagtcccagtcgaatgcctgggtgtctctaggagggagtgttggggtgagcaaccctgggtggggcctgggaggggccagtggaggcatttaaaartgcctcccacagccaggcgcggtggctcacgcctgtaatctgagcactttgggaggctgaggtgggcggatcacgaggtcaggagatcaagaccaccctggctaacatggtgaaaccccgtctctactaaaaatacaaaaaattagccaggcgtggtggtgggcgcctgtagtcccagctacttgggaggctgaggcaggagaatggcgtgaacctgggaggtggagcttgcagtgagccaagatcatgccactgcactccagcctgggctacagagcgagactccatctcaaaaaaaaa

SEQ ID NO: 177676 - DNA, 601 bp, Human
tgattagccaccatctcacaattgaccgtgcttgtggtccactagacccttcagattgttttccgttgtgataccttggccttgactctgtcctcttttctgtgtgtggcgtgttgtggcgacggccgctccccaactcccatccccactctctccccaactccggctccactcacactccagttctttcatttccccagtataaaggctgagcttctggttccgccccgggccctggggatataaacatttgccagattcttcctcggcccctgggggaaactgaggattaattcaggtrgagtaagtggtgggatttgggtagaagtgaagccttgtcctgttgtggccatggtgcagggctgcggcacagccagccatcagtgtcatccgggtcagtaatgctcaaggcacagtccctggcccagcagcatgtcacctgggaggtggttaggaatgcagattctcaggcccacagagccctgataaaccaggagttctgggagggggtccagcaatctgtgtgttaagtcctgagagtgagtctgatgctcactcaagtcttgagaaccacgggtctgggtgagagatacggtagctg

SEQ ID NO: 177677 - DNA, 601 bp, Human; identical to SEQ ID NO: 79723

SEQ ID NO: 177678 - DNA, 601 bp, Human; identical to SEQ ID NO: 79724

SEQ ID NO: 177679 - DNA, 601 bp, Human
gactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctgacagcagctgccagctgctgctctcctctagcccacctgtgctctcccctgcccctgccactttcccccctgtatttttggggccattattctcgctgctcagcctgtcctctgcttgcccagaggccccctgagtcccrcacctttcctcctctgcttctccctggggccagcactccagctcacaggaagaagattctgaggctccatagcctagaagctggactggctgctgcattgctatagacgatagaggcctactaggggccagtgtgcatggacagtgaggccagggccatctgccttctctctgcttcattgtgggagagagagactgagaaagaccaagagagacacagagacagagattgaaaaacccagcatccacttcctccagagtcagggagacagagatgatggggcgtctccacggggagtcc

SEQ ID NO: 177680 - DNA, 601 bp, Human
ctgccactttcccccctgtatttttggggccattattctcgctgctcagcctgtcctctgcttgcccagaggccccctgagtcccacacctttcctcctctgcttctccctggggccagcactccagctcacaggaagaagattctgaggctccatagcctagaagctggactggctgctgcattgctatagacgatagaggcctactaggggccagtgtgcatggacagtgaggccagggccatctgccttctctctgcttcattgtgggagagagagactgagaaagaccaagagagamacagagacagagattgaaaaacccagcatccacttcctccagagtcagggagacagagatgatggggcgtctccacggggagtccagcaagccggcattcactgctccctggccttggtgccctttgccggagcctgtgtctgggctgctggtcccataacacgtcgacaaccctcaggatatggggcagggttgctgcaggggtggatttgggcagtggagagtggctggcaccctggaggctgtgtaggcccagctgtggctcttctgggcctgacttcagggtggagaagtgaaggg

SEQ ID NO: 177681 - DNA, 601 bp, Human
ggatgtattctagaggtctattcctaccctaggaacaagtgcagttttagattatctgttcatcattgctgctggttcaaggatggctcttaacaggggcctggtccggatgaccttggcctgggggcttgctgagctaggagactgcagttcagatagtgaaacagggagtggattagtaaagggggttccctttgccttgagggaagttggagctggagagagtggattctccagggcctcaggtatcccctgctggggagtcaggctctttagagcttgcaggtcagggaaggcaagygcttcgtcctgacatagcatctgttggcatttcttgggcttcttcaatgcagctgaggggggcagggcgaaggcgtggtgggcagttacgacggctgatagtcccaagtgggctgcaggcggcagtggtgtgacggcagaatggtaacctctggggtcattggatgcaactcactcaccaaacagatggggaaactgaggcacaattttcatcagattcagttctgactcttagcctcattccccttcgcattgcgcagtcccagagagcccccccttttgggggagtgcctgacctgca

SEQ ID NO: 177682 - DNA, 601 bp, Human
gggcctgagtccctctgctgtgcccgctgcaggtccccaataaagcctgtgccctggcctcggtggtgtgcagtgtctcgccatcagcccccatccctttcacaatccctcacggccccgagcacttgctccctggccacttcccacactcccccagcccttgccaccttccaaggaggaggcctggaataatcaggggcttcaccgaatctcctgaggctggccaggagcctccggccctgactgtttctctggtagccccagagctgcctccgtgttgggtgtgcagagagctgtgctragggaggtgccatctgggcgccgccgagggcttggggtaggaaggcaccaaaccaggtgcaatctcgagtctccctgccttgcagggccactgggcagggggtggatggaagggcagagtttgagaggtggggtgaggtccggcctgtgcctgggtttagtctggcttctgtcactgatgtgctgtgtgtcctcaggcagctcccaaccccctcccagactcaggccttccagagtgaacagcttggttctgtgaaggtccttccagccccaccctccaggaattgtcaaacctgtgctg

SEQ ID NO: 177683 - DNA, 601 bp, Human
gagggagcgttggagggatgaggctgagagcgtggactgccgggccaggtggctggtgtccgtggtgatggggaatttctactgtagacagcgagagggtagcgagcacagcctgatggactcctcgcacccatcccttcactttgacacttgccagcctatggctagtcttatttcctctacacacccctgcactttgcccagacagcatctcatttcatctgtaaatatttccggatgcatctctgaaagataagggctcaaaaaaaaaaaaccataataccaacttataaaataatcycttaatatcatcaaatatccagtaattgttctaatttctaatttgtgctataaatatgcataggttttacggtttgtttgaatgagatccaaacagaagtccataattgcaattggttgattgctctttcatcttttattttttcctagtaaattatctatcaaagaaatggggccgtttgtcctgtagggtttcccatggtgtgggttttgttgactgtgtctttttggtggtgtttgacatgttctctgtcccctgcgtttctgtaacctgggacttagctccagaagctcatacggt

SEQ ID NO: 177684 - DNA, 601 bp, Human
gctctgttgcccagctcactgcaacctccgcctcccaggttcaagcgattctcatgagtcagcctcctgaatggctaggattacaggcacgcaccaccacgcccagctaatttttgtattcttttttagtagagacagagttttaccatgttggccaggctggtatcgaactggcctcaagtgatccacctgccttggcctcccatgagacgtgtttttgatacagctgtctgtcctgaaagcaaagtggggagagagtgccaggagtcagggcatttttacttagaaagggcacagagttgacagaaaagtgggggtgaggaggtgggggaaaggaacagccagtgttgagcccttgctgggttccagacagtgaggttgggaagtcctgggtttgaaccctgcctccctcgcttgagcctgtgggcagccttctgccagcaccttccggtagtattgcctcaaaagcctgtcctgaggctcaggggtgctagtgtgagcagcctggccctgtgcctggcacccaacagggctccattagggcagtagtacctctcgctgcagttagcattttcattttcttggtctcacatgtcccatt

SEQ ID NO: 177685 - DNA, 601 bp, Human
cgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaagtaggtgccagcagcaggcaggtgggtgggaggcccagacgggggtggcaccggatgggctcctcgtggtattccgttagccagggctttaggcacagagaagtgaggggctggtgcaggcacgcagcaggctcaaccrccaggcctgagggcatagtcagctgagcctgtgctgggtggggtggaggcctgggccctgtaaggagaggaatgttggttactcccattttagggggagaagactgaggcccaggcaacatcctgtaggtagctgggggcagaggcagcactcacatttaggaccattctcgaaggttcatgctgccatgccctgcctggggccttggttggggaagtggtaactgagctggggcctggttgtgcagggtgggccacgtgcctgccttccccgcctgctgggcctccctcttgtccacca

SEQ ID NO: 177686 - DNA, 601 bp, Human
catctactgccactccaactcccgcaatgagttttggtgcgccctagtggagaaggcctatgccaagtaggtgccagcagcaggcaggtgggtgggaggcccagacgggggtggcaccggatgggctcctcgtggtattccgttagccagggctttaggcacagagaagtgaggggctggtgcaggcacgcagcaggctcaaccgccaggcctgagggcatagtcagctgagcctgtgctgggtggggtggaggcctgggccctgtaaggagaggaatgttggttactcccattttagggrgagaagactgaggcccaggcaacatcctgtaggtagctgggggcagaggcagcactcacatttaggaccattctcgaaggttcatgctgccatgccctgcctggggccttggttggggaagtggtaactgagctggggcctggttgtgcagggtgggccacgtgcctgccttccccgcctgctgggcctccctcttgtccaccatccgcctctgcctggctgactgtccattctgtctttgctgacccctccttctgctccgtgccttctgcttctgtgtccccagtgcccaacacagag

SEQ ID NO: 177687 - DNA, 601 bp, Human
tagacaaaacataatgcttctcattttaaccatatggaaacatacaattcagtggcattcattatgatcacagtgctatgggccatcaccactatctatccccagaaccttctcatcattcccagcaggaggtctatacccatccgacagtaactccttcccctccccctgaccattgttggcactttggaaaagagttgcttttttttttttggacagctgattttttaagattgagccactaaggcttaggggaatttaagccttatatgttggcccgagtgttaagaactgggttccrgtgttggctccgccgtggcctgctgcgtgactgtaacaggttgtttgacccctctgagtttcaaaaacctcccctatgaggtaaaggatgcagcctggctggggagcatgagctgggaagtctttccacattgcttcccagactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgca

SEQ ID NO: 177688 - DNA, 601 bp, Human
tgcttctcattttaaccatatggaaacatacaattcagtggcattcattatgatcacagtgctatgggccatcaccactatctatccccagaaccttctcatcattcccagcaggaggtctatacccatccgacagtaactccttcccctccccctgaccattgttggcactttggaaaagagttgcttttttttttttggacagctgattttttaagattgagccactaaggcttaggggaatttaagccttatatgttggcccgagtgttaagaactgggttccggtgttggctccgcygtggcctgctgcgtgactgtaacaggttgtttgacccctctgagtttcaaaaacctcccctatgaggtaaaggatgcagcctggctggggagcatgagctgggaagtctttccacattgcttcccagactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcc

SEQ ID NO: 177689 - DNA, 601 bp, Human
ttaacaatattcctggccgggcatggtggcacatgcctgtaatcccagctactcgggaggctgaggcaggagaattgcttgaacccgggaggcagaaattgtggtgagccaagatcgcgccattgcactccagcctgggcaacaagagcaaaactccatccaaaaaaaaaacaaaaaacaaaacaatgttcctgaatatttaacaattcctggaatatttaacaatttaaatattcccgaatatttaacaacagctgagccagtgcacgtgggccccagcattcccctgggctgacccactatgggcaccttcctttactgagactgctgcccatgggggttttaaagctctgtgaacacagcactgccccatgactgcaattcccatcccatcctgtaggtcccgtgcagcctcctagccctccagcacctgagtccctggtctgggttccagtgtggccctgcctctctgagcaactgtgtccctccacaggcagtgacagcagctgacatggaggcccgcctggcgtgcggcctggtaaagggccacgcatacgccgtcactgatgtgcgcaaggtgcgcctgggccacggcctactg

SEQ ID NO: 177690 - DNA, 601 bp, Human
taacaatattcctggccgggcatggtggcacatgcctgtaatcccagctactcgggaggctgaggcaggagaattgcttgaacccgggaggcagaaattgtggtgagccaagatcgcgccattgcactccagcctgggcaacaagagcaaaactccatccaaaaaaaaaacaaaaaacaaaacaatgttcctgaatatttaacaattcctggaatatttaacaatttaaatattcccgaatatttaacaacagctgagccagtgcacgtgggccccagcattcccctgggctgacccactrtgggcaccttcctttactgagactgctgcccatgggggttttaaagctctgtgaacacagcactgccccatgactgcaattcccatcccatcctgtaggtcccgtgcagcctcctagccctccagcacctgagtccctggtctgggttccagtgtggccctgcctctctgagcaactgtgtccctccacaggcagtgacagcagctgacatggaggcccgcctggcgtgcggcctggtaaagggccacgcatacgccgtcactgatgtgcgcaaggtgcgcctgggccacggcctactgg

SEQ ID NO: 177691 - DNA, 601 bp, Human
gtcatggtggcagctcacggtcccttgtgggaggagacaggcagggcttcctggagaggggctgggcatggcctcagtgcccctggccacaccgtgccgctggaggcctggtgcaagactgcccctcgtgcctcctcgcctttgccagacagattctggtggggctgcctcttagacagctccctttctcctccccggccctgacaccccagctcggaggagtggcagaaagtgagcaagagtgagcgggagaagatgggtgtgaccgtgcaggacgacggtgagttctggtgagtgtgtrtgtgccctgggcgtccggggctgagggggcttcccacgggcctggcggggagcaccaggtggggagtcaggagccaggcctctcctgcatgccccatcatcaatttgctgtgtggccttggacaagtcacaccatctcagagcctgtttcctcctctgtaaaattagttgggcagtaccaggccctttcatccccacagtcccctctgccgaactgaggggtcctggagccgctgtggcacccagaccgagcctttggcatgcaggtcagggagccgtctaagaggtgggcccaccagga

SEQ ID NO: 177692 - DNA, 601 bp, Human
ctcagcctgcctccaggggccctctggcagcctgatttctgaaattaggtagcagaggctcctagaggaactagcttctaagctgagacttgaggtacagagtaggccttggtgggcaaggaagaggacgtggctcagaggtgagagaacacagctgtgtttgagaagggagctaagcaggtacatgggtgagctgggaagatgacagcagctcagcttaaagagcccagtaattggctgggtacagtggctcatgtctataatcccagcactttgggaggtcaaggtagaaggattgctkgagtccaggagtttgagaccagcctgggcagcatagtgggaccccatctctacaaaaatgaaaaattagctgggtgtgatgatgtacccctgtagtctcagctactctagaggctgagaggggaggattgcttgagcccaggaggttgagtttatagtgagccatgatcgcaccactgcactccatcctgggctaaagagcaagaccctgtttcaaaaacaaaaagaaaaaccccagtagtaataaaagttcatcctgcattcatccagcctgcatgagtcctgaatgtgggctaggctc

SEQ ID NO: 177693 - DNA, 601 bp, Human
gaacaccttggtcactgccgctgccctggctgccgtggcagacattgtgaggatgccgtggcatgggccccacttgaatattcacagagggcccagcctgcccagccttggcttctgtgggagctctcagcctgatttctttctgcctaagacccacaggcctgggatgtttggtggatgaggaaggggaagattactggtggttggggccgggccctgggaggctctgggcatctactgggcccccactgctcctccctcaggcctcagggccccttgcagccccttagccttcctgcaytggaggccttgctgggcaccaggaggaggcatccttgagcatagccaggtggggtcacctatggccgcaccgcctggcctggaacctgaggccttccacgtgttgtgatgcccagtgtgtggtgacagtcagcatggcgggaccccatgtgcctgtcagaccttgagaacggaatgaagccaccgggccctgcagaggctgggtacatgctgagtccttggcatctgatgtgcctggccacgccgtggcactttgtttatactcttgtgctggtacattcattgcatgctagtgtcttgt

SEQ ID NO: 177694 - DNA, 601 bp, Human
agagggcccagcctgcccagccttggcttctgtgggagctctcagcctgatttctttctgcctaagacccacaggcctgggatgtttggtggatgaggaaggggaagattactggtggttggggccgggccctgggaggctctgggcatctactgggcccccactgctcctccctcaggcctcagggccccttgcagccccttagccttcctgcattggaggccttgctgggcaccaggaggaggcatccttgagcatagccaggtggggtcacctatggccgcaccgcctggcctggaamctgaggccttccacgtgttgtgatgcccagtgtgtggtgacagtcagcatggcgggaccccatgtgcctgtcagaccttgagaacggaatgaagccaccgggccctgcagaggctgggtacatgctgagtccttggcatctgatgtgcctggccacgccgtggcactttgtttatactcttgtgctggtacattcattgcatgctagtgtcttgtgacatattgttgtgactttgccatgtgacgatcttcactagtgtgaccagaacacttttttcaggattgtcaggcaggtcctggc

SEQ ID NO: 177695 - DNA, 601 bp, Human
tctcgctttgttgcccatgctgaccttgaacgtccagcttcaagtgttcctcccaccttggcctcccaaagcgctgggattacaggcatgagccactgcgcccagcctcctttaatagtttttattgagatataattcacagagcatgcaattcagccatgtaaagtatacaatctaatgacttttgtgtgatcagagtttatgcaaccatcaccacaatcaactgtagaacattttcatctccccaaaagaaacccactccctttaaccaccaccacccattcccattgacctcttcccytcagccctgggcaaacacgaatccgcttctgttattatagatttgcctgttccggacatttcatataaagggattccatcgtcccttccatggtggtgagggggaggcggggtgggccagggtgttgtagggtgtgtctccgcgtggcccagcccctcccgcctcctgcaggtggaggagaaccgccagtaccgcatgcacagcctgcagcacaaggccgccagctccatctacatcaactcacgcagcgtcttcctgcgcaccgaccagcccgagggccgctatgtcatcatccccaca

SEQ ID NO: 177696 - DNA, 601 bp, Human
tgtagtctaccagctatgcctcccagtttctattcatcaacaaaggagtaaagagacagagacaaaggagtaaagagacagagaactaacattcaaataccttctgtgtggaaggtactctattaggaactttgtatgtagtcttcacaacaaccctgtgaaatgatatctcacttttaaaataggaaactaaataaaggtcaaagcagttaactgacatgcctaagatcagaaagctggtaagtggtgacccagctccatctaaaccagaagctcatggtaactacttacacacagaaacccagtatctttagcatgccataagaacagggcccacaaatataaggagaactttacttcagagcaacagccacttaaatcaacatttttggtaccaaacaaaagtcatcttttgttgtggacaccaaaacctttattttacaaccttgtctacgaggatcttggtgactttttcatatacactattaaatcaacagtgttaaaatcagtgttaaaatcaccactattcatcatatgattactcttctattaacagaagttttatcaataaaaaggaaatgaggctgcccaggataattta

SEQ ID NO: 177697 - DNA, 601 bp, Human
caggctggagtgcagtggcatgatcacagctcactgcagattcaaattcccaggctcaagcaatcctcctgcctcagcctcccaagcagctgttactacaggcacacgccaccatgcccgactccttttttttttttttttttagtagagacaaggtcttcctattttgcccgggctagtctcaaactcctgagctcaagcaatcctcccacctcggcctcccaaagtgttgggattacaggcatgagcccctgtgcctggccttcttttctacccaaagccaccaaacccaaagggaagkgaaggtgaagtagaaggactcatacacataacgatataagcccaatgtactcattaaaagtccttattatttctcatttcacttgtacgacatttacaatacatgagatctgcttataagacatatctatataaagacactacaaatgcaatgtgtccaaaataatcatcttccctgctctccaatcaccaacactcctaatttgttccttctttctatgttccctattgggctaatgacactaccatctaccatctcccctgatccgtagttaggcaattatatttttctacaacatga

SEQ ID NO: 177698 - DNA, 601 bp, Human
aaagtggctacatatgtggaagaagactgcagggcatttaacactgtctcagatcatagcccttgtaccaaggaagttggcagctactatatgaatgaattagtcaggaaatcaaggttaagcaccttacccatatcttttattttatttatttattttttgtgagatggagtttagctcttgttgcctaggctggagtgcaatggcgcaaccttggctcactgcaacctccgcctcccgggttcaagtgatactcccagcctcagcctcctgagtagctgggattataggcgcctgccascatgcccagctgattttttgtattttagtagagatggggtttcaccatgttggccaggctgatcttgaacttctgacttcaggtgatccacccgcctcagcctcccaaagtgctgggattacaggcatgagccaccacacccggcctattttatttttttaagacaggatctcactctgtcacccaggctggagtgcagtggcatgatcacagctcactgcagattcaaattcccaggctcaagcaatcctcctgcctcagcctcccaagcagctgttactacaggcacacgccaccatg

SEQ ID NO: 177699 - DNA, 601 bp, Human
cactacatgtagacacttgggctgaaagcctatttatagagatcaagaacactggttgataagatacaatattaaaaataaatacacatctaaattgagggataaacaaagtggctacatatgtggaagaagactgcagggcatttaacactgtctcagatcatagcccttgtaccaaggaagttggcagctactatatgaatgaattagtcaggaaatcaaggttaagcaccttacccatatcttttattttatttatttattttttgtgagatggagtttagctcttgttgcctaggcyggagtgcaatggcgcaaccttggctcactgcaacctccgcctcccgggttcaagtgatactcccagcctcagcctcctgagtagctgggattataggcgcctgccagcatgcccagctgattttttgtattttagtagagatggggtttcaccatgttggccaggctgatcttgaacttctgacttcaggtgatccacccgcctcagcctcccaaagtgctgggattacaggcatgagccaccacacccggcctattttatttttttaagacaggatctcactctgtcacccaggctgga

SEQ ID NO: 177700 - DNA, 601 bp, Human
cactttcccatttagcacataagattgtccctccaggttccaatgatgtctgaaggctctgcttccatctgctgtttcagactggaatcttcttttttaaaaatcagctttattgagatgtaattcacttaccaaacaattcacccatgaagtgtaaaattcaatggcttttaatatattcagagagctggacaggtatcaccaaaatcaattttagaacatttcatcactacaaaaagaaaccccacccctcttagtaatcatctcctagttttaattgcctctccctctctgcagcccraggcaaccgctaatctactttctatctatgaatttaccaatgctggacatttcctacaaatagaatcatactatatgtgatcctttgtaactggcttctttcacttaacacagcattttcaagggtcatccatgtcatggcacggatcagaacttcatgtctttgttaccaaatatttcattgtatggatattccacattttattatttatctattcatcagctgatggggtatttgggttgtttctgctttttggctattatgaatgctgctataaacattcatgtactgctggtaact

SEQ ID NO: 177701 - DNA, 601 bp, Human
gcctccccagcagctgggactacaggcacccgccaccacgcccggcttattttttgtatttctagtagagacggggtttcaccgtgttagccaggatggtctccatctcctgacctcgtgatccacccgcctcggcctcccaaagtggtgggattacaggcatgagccaccgtgcctggccagttataggattctaaagctaaaagaaactgcacatgcctactgctctctctccttttctagatgaaggcactgacgtctacagagaaataattgacccaaatcagacagccaatttatsgaagaaccaatactataatcccaatatctagacccccactttcccatttagcacataagattgtccctccaggttccaatgatgtctgaaggctctgcttccatctgctgtttcagactggaatcttcttttttaaaaatcagctttattgagatgtaattcacttaccaaacaattcacccatgaagtgtaaaattcaatggcttttaatatattcagagagctggacaggtatcaccaaaatcaattttagaacatttcatcactacaaaaagaaaccccacccctcttagtaatcat

SEQ ID NO: 177702 - DNA, 601 bp, Human
agcctaggattttctacagctgtatcattgaataaagtactttacaatggcctagtttcttttcacctatatagacaagcctgatctaaccacgcctttgcaacatcacatttatgtaattataggattctattttattttattttgttttttgagacggagtctcgctctgtcgcccaggctgaagtgcagtggcgcaatcttggctcactgcaagctccgcctcctgggttcacgccattctcctgcctcagcctccccagcagctgggactacaggcacccgccaccacgcccggctwattttttgtatttctagtagagacggggtttcaccgtgttagccaggatggtctccatctcctgacctcgtgatccacccgcctcggcctcccaaagtggtgggattacaggcatgagccaccgtgcctggccagttataggattctaaagctaaaagaaactgcacatgcctactgctctctctccttttctagatgaaggcactgacgtctacagagaaataattgacccaaatcagacagccaatttatggaagaaccaatactataatcccaatatctagacccccactttcccat

SEQ ID NO: 177703 - DNA, 601 bp, Human
atgaaacctatgtgcccagggcaaatatagaaaatctgtaaccaaaggatgaaagatagttagatcattttgcaagaacttcttataactctgtatgttttctacctctatgttttcagcctgcagagatgcagttttgatcttgaggctatgagatgtattttcagatcagatttagcctaaggttacttagatttagcctaggattttctacagctgtatcattgaataaagtactttacaatggcctagtttcttttcacctatatagacaagcctgatctaaccacgcctttgcaayatcacatttatgtaattataggattctattttattttattttgttttttgagacggagtctcgctctgtcgcccaggctgaagtgcagtggcgcaatcttggctcactgcaagctccgcctcctgggttcacgccattctcctgcctcagcctccccagcagctgggactacaggcacccgccaccacgcccggcttattttttgtatttctagtagagacggggtttcaccgtgttagccaggatggtctccatctcctgacctcgtgatccacccgcctcggcctcccaaagtggtgg

SEQ ID NO: 177704 - DNA, 601 bp, Human
ggctccagatcctaaccacaggaaccaggctttcccacatggaattctgcaactcagcatcacctattacaggccctcaattacagcttctctttccaatcatttatgcatcccccaggcacatactgaggccatgctagagaggtcagcattaggtaatgcccaaagacattctacccactggcagctcaaatctcaaccattactacagcctacagatcattcttctttctcatctcccaaaaatctctctagagacccaagacaactcctctagaaattctgactccaaaggtctggrtggaatgcaggtatcagtattaattaattaattaattatttttgagacagaattttgctctgtcacccatgctggagtacagtggtgtgatctcagctcactgcaacctctgcctcctgggttcaagcaattctcctgcctcagccttctgtgtagctggaattacaggtgcccactaccacgtccagctaatttttgtatttttagtagacacagggtttcaccatgttggccaggctagtcttgagctcctggcctcaagtgatccacccgccttggcctcccaaagtgctggggtta

SEQ ID NO: 177705 - DNA, 601 bp, Human
tacaatcttatgaatatactaaaaaccacggaattgtacattttaagatggtgacttgtatggcatgtgaattatatctcaattttttaaaaaaaagtgaatgtaatttactatattaagaaaataaagaagaaaatatatataatcaattcaattaatgcagaaaaaagcatttgctgaaatgtgatatcaatcatgattagaaactcttagcaaactaggattacaagggaatttacttaatctaataaaaggtaattaccaaaaactggagcaaacattatactcaattctaaaatgmtgaaagcttttcctgagattaaaaacaggagaagggtattcctcctcaccacttctattcatcatagtactgaaggtattaaccagtgcaattaggcaagaaaaagaagtaaaaggagaaggattacaaagaaagaaaaagaactattacaatttacagatcatgtgctcatgtacgtgaatacagaaaactcaatagaaaaaccttcatgtctctgagtaggtaaagatttcaaaaatagaaccacaaagcattagaaaggaaataattaataaatttgaccacattaaaattctatct

SEQ ID NO: 177706 - DNA, 601 bp, Human
gaatgttcacattagcttattcataacagtcaaaaagtgaaggcaacccaaatgtccctcaagtgacgaatagataaaatgcagtacatccatatactattattcagccatgaagagaaatgaagtcctgatccatgctacaacatggatgaaccttgaaaacattatgctaagtgaaagaagccagtcacaaagggcaatatactgtgtaattccatttatatgaaatgtccagaataggcaaatccatagacacagagtagattagtggttgccaggggagaagggagaagtgaggaaygactgcaatgagtatgaggtttctttctggagtgatgaaaatgtattggaattagttgtaatggttgtacaatcttatgaatatactaaaaaccacggaattgtacattttaagatggtgacttgtatggcatgtgaattatatctcaattttttaaaaaaaagtgaatgtaatttactatattaagaaaataaagaagaaaatatatataatcaattcaattaatgcagaaaaaagcatttgctgaaatgtgatatcaatcatgattagaaactcttagcaaactaggattacaaggga

SEQ ID NO: 177707 - DNA, 601 bp, Human
aaaagaagtaagcagtgtgatctttcttccatctttccacctgctcagcaagtcaaccaaatttcataaactcttaccagattcacaaagcacatgactgcaggcaggaaggcactaagagcttcggactgagggaagacacaatggagaaaataaagcaaacctaggatcctgatggtcccatatcccagggatatagtatccctgggactactgctgcagttgcaaattttttatgatgactagaagtatgtctgcaggaatctgatgaaaacttatgtctacacaaaaacttgtatgkgaatgttcacattagcttattcataacagtcaaaaagtgaaggcaacccaaatgtccctcaagtgacgaatagataaaatgcagtacatccatatactattattcagccatgaagagaaatgaagtcctgatccatgctacaacatggatgaaccttgaaaacattatgctaagtgaaagaagccagtcacaaagggcaatatactgtgtaattccatttatatgaaatgtccagaataggcaaatccatagacacagagtagattagtggttgccaggggagaagggagaagtgaggaa

SEQ ID NO: 177708 - DNA, 601 bp, Human
acacaaaaattctctccagggcaggaataaatgttcatttcagcagctctggcctgactttcacaacacttgttacccagcacctgtgaaccttattttaaaaccctgctgtctgggagctcaacacactaaccaaaagaaattctgaagttctaacacctccacagacccagcaaaaccctgataaaaggtagcaaaatgagaaggaaaaaacaaaaaggtctagagttcaagccagtttcacctctacctcaccacagagtgtgtgtgtgtgtgtgtgtgtgtgtgtgtgtgtgtgtakagagagagagagaaagagagaccaggatctctgctttctcatctaaacaagggagaggatgagctagatgatcttaagggtccctcaagcacctacattctgtgaatctatgaaaacaagaaactatgctttctcaaagctctgcagttaagattccttcctgagatggcatcccacagttttaaataggtatttcatacatatcatctaatacaatcaccacaatcctgaggtaagttttacttgtagattagaaaatttgggagcagacttgcctacaatcattaagtaattaaaatc

SEQ ID NO: 177709 - DNA, 601 bp, Human
gacacaaaaattctctccagggcaggaataaatgttcatttcagcagctctggcctgactttcacaacacttgttacccagcacctgtgaaccttattttaaaaccctgctgtctgggagctcaacacactaaccaaaagaaattctgaagttctaacacctccacagacccagcaaaaccctgataaaaggtagcaaaatgagaaggaaaaaacaaaaaggtctagagttcaagccagtttcacctctacctcaccacagagtgtgtgtgtgtgtgtgtgtgtgtgtgtgtgtgtgtgtrgagagagagagagaaagagagaccaggatctctgctttctcatctaaacaagggagaggatgagctagatgatcttaagggtccctcaagcacctacattctgtgaatctatgaaaacaagaaactatgctttctcaaagctctgcagttaagattccttcctgagatggcatcccacagttttaaataggtatttcatacatatcatctaatacaatcaccacaatcctgaggtaagttttacttgtagattagaaaatttgggagcagacttgcctacaatcattaagtaattaaaat

SEQ ID NO: 177710 - DNA, 601 bp, Human
catgcctgtaatcccagcactttgggaggccaaggcaggcagattgcttgagtccaggagttcaagaccagcctaggcaacatggcaaaaccctgtctctgcaaaaatacaaaaattagctagacatggtggtgcatgcctgtaatgccagctacttgtgaagctgaggcaagaggatcatttgagcccaggatgtagaggttgcagtgagctgagatcacgccactgcattccagcctgggtgacagagtgaggccctgtctcaaaaaaacaaaaaacaataaaataaagggagaggcaraaagatcgtctgtcagagttaacagttctggttttaccagtaactagccagttgatatagagtaagtcatcttttttgtgaagccctccttgatctctaggctgggtggttctttaccctctctgttcccacagcacccaatatatgtaatagtaattgactattataagtgtttatcttccataccagactgaattctaagtgcagaggccatgtcaaattaatcacagcttcccagaggctagcacacacctggacaaagtaggtgctcagacagtaagtgaagaaaggaaaaaatga

SEQ ID NO: 177711 - DNA, 601 bp, Human
gctgcagcctgtcatctccaccatctgtgcccttgaaacaagccagatactggctggggaaagcatccttcaaaattcactagttcatcctggttctcaccttcccaacaatactgccatttgaaggaggcaacatgagtaaagagcctagaaattaaaagattagcccactattaatttagcatattagaaaggccttctttggttctcacacctgcaaaacaatggaaagctggtccgctgtggaaggagagcctccaaataacattattaggggcaagtagtaaattcaaaaggtgaygttacaggaattaggagacctgggttctaatcccaattctgctattaaaaacactctgaaaaatatagtcccttctaccgagggtacatctaaagaaacttattctttattggcctgtttttcatttaactaataaaaattagttccctgaggaagacatacattaatgttattaaataactaataataatattaacaataatgatgacaatgatagctacatttctatggtgatgttttacaacttataaagaactctcacatcaatcagctcacttatttctcactataacctctttt

SEQ ID NO: 177712 - DNA, 601 bp, Human
ccacaggactccagcaaaagaatcacatgaggtaattcacatgtgagcatatacaaatgaggtagtattatcataactaatagtataagaggatggtaaatagggaaaggagagatatgacacttaaaaaaacctataccaaatatgcaattttgcctagagttggccctagtcttcaacttatagaaaattaaaattcttgcatacatatatatacatgtgcacaaatttatacatacaaaagtagatgtacacacgtatctgtacatatacactcaatattattcatatgtgcatgcaygaatgaacatacacataattacctgaatgtttatatttatacatatgttcgttcatgaatacctgagtggactttatctttgttcatgaatacttaagtaggctttaattccaaatatatgcaaacccacagggctatgtctctgtttacatacacatttacatgccactagcacatatttacatacatacatgcaggaaagatccttgcaaagacttggccactgaggttttcaaagacagcctctaacctgatgtttccatgacaagttccttaaacacaaactctaatttcctgact

SEQ ID NO: 177713 - DNA, 601 bp, Human
tccagaccagcctggccaacatggtgaactgtctctattaaaacacaaaaattagctgggggtggtggtgcatgcctgcagtcccagttactcaggaggctgaggcaggagaatcacctgagcccaggaggcacaggctgcagtgagccaagatcacaccacaggactccagcaaaagaatcacatgaggtaattcacatgtgagcatatacaaatgaggtagtattatcataactaatagtataagaggatggtaaatagggaaaggagagatatgacacttaaaaaaacctataccaaatatgcaattttgcctagagttggccctagtcttcaacttatagaaaattaaaattcttgcatacatatatatacatgtgcacaaatttatacatacaaaagtagatgtacacacgtatctgtacatatacactcaatattattcatatgtgcatgcacgaatgaacatacacataattacctgaatgtttatatttatacatatgttcgttcatgaatacctgagtggactttatctttgttcatgaatacttaagtaggctttaattccaaatatatgcaaacccacagggctatgtct

SEQ ID NO: 177714 - DNA, 601 bp, Human
tgttgccaggcacatggctcacgcctgtaatcccagcactttgggaggccaaggtgggtggatcacgaggtcaataggtcaagaccagcctggccaatatggtgaaaccccatctctactacaaatacaaaaattagccaggcatagtggcgtgcacctgtagtcccagctacctgggaggctgaggcagaagaattgcgtgaacccaggaggcagatgttgcagtgagccgagatcgcgctgctgcactccagcctgggtgacagagtgagactccatctcaaaaaaaaaaaaaaaaaaattaagtgttgaaaaaatagaaatacttgacaaaaaaattagcatggaagattgtgcttcggttataggcagcaaaggagttaaaggcccaacttaaaatacatttccatcatgtatcagctgagtcacttggggtatgtcatttaacttctctgagcctaattaatttctttgagtatataaaatgagcataatagtccttgccctgccaatctaaggccatcataagaatcacatgagggagccaggctcagtggctcacaccagtaatcccagaactgtgggaagccaaggtgagcag

SEQ ID NO: 177715 - DNA, 601 bp, Human
agaaataaattcaggatatactttaaacataattcgtttgttttttcttgtccaaaagactatagactatcaactttggcagagtacaacactatgccttcactgcactacccccaactttacgtactgctagtatttttgaagattgggtattttggtaataggcatacttgttatgtcatataaaaataagtaaacactccctttaaaggtgatgaacttctatatatcaaaatcaaattccaaagcacagaatgatggaacagaaagtgcttccagcactttcattttacagatgagyaaaatgaggtgcagaaaaggaaaaagattggttcaaggtcacgtaagtcagtggcaaaatagggctaagacccagttgagttgtcaatctagtctactttttccctattacattagctactaacaggtataaaaaattaagtgttgccaggcacatggctcacgcctgtaatcccagcactttgggaggccaaggtgggtggatcacgaggtcaataggtcaagaccagcctggccaatatggtgaaaccccatctctactacaaatacaaaaattagccaggcatagtggcgtgcacct

SEQ ID NO: 177716 - DNA, 601 bp, Human
aagttcagagatgttaagtacagttgggtgtggcttagcaatggggtatgttctgtgaaatgtgtcatcaggtaatttggtcattatgtgaacatcatagagtgtacttacacaaacctagacggtatagcctgctacatacctgggctatattgtatagcctattgctttctaggctacaaacctgtacagcacgttactgcaggcaactgtaacacaacggtaagtatttgtatatctaaacatagaaaaggtacaataaaaaatatggtttacaaggtaaataaaaggatacacctayatgagcacttaccataaatagagcctgcaggactggaagttgctctgggtgagtcagtgagtgagtgatgagtaaatgtgaaggcctaagtaggacattaccagtgtacacttaggctatgctaaatttattttaaacttcaggaatcactaggtgataagaatttttcaactcccttataatattaattatcagaccaccattgtatatgcggtctgttgttgtggcacatgactgttatttgcccagggtacacacaggttaaagagaggaattagatttgaattctggtctcattct

SEQ ID NO: 177717 - DNA, 601 bp, Human
tctaccaaaacttttaaaaaattgtctgtctgacaatttgacatcacactcaataagctgagtgtgatggcttatacctgtagtcccagctattcagagggctggggcaggagcatcatttgagcccaggagtttgagtttacactgagctatgatcacaccattgcactcccgcctgggcaacagagcaaaacctcgtctctttaaaaaaaaaaaaaaaaaaaaagcagtattctcttatatgcatcacattttactatttataggaccctttcaaatacatcaacatcacattttatccgtaagtgccctgggaaatagaatttgtaagttaagagagacagagagatcatctagtttactctccagccaattcttcatgatttctataacatccatttgagtgtcaaagcattcattacaacttcagaggacagaatgaatgactttaaatgaataaaatctgctcccttcaacaattagtactaatcttggttttgcagactccatagaccaaagaggaaattttcttctaagtgtaggtatctgaagacatgtccaggtgagggcacagtgtatcatcctcattttattgatgaag

SEQ ID NO: 177718 - DNA, 601 bp, Human
ctaacactttgggaggtcgaggcaggaggatcacttgaagccaggagtttgagaacacataatgagaaccacatctctaccaaaacttttaaaaaattgtctgtctgacaatttgacatcacactcaataagctgagtgtgatggcttatacctgtagtcccagctattcagagggctggggcaggagcatcatttgagcccaggagtttgagtttacactgagctatgatcacaccattgcactcccgcctgggcaacagagcaaaacctcgtctctttaaaaaaaaaaaaaaaaaaaaagcagtattctcttatatgcatcacattttactatttataggaccctttcaaatacatcaacatcacattttatccgtaagtgccctgggaaatagaatttgtaagttaagagagacagagagatcatctagtttactctccagccaattcttcatgatttctataacatccatttgagtgtcaaagcattcattacaacttcagaggacagaatgaatgactttaaatgaataaaatctgctcccttcaacaattagtactaatcttggttttgcagactccatagaccaaagaggaaat

SEQ ID NO: 177719 - DNA, 601 bp, Human
aggcagcacaaatcaggggaaagcagtataggctgggaatcagatgcctattgccattaactcttttccatttcagttttatcatctacaaggataataacttacctcagtaagctcctgtgaggattcagagagtcagtaagaaaggatccaacaggttgcaaggcactgaacgtgtgaatattgttttttataatcaatatgtgtaaaaatgactccgaataaaccagtccccactggtggaagcatggttcaaagtattttgatggtgactcggtattgtgttagaacttaaccactyttctgcttaagttctttaagcgtctcatcacctttaagataagtcaaactcctacatgatctgtcctgcttaccaatcctcctcatcacccacctctacttccttcactattcacattctagtcataaccacttcgcagttccctgtgcaagtatgcctcatgaacttccttgcccacatacatgctattctctttctgtgtggaatacccgcatttccccttaatccctgctctagataactaactcattcagctcagactttaccatcaggaagctttctctgacacatccaaccttt

SEQ ID NO: 177720 - DNA, 601 bp, Human
tctctgcctggtatcattacctgatgcttacttaacactatattataaatccttgtttacatgttctgattcatcacaaaaattgtgagaccaagagcagagatcttactagtccttgacttctcagcacccaaagaacttatcatgtggtaactattcattttataaatgagaatcaggcattaaaatgccatggaatcttagagtcagatctcagaccagtgaaccacagataacagaatttagagctaaaagggactttaagattatgtttgttaaacgaacaaagctttaaggcccragaactctgcaaacttccttgtacttcagagcagaataaatcactccatcaaatataaccctattgtacattattcatgcctctcttgcagcccttatctccccagtctgtcattaattttttttctcaaggattaagacagtgcacgttcatttttgtgtcacttgtattttggcataaagaagatactaagtcaatatttagggtatgagtgaatacatgaatgctcaggagagcagaattttgtgctggtttctactactaactcattcaaacgtagggagtgagtcacttaatctt

SEQ ID NO: 177721 - DNA, 601 bp, Human
gcttttaatttggtttttaagaaatcttttctgaaattaagaaatttgagatagcaagagagatgggcacatgaattcagtttactatcttgatccaatttccaaagaaatctaagatgttagtttagacatcacatatccaactacatcaatcttctacttaaaatagtccctcagctccagcacaaagtccaagctctctggcctaacatactggatccttaacccaacttttgttcatgctgtccatcagacaggaaagcactgcctttttctctgcctggtatcattacctgatgcytacttaacactatattataaatccttgtttacatgttctgattcatcacaaaaattgtgagaccaagagcagagatcttactagtccttgacttctcagcacccaaagaacttatcatgtggtaactattcattttataaatgagaatcaggcattaaaatgccatggaatcttagagtcagatctcagaccagtgaaccacagataacagaatttagagctaaaagggactttaagattatgtttgttaaacgaacaaagctttaaggcccaagaactctgcaaacttccttgtacttc

SEQ ID NO: 177722 - DNA, 601 bp, Human
ttcagaaaattagctgattttagcttagaatcaaatgcacctgctgccttttgttcactgtaaggaggaggctgcccctactgtttcaaaggtagaattaaattaatttacccttgaagatgacccatgactctttcctgcttcttgtatatattctttcagcccattttctctggagctactttcattttcctaggcatcttctcttacacatactttaagctgtggcttcttctgctctgatcaatctgaccttttctgctttctatcttccatgaattcctcacaacagttgatttaygtcatgcttttgtttcagagcattgcttttaatttggtttttaagaaatcttttctgaaattaagaaatttgagatagcaagagagatgggcacatgaattcagtttactatcttgatccaatttccaaagaaatctaagatgttagtttagacatcacatatccaactacatcaatcttctacttaaaatagtccctcagctccagcacaaagtccaagctctctggcctaacatactggatccttaacccaacttttgttcatgctgtccatcagacaggaaagcactgcctttttct

SEQ ID NO: 177723 - DNA, 601 bp, Human
caattctataagcagctgaagtattaattaaacgtgagggtagcatagagaacgccccattttgagacctgaaaggtattattaaatgtttactttccatttactttcttaaagctactagaggatatgctccaccaaattcaaaagtaaacaaaaaataatgtaggcgtggcatagaaaaaataggaataccaacacaaaaatgcaaagggattgccaagacaatggtgaaggaagatcccagaatgagagctacttattacaagtcctacttgactttttaatcaaatacctggataawaatattttttatttattttttttttgagatacagtcccactctgcggcccaggctggagtgcagtggcatgatctcggctcactgcaacgtctgcctccctggttcaagtgattcttttgcctcggcctcctgagtagctgggattacaggcacacaacaccaagcccagctaatttttttgtattacaggcgtgagccaccgcgcctggccggtaaaaatacttttaagtgagtattcttaatcaccattaaccccagaggtaattgatgttactatttggtatttagcctttcagaag

SEQ ID NO: 177724 - DNA, 601 bp, Human
gcggtggctcatgcctgtaatcccagcactttgggaggctgaggcaggcggatcacttgaggtcaggagtttgggaccagcctggccaatatggtgaaaccccatctctactaaaaatacaaaaattagctggctgtggtggcatgcacctgaaatcccagctactcgggcggctgaggcaagagaatcgcctgaactcaggaggcagaggttgcagtgaaccaagatcgcaccactgtactccagcctgggcgacagagcgagactccgtctcagaaaaagaaaaagaaaaaaaaaaaaataacacctaaacgcacagtcagactgccaaaagctaaagtcaacatgaaaatatttaaagcaaccagagaaaactgacatcatgtacaaggccagtcagtataattaacagctgactgctgatcagagtattttaaaaatcaaaacaaaaacttctgatcagaaaaaatggaggtcaaaaggcagtgggatgacatattcaaacagctgaaatttttaaaaattgccagtcaagaaatctatacccaacaaaactatccttcaaaatgaagacgaaataaagacattccagattaacaaa

SEQ ID NO: 177725 - DNA, 601 bp, Human
ttgacaaggtggggagatactattttagatacgataggcacaggcaagcctctctaataagatgtcatataacagtgacctgaatgaattaagggagcaagccacggggctctctgagaaaaggatattcctagcagatggaagaagttaaagactctgagacagaaacatgcttggtatgttcccacaacccttaggaattctacctatgtgggtgtaacaaagttagtaaggggaagtaaggaaagaaacaaggtcagaaagttagctgggaatcagattatgtaaagtcagagaggcrgtaataaaaactctggagtttagacctagaataagaaaccactggaggactgtgagtagaacagtgatgtaatctatacattttttttctttttaaagtgctttattaagatgtttctcacaaattagagaaaaggtttttttaatcaatggcaataaaatacaaattcctattttataacaaaatagtgaaaagcaccaaagaaaatttgcacctataactctaacaaactcaagggttcttggttctcagttcttttaaagtatagtctgatagagtactcaaagcttttagaaagag

SEQ ID NO: 177726 - DNA, 601 bp, Human
gtctaataaccacaaatctctgtttcaaacaaaagccagacattccaattcatcatccatctacccatatagccatccatccatccatccattcactgtgtgccagactccattctaggctctggggctacataaagaataaaacagataaagtccctggttctatgacttacattctagaagagaatagagtaaaaaacaatcaccaaagtgtctgctccatataggagcagagattggttgacaaggtggggagatactattttagatacgataggcacaggcaagcctctctaataaratgtcatataacagtgacctgaatgaattaagggagcaagccacggggctctctgagaaaaggatattcctagcagatggaagaagttaaagactctgagacagaaacatgcttggtatgttcccacaacccttaggaattctacctatgtgggtgtaacaaagttagtaaggggaagtaaggaaagaaacaaggtcagaaagttagctgggaatcagattatgtaaagtcagagaggcggtaataaaaactctggagtttagacctagaataagaaaccactggaggactgtgagtaga

SEQ ID NO: 177727 - DNA, 601 bp, Human
gctgccatggaacttaactatcaggatcaccaaacctcccacgagaaaccccatcctgatatcccttctgaaatacacattagcctccaagctctcacctttgtgtagctagtctcagaagctcaatctgtttctccctcttcttttagccatcactatccactcagtcccttggggcttccttctcccactcaaagcctagctgtgaatgggaagctagcttacagcttttctacctgcctctcccccaacccaacccctgaagacaagctcacagtaccttcttattctatgaattttkctctccacactgaacaggaaataaagtatgaaatgtagggaagagatcaaaagtttctaatttttcaaaattcatcactataatttcttactctctcctgatatggtaaatggcagtctaaacaggcttttgccctgcccttttcctctctttgcaaaaatctcctgaacccattacattaccaggggtcctcacctcaacctgaagataaagaacatcagcatcaggatcatgttatctaaagagaacaatgaatttctccccagactggatactatttccctaagtttctgccctacc

SEQ ID NO: 177728 - DNA, 601 bp, Human
ataaagtctacagtagcgtacacagtaatgtcctaggcctcgacattcactcaccactcactgactcacctagagcaacttccagtcctacaagctccatccatgttaagtgccctacataaatataccttttttttatcttttatgctgtatttttaccgtatcttttctatgtttagatatacaaccaccattgtgttataattgcctacagtattcagtacagtaacatgctgtacaggcttgtagcctaggagcaagaggctataccatatagcctaggtgtgtagtaggctatackatttagttttgtgttcactctatgacgctcacatgacaaaactgcctaaggatgcacttctcagaacatatcccctttgttaggcaacatatgactatacaattgtttgcctatctttttctgttgacttgaggtccttggaagcagagattgtctctgaattcatagtgccttgcacacaataggaactcagttaagacttgctgaattcattacactgagggcagcatataagatacagagaaggatgaatgcaagaaggataaattctggcatctacctagaaaaacaggtcctatc

SEQ ID NO: 177729 - DNA, 601 bp, Human
tataatttaaaaaaaaaaagaaaatttcaatgacatcattagcaacaatgctttcattccactaacactgagagccagacatttttctttttcagtttctttttaattttatctcttttggtgggtctttagaaatctcattttttttttatagagaggtataacttaatttgcacaaatcttaagtgtacaacttgatttttatatatgtacacacccatgtgttcactaccaagatcacccccaaagattccctcatgactattcctactcaacatcctcctcccagaaataactacaytgttctgacttctattatcatacattagttttgcttgttcttgaatttcatataaatagaatgacatagtatctgctcttttatatctggcttttttcactcaaaataatggccactttcaaaagacactacagtcattacccccgaagattccttcatgcctattcccactctacatcctcctcccagaaataaccactattctgacttctattatcatatattacttttgcctgttcttgaatttcatataaatcaaatgagacagtatctgctttttcatatctagcttctttcact

SEQ ID NO: 177730 - DNA, 601 bp, Human
ctggaactagaaaaaaataagatccactcaagcccagagttgttctgaggattaaacaataaatgcaaataacagatgtgaactgtagaatgctgtataaacagaacctccctatattatgcaatcttttattttcagaaattcttgggtgtataatttaaaaaaaaaaagaaaatttcaatgacatcattagcaacaatgctttcattccactaacactgagagccagacatttttctttttcagtttctttttaattttatctcttttggtgggtctttagaaatctcattttttttttatagagaggtataacttaatttgcacaaatcttaagtgtacaacttgatttttatatatgtacacacccatgtgttcactaccaagatcacccccaaagattccctcatgactattcctactcaacatcctcctcccagaaataactacactgttctgacttctattatcatacattagttttgcttgttcttgaatttcatataaatagaatgacatagtatctgctcttttatatctggcttttttcactcaaaataatggccactttcaaaagacactacagtcattacccccgaag

SEQ ID NO: 177731 - DNA, 601 bp, Human
tacttaggcccactgcttaatacctatttctaacttgaatagacatataattagacatatgaattccaagtccaaaagaataataatcttcaggtcttaaaggagaaataaaagcaagcaaaaattacaatattaccaattcatcatattggtgtgacagttatattttaaaaattatgcaatgtggaaacatcagcataagtgcttaattaatatttcattcttcccttagcactaacagacctgtcaagtaagcaaggaaagaacattatgcagatgttgcctatttataggtctcatrtatcagtaactaaaaaaaaaaaaaaagtcacaaaagttctggaggtaaaaggtcctcaattcacaatctgtcttccttaaatttacaggaagaaactccagtccagagaagaaacctgacttgcctatgcttgtccatgtacatttctgctacattcttaatatctcaatttcactacctaaaggaaataccatcccacattactctgaggtaagcaaaataatttttttctcaaggtgttaaataccttacaccagttcaaactcacaaaagtatgtctattttgaaaaacactggaac

SEQ ID NO: 177732 - DNA, 601 bp, Human
atctaactatttcaccttagtccaaaccttaagtttcataatgttatcctgctatttggcttttgtatgctacagtaagaaactagatatgttccagctgggcacactggctcatgcctgtaatcctagccctttgggaggccgaggcaggaagatcacctaaggtcaggagttcgagagcagcctggctaacatggtgaaacctcacctctactaaaaaatacaaaaattagccaggcatggtggcaggttcctataatcccagctactcaggaggctgaggctggagaactgcttgaayctagtaggcggaggctgcagtgagcagagatcacgccactgcactccagcctggatgacagagtgagaccccatcccaaaaaaaaaaaaaaaaacctagaactgttcctgttgacctaacaagggctaaaaattaatcccaaataaaaagaaacagaactaaaggagcaacagtgggtggtggatactcacctcctgtcctgtggccacatccattgctgtgtacacggtgcctgaagcactgaacagtaaggtggcggagaaagagggaaaaaaacacagtgttcaataaagtgatatt

SEQ ID NO: 177733 - DNA, 601 bp, Human
gactgtcacttactgaccttgaccaatcacaagctctctgagcctcagtctcttcatcaatacattgaagataatctcaaccttgattcccctcttttcaggattgttttgaataccaagtgagacaatggccaatgcattactcacatataagtaaataatttaagcaataaatttagacaataacaaaaatggtaatcacagtaataacagcatttaataagtacttggcacagcaactactctcccaccgctactgtttatcaaataccaactgtgtgccaggctctgtgctagatgmcgtacttatattatcacagtaaaacctaaccacacacaaccctacaaagtaagaatcatgatctgcattttcagtaagaaaattgaggctaagactcataagaaaattctaaggtcataatcaatgcctacaggtccatgtgactccaaagcctcttccagtctgttctttctattgtacacattctctctaaaaacacacttgaaaaataattgttggatatgttaactggaagacttcccagcactaacattcttcctatatgtgagacactaggtctgcccttctcagctggataac

SEQ ID NO: 177734 - DNA, 601 bp, Human
ttgtgtgtattgagaggtttgagggcttgattgaaagcccagaaccctcaatgccaaacacaggcctttacacacagagttggtgctcaacaaatgtctgtagaaaggaagatggcaagagagaaatcagtaggttggaaagtactttgtttttaaataaaaacaaaaaaaaaaatggcaatgggctcctctatcccatagaagtatactttaaattattttctaagtgttcattctctagagatatttttcctttttcctgcttagtggacaagaacacgaacatctaacagaactaagytgtctttctagaagcagcaagaagtataaagaaggaatgattcaaacttttatgtgacaaatccctgactctattatttcttcaagtcaagaatggacagtctcttgcagagaccaggttaatcatttagaatagaagtaattctgtaaaaaaatctgaccacctccattccctacctcaagtaaggaaaaattgctttggagtggggtttcctgttaggtcaggcttctggtctggctgcagctgtctataacagctgagcattagtttttcctaacgtttgaaaagcaacatgttgat

SEQ ID NO: 177735 - DNA, 601 bp, Human
gcttggtacaaagtaaagcacaatacaaatattatatacaaccactattactattttgcaaaaaaattttgatgggctggaatgatgggctaaaataataaaaatgggacttaatgaagatagtgaaaaagttccacatttccagtttaatgcaagcttatgtaaaaaaaaaaaaaaaatcagaaattttagttgactgcaaacttactgggagtcaaagcagacaacctaaaagataaaacaagaatgaaatcattaagctgtgttgagtttagaaagagtcccactctctccatagtgrtcagatctcaaatgaaacatctagttctgcacactgcattttaagagaacataaacaaacaacaagttattcaggaggatgagcagaataaggaaagatttgggatgtaaaatgagttaaggacctagatgtttgactcaggcagatgggttggtaggtttcccttaggcaaaacaaacagtacgaggatcaactgttagaagctacacggtggtagagttcagcctaacacagaaggatttcccagcaaaaaaggtgtccagcattacacagggtcacatacagagagctcagcatcac

SEQ ID NO: 177736 - DNA, 601 bp, Human
tttgctgttttatggcttactactcttggacaagttattaacgtctataaacctcagtttccttgtctgtaaaatatggataaaaaaaccctacctcacaatgagatactgttcatgaaagtgcttggtacaaagtaaagcacaatacaaatattatatacaaccactattactattttgcaaaaaaattttgatgggctggaatgatgggctaaaataataaaaatgggacttaatgaagatagtgaaaaagttccacatttccagtttaatgcaagcttatgtaaaaaaaaaaaaaaaatcagaaattttagttgactgcaaacttactgggagtcaaagcagacaacctaaaagataaaacaagaatgaaatcattaagctgtgttgagtttagaaagagtcccactctctccatagtggtcagatctcaaatgaaacatctagttctgcacactgcattttaagagaacataaacaaacaacaagttattcaggaggatgagcagaataaggaaagatttgggatgtaaaatgagttaaggacctagatgtttgactcaggcagatgggttggtaggtttcccttaggcaaaacaaa

SEQ ID NO: 177737 - DNA, 601 bp, Human
tgggaatactggtaaagatatgattaataaacaaatctataagtctcttaatcctactcccagaacacaaattccttcaataacatcgttttatcatgtagatgcatccactgatggggaactcaccattttgtgagacaggccatacccttactgacagctttcatttttccatatcctgaaccaaaatctaatacccctgtcgccttcagtagtttgcatgagctatattctctgtataataagttctgaaagagatgataaggtactaactttcagaggattcttcagagccagtcargacccacattaaggagacacagccatctcaaagaagaaggctttattctttatagtgttgggaatgtcaaagttcaactcttttcttctttaaggaaactgaagcttactagtgttttagatgcagaacaagaaggcgcccttatgaaatctaccagtaacaggaagaggtagctggtcatgcaatataagaggtaaagaaattagagtccaagatttagtccaatttcacctccacctacgatgtctctgaaccctgggcaagaagcttaacttttttttttttttcaggtatcggaga

SEQ ID NO: 177738 - DNA, 601 bp, Human
acaaataaaaacaaggcgagcctagagccctaaagtcttctgccagtcttggacaaagaagctggattggaaaaaaacatttcttgcattggcttgaactgtgtggtatcatcttatcttcatcctgatattgggaatactgctggacagatgtggagactgttggaagattttaacaaatgcaatcaagcaagggtaagatttgaatcctatttttttgactactaatcgacagctctttccataaaactctgtgttctgatttataattttttaatgtcctgactaataaacatgacacactaagtgtttcttcaacaatctcttttgagagagaagactatggggatttgaactgctatggtctgaatgtttgtgtccctcaaaatttatatgttgaaaatctaatcactaatgttattaggaggtggggcctttggaaggtgattacatcatgagggttctgcccatgagttcatccatatgtgatggagttcccctctgggacatctcacaaaaaccacagaccctcatttgcaacaccttcactgaatgctcaggttaatgtcctcttccatgaccttacagaggtatttttttt

SEQ ID NO: 177739 - DNA, 601 bp, Human
tcaatgtttccttactatagaatcagacaaataaaaacaaggcgagcctagagccctaaagtcttctgccagtcttggacaaagaagctggattggaaaaaaacatttcttgcattggcttgaactgtgtggtatcatcttatcttcatcctgatattgggaatactgctggacagatgtggagactgttggaagattttaacaaatgcaatcaagcaagggtaagatttgaatcctatttttttgactactaatcgacagctctttccataaaactctgtgttctgatttataatttttyaatgtcctgactaataaacatgacagactaagtgtttcttcaacaatctcttttgagagagaagactatggggatttgaactgctatggtctgaatgtttgtgtccctcaaaatttatatgttgaaaatctaatcactaatgttattaggaggtggggcctttggaaggtgattacatcatgagggttctgcccatgagttcatccatatgtgatggagttcccctctgggacatctcacaaaaaccacagaccctcatttgcaacaccttcactgaatgctcaggttaatgtcctcttc

SEQ ID NO: 177740 - DNA, 601 bp, Human
caagaatggaatgaatttagcaagggcttatggagccaaagccttctgataagccaagactaccatttagtaagatatccccagagagattatgggctgacatgagttagaagtgatagtttcactcaggagttggatcactcaaccctattacacgataaataaaaaggtcacttagcctatttggtcaatgtttccttactatagaatcagacaaataaaaacaaggcgagcctagagccctaaagtcttctgccagtcttggacaaagaagctggattggaaaaaaacatttcttgcrttggcttgaactgtgtggtatcatcttatcttcatcctgatattgggaatactgctggacagatgtggagactgttggaagattttaacaaatgcaatcaagcaagggtaagatttgaatcctatttttttgactactaatcgacagctctttccataaaactctgtgttctgatttataattttttaatgtcctgactaataaacatgacagactaagtgtttcttcaacaatctcttttgagagagaagactatggggatttgaactgctatggtctgaatgtttgtgtccctcaaaa

SEQ ID NO: 177741 - DNA, 601 bp, Human
tgaagccccaaagggcagaactaagatctctagcttgaagtgatacaataaaattatatttcatcacaacacaaaggaagacatcctaaaattagaaagactgacatgattcccacacctctagaagcatccaaacatttgacaaagataggatttagagtccatgttacccaaagaagagagagctactaaacctcccagagagtcctaccagatctgagatctatgagaccaagtattgggtcttgttcaagactctatcctcagagtccagcacagcagatgccaatatttactaaayaaatcactgaaaaaataaaagataactataaatattaaacgaaataatgtttataggagccccttaaaagctgcaaagtgttgtatacatagtcattatgctgacaattgacctctactttgagtgtctgtggttcaagaatggaatgaatttagcaagggcttatggagccaaagccttctgataagccaagactaccatttagtaagatatccccagagagattatgggctgacatgagttagaagtgatagtttcactcaggagttggatcactcaaccctattacacgataaataa

SEQ ID NO: 177742 - DNA, 601 bp, Human
atggtgatagaaatgacaaacacaggtacaatacaggaatgatagcagtgtcagcactaatttctaccaattccacagagcccaggctgagatctcactgtacagggaacttcaggagacaggaatatggaggcagctttctacccaagactgcttggcccttggccttacctcacggcacacagctgcaatttggccttcatccatgcaagtttctgtcaccacatctgtcaaggagcctccagccaagtattccataacaacccacagctcatctcccacgaggtaactgcaggaatayagataaagggtgagagagaacaatcagagtacactgagccatagcactgggtttcaaaggctaagcatatacacagagtgaaactacgtcttagcacaaagtaaagtaaaaggttctttactttggggaaaagcagaatctggggaacagaatcactaactttgaatctctcaaggatgctcctggagaaaaccaagtatacatgttctgtgaagccccaaagggcagaactaagatctctagcttgaagtgatacaataaaattatatttcatcacaacacaaaggaagacatcctaaa

SEQ ID NO: 177743 - DNA, 601 bp, Human
gaatatattataacgtgcttaggcaagtggttatctctaagactggaattatgagtgactttttacaatatatactttctagtactttataatttttctacaatgggtagaataaagttatcgttaaaaaaaaaatcatggtgatagaaatgacaaacacaggtacaatacaggaatgatagcagtgtcagcactaatttctaccaattccacagagcccaggctgagatctcactgtacagggaacttcaggagacaggaatatggaggcagctttctacccaagactgcttggcccttsgccttacctcacggcacacagctgcaatttggccttcatccatgcaagtttctgtcaccacatctgtcaaggagcctccagccaagtattccataacaacccacagctcatctcccacgaggtaactgcaggaatacagataaagggtgagagagaacaatcagagtacactgagccatagcactgggtttcaaaggctaagcatatacacagagtgaaactacgtcttagcacaaagtaaagtaaaaggttctttactttggggaaaagcagaatctggggaacagaatcactaacttt

SEQ ID NO: 177744 - DNA, 601 bp, Human
tcctccaatgtaattttttttctaattagatccttggtaaaggacctaaggcccaagagaaattactgaagaaaaatggaaaggatcttataatgacagaccagaggaaaacaacaaataagggtcatatttgaggaagcagacatatggaagtgatactagaagcagtaagttagcaggataatcttattttggtgaggagatattttgtactattttggatatgctgaatttgacatctgaagacaaatgtctggtaggcaacttaatttatgataaattatggtaaatatttacaagtcatttgggaagagatgatttttgtttaagttataaaaatggttgaacccggcaaagggtaaaggagaaagagaagaatcttggaaaacacctatacttagcaggcagaatgagtaataaagagacacaatggtacaattaaaatgcctggttctgctgctaccccattgactatataattctggacttccatctataaaatttgggaatcagatgagatcatctcagcttttctactaaatcaataatttgatttcattgacccaaaactaattttttagaaacttctaccaattaaaaa

SEQ ID NO: 177745 - DNA, 601 bp, Human
taaacattcttttaacactccatgctgcctttcaccttaaaacagtttttttaagtaaaggagttcctccaatgtaattttttttctaattagatccttggtaaaggacctaaggcccaagagaaattactgaagaaaaatggaaaggatcttataatgacagaccagaggaaaacaacaaataagggtcatatttgaggaagcagacatatggaagtgatactagaagcagtaagttagcaggataatcttattttggtgaggagatattttgtactattttggatatgctgaatttgayatctgaagacaaatgtctggtaggcaacttaatttatgataaattatggtaaatatttacaagtcatttgggaagagatgatttttgtttaagttataaaaatggttgaacccggcaaagggtaaaggagaaagagaagaatcttggaaaacacctatacttagcaggcagaatgagtaataaagagacacaatggtacaattaaaatgcctggttctgctgctaccccattgactatataattctggacttccatctataaaatttgggaatcagatgagatcatctcagcttttctac

SEQ ID NO: 177746 - DNA, 601 bp, Human
gaagacttaatagaaaatccactaattcaacctcttcactttaaaataaaggaagtaaggccccagtgagtaaaaggacttgccccaaatcaatcgcagagccagatctagaaacaagtcttccatctcctagctaaacattcttttaacactccatgctgcctttcaccttaaaacagtttttttaagtaaaggagttcctccaatgtaattttttttctaattagatccttggtaaaggacctaaggcccaagagaaattactgaagaaaaatggaaaggatcttataatgacagaccrgaggaaaacaacaaataagggtcatatttgaggaagcagacatatggaagtgatactagaagcagtaagttagcaggataatcttattttggtgaggagatattttgtactattttggatatgctgaatttgacatctgaagacaaatgtctggtaggcaacttaatttatgataaattatggtaaatatttacaagtcatttgggaagagatgatttttgtttaagttataaaaatggttgaacccggcaaagggtaaaggagaaagagaagaatcttggaaaacacctatacttagca

SEQ ID NO: 177747 - DNA, 601 bp, Human
ggaagatcagcagaacctggggaggttgaggctacagtgagccatgattgcgccatgcactccagcctgggcaacagagagagatcctgtctcgaaaaaacagagcagaaaaactggaaactctaaaaatcagagcgcctctcctcctccaaaggaacgcagctcctcaccagcaacggaacaaagctggatggagaatgactctgacgagttgaaagaaggcctcagatgatcagactactctgagctacaggaggaaattcgaatcaatggcaaagaagttaaaagctttgaaaaaaawtaagatgaatggataacaagaataatcaatgcagacaagtccttaaaggacctgatggagctgaaaaccaaggcacgagagctacgtgacgaatgcagaagcctcaggagccgatgcgatcaactggaagaaagggtatcagtgatggaagacgaaatgaatgaaatgaagcgagaagagaagtttagagaaaaaagaataaaaagaaacgaacaaagcctccaagaaatatgggactatgtgaaaaggccaaatctacgtctgattggtatacctgaaagtgacggggagaatggaacc

SEQ ID NO: 177748 - DNA, 601 bp, Human
ctacattgtactaagagacttttagttccaacagatactagagactaatgggttatacttggcagaacccagatctcataactaataggccagtatgccataatcagtaacctcaattacaaagacatgctaagtatgttccagagggtgatattccaatgtgggttcttccagtaatttcattcaattcaataaatatattttgagtacctatcctgagtcaagtcctaggtaaaacatgagactcagggattaacaaaatagaggttataatccaataggaaagagattcataattaayacagggcagtatgccctgccctgccctgccctgctctgtcacttctgggcttcataatacgaaagcaaatgacagtgcatgccttcataaagttgcatgtgatacttactattagatcactagtgggcaatacaataaaagaacactagttataagaaattgtacttgaaacatatatgttaaatacaaatgatgcggcctgctaaaggcaatttttgcaaccatataaaattatcaggattaggcaggcaggagtataaaaggcctagtaaacccctgactccgggtttccccacaaac

SEQ ID NO: 177749 - DNA, 601 bp, Human
tcactgaactgagaaacagcctcctcttcaagtccactgggtgaaagagaacaagttcctaataatgttgtcatgtctaacacaagagttacagatcctagcatttcagggtacatctgaaacttatttttcccatagaaagactgtcatacaaattattataggtattttaatatacttatgctaattattaacataattttataatttctttagtattaacataatcctataattcaggtattttattatttaaataggctttagtgggctgtctgtgactctaaccactaagtatacygtttctgagaaaataagactcaagttccaaaccattttacaagttgtaaaatgtaatcaattgtgtagtaagttagaactaccaattcacaaagactcaaaattataagctgaatgtgataaacttaaaacacaagattcttaattttataaaaagttccacttcaggggtcatttatttttaacaactaggtactcaagcattcagcataggatttaatttacatatatcttttttattactatttcactagaaaacgtaagtcacaaagaatcaaacacacttctatctagtgtagga

SEQ ID NO: 177750 - DNA, 601 bp, Human
acacatgaaaaaatgctcatcaccactggtcactaaagaaatgcaaatcaaaaccacaatgagatatcatctcacgccagttagaatgacaatcattaaaaagtcaggaaacaacagatgctggagagaatgtggagaaataggaacgcttttacactgttggtgggagtgtaaattagttcaaccattgtggaagacagtgtggcgattcctcaaggatctagaactagaattaccatttgactcagcaatcccattactgggtatatacccaaaggattacaaatcatgctactataargacaaatgcacacgtatgtttattgcgacaccattcacaatagcaaagacttggaaccaacccaaatgtccatcaatgacagactggattaagcaaatgtggcacatatacaccatggaataattaaggcagaaatctatgaaattgaaaacaggaaatcaagagaaaaaaacaatgaaactaaatgaagattccttgaaaataacaaaattgataaatttgtagttgtgtattatgatgtaccacacagggcttttattttggtttaaaaaaaaatcagtgccactattcaaaatagca

SEQ ID NO: 177751 - DNA, 601 bp, Human
aaatgcatattaccaagtcaaagaagcgaatttgaaatggctacatactctatgattccaactacatggcatgatagaaaaggcaaaactataaagggtgaaaagattagtggtttccaggggttagaaaggagagaggataaattggcagagtacagatttttgggcactgaaactattctgtatcatactaaaatggcagacatgtgaaattacacatttctcgtatcaaaacccatcaaatgtacaacaccaagagtgaccctggtataaaatattaactttgagtgatttatcaacrtaagttcatcagttgtaacaaatgtactattctggtacagaatgttaataggctatacatatgtggggtcagagaatatatgggaactctctgtactttctgctcaattttgctatgaacctaaaactgatctaaaaaataaaagtatcttaaaaaagaagttggaagatgtgaatgtacttaatgccactgaactatatacactttcaaatgattaaaattgtaaattttaactcgtgtgtatcttaccacaattaaaattttaaatgtcataaaagagttctagcaacattaggaact

SEQ ID NO: 177752 - DNA, 601 bp, Human
caaataagcatatgaaaagatgctcaacatcatgcatcatgtgtcagtagggaattgcaaattaaaacgagatattgctacatgcctattagaatggccaaaatctaaaacactggcaataccaaatgatggagagaatgcagagcaagaagaactctcattcgctgctattgagaatgcataattggaagacagtttggcagtttcttataaaatgaaacaaactcttaccatacaatccagcaaaaacattctttgatatttacccaaagaggtgaaaacttacacccatacaaaaatstcaacatcgatgttttagcagttttattcataactgctgaaacttggaaccaaccagtatgtcctcgagtaggtaagtaaaataaagtgtggtacacccaaataatggaatattcagcgctcaaaagaaatgaaatatcaagccatgaaaatacatgggaggaaccttaaatgcatattaccaagtcaaagaagcgaatttgaaatggctacatactctatgattccaactacatggcatgatagaaaaggcaaaactataaagggtgaaaagattagtggtttccaggggttagaaagg

SEQ ID NO: 177753 - DNA, 601 bp, Human
catatcaagtattaatacttaagaataaaaaactttgtttttggggacaggtcctagaatatagacaaattctgcttctcctctcctactgtttggtagactcttctgagagtcgactctgacctaatcacaacttaactttttcattattcagcattctcaaaacaagcaagatataaattaagatttgtcacgcagacaacgtatttcttgcttcaaaaggcataaaggaacagacagaagcagacttattctataaggttaacattaccctaatgcaaaactagataaagacaaggcaaaaaaaaaaaaaaatccaaaaaactaaaggccaatatctctcattaacaaaaatgcaaaaatcctcaacaaaatattaacaaatcgattccaacaatgtgtaaaaataattacataccaggaccaagtgagattcatcctagatatgcaaggctggttctacatacaaaaatcaattaacataatttatcgtatcaacaggctaaagaagaaaagcctgcatgatcttatcaaaagatactggaaaagcatttgacaaaaaccaatgcccattcattactaaaactctccgcaaactagg

SEQ ID NO: 177754 - DNA, 601 bp, Human
gaaatcataaatttcctctttgttgtgagaagcaaactttaaaactactcactactcatgaatctctaaaggagattcataggaaaatgacaaaaccaatttaggtactcacaggactaaagaactagtcatcatgctgaacatctccagttatttgctctgaggtactctggctcttggtttaaaaaaaactgccctaagaacagtgctatctttaccaaaaataaatatataaataattatgtcacctgaggccaggcgcggtggctcacacctgtaatcccagcactttgggaggccraggagggtggatcacgaggtcaggagatcgagaccatcctggctaacacggtgaaaccccatctctactaaaaatacaaaaattagccgggcgtggtggcgggcgcctgtagtcccagctactcgggaggctgaggcaggagaatggcgtgaacccgggaggcggagcttgcagtgagccgagatcatgccactgcactccagcctgggcaacagtgcgagactccgtctcaaaaaaaaaaaaaaaaaattatgtcacctgaagtcacaatagcaaagcattaaattttgataggctact

SEQ ID NO: 177755 - DNA, 601 bp, Human
ggttccaagtctttgctattgtgaatagtgccgcgataaacatacgtgtgcatgtgtctttatagcagcatgatttatagtcctttgggtatatacccagtaatgggatgactgggtcaaatggtatttctagttctagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcaytgtggttttgatttgcatttctctaatgacaagtgatgatgagctttttttcatatatttcttgatggcataaatgtcttcttttgagaagtgtctgttcatatcctttccccacttggtgatggggttgtttgtttttttcttgtaaatttgttggagttcattgtagattctggatattagccctttgtcagatgagtaggttgcaaaaattttctcccactctgtagtttgcctgttcactctgatggtggtttcttttgctgtgcagaagctctttagtttcattagatcccattt

SEQ ID NO: 177756 - DNA, 601 bp, Human
tggctgaggtacaagaattgcttgaacctgggaggtggagtttgtagtgagccaagatcgcaccactgcactccagcctgggtgacagagcaagactctgtttcaaaaaaataaaaaaaggaagtacatttttgtgaggaaaaggtcaggaagatatccagccctgagccatgtggatccctgcagtttactttcattgctatattctcaagcactttcagtactaataatagcaccaaagtgaaaatctccattatctagaaacattttggatagccaagttttctaagtaattcagatwttattatctaatacatcaattgttattttaactattttcgatggaaacttgtgaaatgtattctaagcttccctcttcttaaatggaatataaaattaaacataatttaattttttcttagggactcatgggcatgaattatgaaaatcaaatattatcctaggccagaaaacagccttgaaatgtataaggatatttgctttacattaaatggcttctttccagtttttatgttgcatcttcccttacatcactttgtcctttcctgtgaactacctccttttggttgggttcagtgat

SEQ ID NO: 177757 - DNA, 601 bp, Human
gtggctgaggtacaagaattgcttgaacctgggaggtggagtttgtagtgagccaagatcgcaccactgcactccagcctgggtgacagagcaagactctgtttcaaaaaaataaaaaaaggaagtacatttttgtgaggaaaaggtcaggaagatatccagccctgagccatgtggatccctgcagtttactttcattgctatattctcaagcactttcagtactaataatagcaccaaagtgaaaatctccattatctagaaacattttggatagccaagttttctaagtaattcagaktttattatctaatacatcaattgttattttaactattttcgatggaaacttgtgaaatgtattctaagcttccctcttcttaaatggaatataaaattaaacataatttaattttttcttagggactcatgggcatgaattatgaaaatcaaatattatcctaggccagaaaacagccttgaaatgtataaggatatttgctttacattaaatggcttctttccagtttttatgttgcatcttcccttacatcactttgtcctttcctgtgaactacctccttttggttgggttcagtga

SEQ ID NO: 177758 - DNA, 601 bp, Human
agaaagcaataaaatgagaaagaggaaattgatataaagtgaattataggtttgtggtaattacctaatacaaaacagaattatgttctactaggaaaaatctcacaaaaaacagatgtactggctgggtatggtggctcacacctgtaatcccagcactttgggaggccgaggcgggtggatcacttgaggccagaagttcaaggccagcctggccaacatggcaaaaccccatttctactaaaaataatacaaaaattagccaggcatgatggcactcgcctgtaatcccagcggcttkggtggctgaggtacaagaattgcttgaacctgggaggtggagtttgtagtgagccaagatcgcaccactgcactccagcctgggtgacagagcaagactctgtttcaaaaaaataaaaaaaggaagtacatttttgtgaggaaaaggtcaggaagatatccagccctgagccatgtggatccctgcagtttactttcattgctatattctcaagcactttcagtactaataatagcaccaaagtgaaaatctccattatctagaaacattttggatagccaagttttctaagtaattcag

SEQ ID NO: 177759 - DNA, 601 bp, Human
cctttcacttaataaattctactccattcactcttagagtatctgtgtgcctaattcttcctcatcgtgagacaagaacctggacctagctcagctaaggagtaaaaaaccttgcatcattaagaaagcaataaaatgagaaagaggaaattgatataaagtgaattataggtttgtggtaattacctaatacaaaacagaattatgttctactaggaaaaatctcacaaaaaacagatgtactggctgggtatggtggctcacacctgtaatcccagcactttgggaggccgaggcgggyggatcacttgaggccagaagttcaaggccagcctggccaacatggcaaaaccccatttctactaaaaataatacaaaaattagccaggcatgatggcactcgcctgtaatcccagcggctttggtggctgaggtacaagaattgcttgaacctgggaggtggagtttgtagtgagccaagatcgcaccactgcactccagcctgggtgacagagcaagactctgtttcaaaaaaataaaaaaaggaagtacatttttgtgaggaaaaggtcaggaagatatccagccctgagccatgtgg

SEQ ID NO: 177760 - DNA, 601 bp, Human
cataataaataagaaagaaagtaaagaagcagatctccgattttaaaaaatggaatccaaaaaaaaaaaaaagaagacatagaagaagtggtgtcagaaaacaaattgacattagagaatctggcaaaagcgttccaattattcaagactacttttgatttattttacaacgtgaacccttctatgatacagtaccaaaactaaagcaaataaaaggaggattggtaccatataaaaacatttttagagaaatgaagaagcaaaaaagtcagaaatcaagatgtgtttttgtaaagttacrccagtgtgcccacctctactacttctacctcctccacctctctgcctctgctactcctgagacagcaagacaaactcctccttttccttctcctctttggtctgctcaatgtgaagataacgaggatgaagacttttatgatgatccacttccaattaatgaacagtaagtatattttttcttatggttttcttaataacatattcttttctctagcttaccttattgtaggaatacagtatactactacacatacaacataaaatatacatgttaagcaacagtttatgttctcggtaa

SEQ ID NO: 177761 - DNA, 601 bp, Human
ctgacaagattaaacttcaaaatagctttactgaaagattattataagcaactgccaatcctctctgaaattctttaagtattttccttaataccaaattagtattaataatcacatctttggttcccatttcttagactgttacccacattccaaaaaatccttaatttttcttaatacactgcacatgatatgcttgataacaacactataataaaatgaaacaggctttaatctttaaattcttattagctaaattttcctaggagagtgtgtcagctctaaccagaagattacaaayaatgtcccacagaccaaatctgacctgctccctgtttttataaatagagtttatttcaacacagacacattcatttgtttatgtatattctatggtggctttcatgcaacaatggcagaattgagtacttgtgacaaaaactgtaaggcccgaaagccaaaaatacttactatatcgtccttgaaagaaaaagcttactgactcctaagataaaacatcatatgcttgttccaacatacctgatacaggtgggtatcggttttgcatctcctgctccatgcattggtggaggtggaggtg

SEQ ID NO: 177762 - DNA, 601 bp, Human
aaacccagacctcctggctccaaagcaatgtcttcacctgtccccattgcctctcctggcctatccctcacaaggaagggccttttgagtgtgcttgtcctgtctgcaccaccaccaagctcaaggcagggaatgattggtgccagccagcaatgtcactacagttacaaaaaagaggctccccataactggaaaggtttctatctatagttttggttcagtgttgagaacaagggcctgcacttctaaaggctggagagctcacaggaaggctctcacagctgctgccagctccataagygctcctgcactaatgaggccacagcctctctgggggggccagccagcgggacctgattactgtgaacctgtacctgcaagcgggggcaaaggcagtcctgaattctagcactattccaggggcacctccaaaccacgtcgtgtaactgctggtcctgcttcatctagtttcacggccaacctcctgccatgctgtgagatgtggctggcgacctgtttggctgtcactgctcctgtcactcttgctgtcttaagtgaaatatttctcaggcagatgtgcctctccggctgctgaaatttg

SEQ ID NO: 177763 - DNA, 601 bp, Human
gttgataccagctggagagtaatttcagggacagcatcacaagctgagcagagcccgcctgagcattttcaggcaaaaggagatgttcttgtctactgacattattgcagttgagaatttaacagggagcataagagcttaattactggacttgttaaagctagttgatttaatatatgctgacaatatacactggcaacgttcacctgaatgttttttaacaagcagctgaagaattctgtaatagcactatatttagctacataattttcccagcagtttctgccaccaagtgggtaaygaagacaatgtcgccaagggcaccgcaggaacagacattgactgtgcacaccgactccctcagctcccgtgtcagagggaagggcccccaccagccttgccctgatgccctaaaacacttaacgtttattcattcttttaaccctcacaatactaggatatgggtaccgttattacccccatcttatagattgggaaatgaaggcaaagaaaaatcagtaacttgcccaaagccatacacagaagtaagtgatcaggtcagcagtcaaacccagacctcctggctccaaagcaatgtctt

SEQ ID NO: 177764 - DNA, 601 bp, Human
ggtcacagatctttgtggatgggagcctggggtggctcagcttggctggagcccagggcagagcttctcaggaagagccagggagtccagctggctgtcaacacatgctcgtgtcttggccatgctaaagagtatgcttctattttgaaggtgatgcagaaaactgaagcttcccagcagggcagggagccatccaatctgcttttctagatgggctatctggcagtggggtggagactgaggagttgatgccttaatccttgctcatggttcagcagatactagttcagtgaaaagaaakaattaatggtaatttttagaaactttagtgaaactaatgtgggccactaaccttctaggagccatatgtgagcacggtggggtgataattaagctgatgcgcaccctgtcccgaggagcccatggatgtgggcacagtgctcctgcaaggctgacacaggcaggccatcacacggaaaagtccgttggggtcggcgtgcgtggaggcggctgggcagcagacagagccagtcactgctgctgagcatgaggtggtattgacattcgctcacttcgtgcttgcgctcagggcactgctctg

SEQ ID NO: 177765 - DNA, 601 bp, Human
gaaaaaaagtaccacacacaattttagcctctttgtgggtgttctctgtaattcttacaaccatcctggaagtaggaaatgagcaatgccatgttacagcctaggaaatgctggagagcacagaggaagactgcccaagcccgcccggagcagtcagggaaggctcttcctttcccagagcagctccctaggaaggagatggaagtctggatggaggaaagaatcctccaagccacaccaggcagggtcacagatctttgtggatgggagcctggggtggctcagcttggctggagcccasggcagagcttctcaggaagagccagggagtccagctggctgtcaacacatgctcgtgtcttggccatgctaaagagtatgcttctattttgaaggtgatgcagaaaactgaagcttcccagcagggcagggagccatccaatctgcttttctagatgggctatctggcagtggggtggagactgaggagttgatgccttaatccttgctcatggttcagcagatactagttcagtgaaaagaaagaattaatggtaatttttagaaactttagtgaaactaatgtgggccactaaccttc

SEQ ID NO: 177766 - DNA, 601 bp, Human
tcagaaacacaactctccccaaaataagcataagaaccttaaacgaagattacgcaatatacaccatgtctacattttgtgtgtaacatcggggtaggaaaaagagtttttgccaaaagagaaaaaaagtaccacacacaattttagcctctttgtgggtgttctctgtaattcttacaaccatcctggaagtaggaaatgagcaatgccatgttacagcctaggaaatgctggagagcacagaggaagactgcccaagcccgcccggagcagtcagggaaggctcttcctttcccagagmagctccctaggaaggagatggaagtctggatggaggaaagaatcctccaagccacaccaggcagggtcacagatctttgtggatgggagcctggggtggctcagcttggctggagcccagggcagagcttctcaggaagagccagggagtccagctggctgtcaacacatgctcgtgtcttggccatgctaaagagtatgcttctattttgaaggtgatgcagaaaactgaagcttcccagcagggcagggagccatccaatctgcttttctagatgggctatctggcagtggggtggag

SEQ ID NO: 177767 - DNA, 601 bp, Human
tcctccactgaaagtggaatttgatttttcccagtatcgggaatggctgagcacgcaggccgaagacaatgttgtagatgtcatacaccaaagggcatgaaagagctgaaaacaaaaatgacagattcgacggcctgcagcagccagccaaaataaactgcccggctggctccctgcagtgctcctggtgggtggatgggtaaaagggattggtgctggccagggctggtccctgccctgtttgccctaaaagcaggaagccgcctgtgggaaccaggccaattctgcagctgctggaacmcagcaggagaggctcctgtgagaccttcagtcatatctacctgaccacccaccgccacccactccttcaagtatgtaagtccctcccatgtgctgtgcatggcaccaggccctggcaacaccagccaagcaacacctgccaagctaggggacagtggccatggacagggatggcagcagtgctgaaaactgtccaagggaaatggcagtcacttgtggaactgtcttgtgctgctgctggcctgtgagctccaagaggacaagggactgtccctgtcacactcacctctgtgtcccagcc

SEQ ID NO: 177768 - DNA, 601 bp, Human
tgctatttaccttgcagggcccaagagggttagagattcagaatcgccttgagtctgatctacaatccagactcgattctgacccagcactagtcctgtcctttcctcggggcctcaattctgtctcaacttggggttttcagttcttgctcccaacactgactggccgtatcctctgttcctgaaacctgtatcctcaagtacgaaggtgaagaaaatggagctcactaccctgaaagcaccccttgccgtttgatcatttaaaagcatgaatcccagatttcaacaatcataaagacamactgagttacgaatctttaactgaaatgttcaaaatgacaaaataaaaaatagatgacacagaaacccagaaattgcaattttcagatcctaactccaaaggcagaacacataagatagacaacatagaaagaaaggatgtgtttacgcaaagctgtgttgaactaactcttcctcaaggccgtcggccaggctccccatgctctgctcccttggtgcgtgttacacagatgtcgagaaggccccgcgacaccctacatggcgttcacatgcacagcatatgccgccctgtgtgccatct

SEQ ID NO: 177769 - DNA, 601 bp, Human
accactgggctcccaacttgtctcagccctggaatgtaggccctgggagttccacacttcggtgctgccttgaaccacaagctcagactaacacctaacctcactggggctccccatctgcaaatgaggtgatgctatttaccttgcagggcccaagagggttagagattcagaatcgccttgagtctgatctacaatccagactcgattctgacccagcactagtcctgtcctttcctcggggcctcaattctgtctcaacttggggttttcagttcttgctcccaacactgactggccrtatcctctgttcctgaaacctgtatcctcaagtacgaaggtgaagaaaatggagctcactaccctgaaagcaccccttgccgtttgatcatttaaaagcatgaatcccagatttcaacaatcataaagacacactgagttacgaatctttaactgaaatgttcaaaatgacaaaataaaaaatagatgacacagaaacccagaaattgcaattttcagatcctaactccaaaggcagaacacataagatagacaacatagaaagaaaggatgtgtttacgcaaagctgtgttgaactaac

SEQ ID NO: 177770 - DNA, 601 bp, Human
gggttgtgaaatctgtgatgtgtgtttgaaaacaccaaagagtaacaggggtccttgaaaaaccatctagtccgtgccttgctttcaggtgccaaactgcaatttccacatcctcatttctatgggattccactcgtcctggtccccaaacttcccaccagctcatccaccactgggctcccaacttgtctcagccctggaatgtaggccctgggagttccacacttcggtgctgccttgaaccacaagctcagactaacacctaacctcactggggctccccatctgcaaatgaggtgaygctatttaccttgcagggcccaagagggttagagattcagaatcgccttgagtctgatctacaatccagactcgattctgacccagcactagtcctgtcctttcctcggggcctcaattctgtctcaacttggggttttcagttcttgctcccaacactgactggccgtatcctctgttcctgaaacctgtatcctcaagtacgaaggtgaagaaaatggagctcactaccctgaaagcaccccttgccgtttgatcatttaaaagcatgaatcccagatttcaacaatcataaagacac

SEQ ID NO: 177771 - DNA, 601 bp, Human
gtcatcagccagtaacttcatggccggcagaagagcaactcccggcgcttctgccgcattcctgagagagtcacataagcacagccagctgcagggcctcaccgggccttcactgcagctacaaagctttcagggaaatccagggcctgagttagtttatccctaagccaacccacgtcccaggcagctagagggggctccaggactgagtcccttctcctcaggactgtgccctgcagagtcactacctctcacccaccttccctggggagggtgtgcgtgtgcctggcagatgttgtawcctgtacacacctgccagatgtccccatggtgacagcttcaggcaactttcttccaacctatcctaacccctatgctgaatcttcctttccaaacggggatgactgttgatattagggttgtgaaatctgtgatgtgtgtttgaaaacaccaaagagtaacaggggtccttgaaaaaccatctagtccgtgccttgctttcaggtgccaaactgcaatttccacatcctcatttctatgggattccactcgtcctggtccccaaacttcccaccagctcatccaccactgggctcccaac

SEQ ID NO: 177772 - DNA, 601 bp, Human
ctgtctgggggtcagggtggggggtgaggtgagccttcaggattccagggtgtctggttgaagacgatgttggtgcttcctggcatacctgaccagctctgggtcagacattcgactctggttccatgggctttgcctgcaggggcaccaccagggcgtcttccttccgtggttcagctcggaccagctggctcgcccctggcccttcctctccgtggtgcagagggagcagtttccagtctgctgatgccaccagctggctggctccccactgaagcattcatcactccatttctgagcrtctggcaacactctcttgccactgagaggtatttaaggaacatccactgtgtgtgaagggccacgaggccctagggatatagtggtgaacaaactgccatgcgactgtccctcatggaacttatggccagaaaaataatgcaatgagacagtgacacattgtgagaaggaacactctgggtggtcagggctgcctggaggaagcgatgtttgaggcggtagctgaagacagctctgaggcaaggccgctttctcacagctgaggaaaatgccatgaggcccacggagagtgagctggggg

SEQ ID NO: 177773 - DNA, 601 bp, Human
cacggcgatcgcctgacaaggcctaacttcttgctaagccatttcttcaccctgtctgggggtcagggtggggggtgaggtgagccttcaggattccagggtgtctggttgaagacgatgttggtgcttcctggcatacctgaccagctctgggtcagacattcgactctggttccatgggctttgcctgcaggggcaccaccagggcgtcttccttccgtggttcagctcggaccagctggctcgcccctggcccttcctctccgtggtgcagagggagcagtttccagtctgctgatgmcaccagctggctggctccccactgaagcattcatcactccatttctgagcgtctggcaacactctcttgccactgagaggtatttaaggaacatccactgtgtgtgaagggccacgaggccctagggatatagtggtgaacaaactgccatgcgactgtccctcatggaacttatggccagaaaaataatgcaatgagacagtgacacattgtgagaaggaacactctgggtggtcagggctgcctggaggaagcgatgtttgaggcggtagctgaagacagctctgaggcaaggccgct

SEQ ID NO: 177774 - DNA, 601 bp, Human
ccacggcgatcgcctgacaaggcctaacttcttgctaagccatttcttcaccctgtctgggggtcagggtggggggtgaggtgagccttcaggattccagggtgtctggttgaagacgatgttggtgcttcctggcatacctgaccagctctgggtcagacattcgactctggttccatgggctttgcctgcaggggcaccaccagggcgtcttccttccgtggttcagctcggaccagctggctcgcccctggcccttcctctccgtggtgcagagggagcagtttccagtctgctgatrccaccagctggctggctccccactgaagcattcatcactccatttctgagcgtctggcaacactctcttgccactgagaggtatttaaggaacatccactgtgtgtgaagggccacgaggccctagggatatagtggtgaacaaactgccatgcgactgtccctcatggaacttatggccagaaaaataatgcaatgagacagtgacacattgtgagaaggaacactctgggtggtcagggctgcctggaggaagcgatgtttgaggcggtagctgaagacagctctgaggcaaggccgc

SEQ ID NO: 177775 - DNA, 601 bp, Human
catctgaggactcctgccatctggtccagctgggggccatgatggcccttgtgaacaccgtccccatgcccttcgggtcacagctcgtctcaaaattgcctcgagcacattagcctcacttccctagctagactgtaagcctcccgccaaaaggtgccacacactgagtgattttcactagcgacggcgtcataatagagcatcccatacttggccaggcagggtactgacagttttacatgccaccccacttaatcttgtgagaatgctagccaggggatactattaatgtctatttttwaaaattaaattaaattttattattttatttgcgagaagggtctcactgtattgcccaggctggagtgcagtggcacaatcacagaggcgcaaccttcccgtccgaagtgatcctcctgcctcagcctccgagtagctgggaccacaggtatgtaccactacacctggctaattttttatattttttgtagagacaggttcttactatgttgccagggctgatttcaaactcctaggctcaagcaatcctcccaacttggactcccaaagtgctgggattacaggcatgagccaccgcacc

SEQ ID NO: 177776 - DNA, 601 bp, Human
cccctcctacctgcccccatctcagctctctgtgaagtcttggctccttttccccacgcaggcttccctgatgcagcccgtccttgctggagcaccagcgtggagcaccaacccagtctacaccacctgcacccacagacaggggagactcatctgaggactcctgccatctggtccagctgggggccatgatggcccttgtgaacaccgtccccatgcccttcgggtcacagctcgtctcaaaattgcctcgagcacattagcctcacttccctagctagactgtaagcctcccgccaamaggtgccacacactgagtgattttcactagcgacggcgtcataatagagcatcccatacttggccaggcagggtactgacagttttacatgccaccccacttaatcttgtgagaatgctagccaggggatactattaatgtctatttttaaaaattaaattaaattttattattttatttgcgagaagggtctcactgtattgcccaggctggagtgcagtggcacaatcacagaggcgcaaccttcccgtccgaagtgatcctcctgcctcagcctccgagtagctgggaccacaggta

SEQ ID NO: 177777 - DNA, 601 bp, Human
gcgagtccccctcctacctgcccccatctcagctctctgtgaagtcttggctccttttccccacgcaggcttccctgatgcagcccgtccttgctggagcaccagcgtggagcaccaacccagtctacaccacctgcacccacagacaggggagactcatctgaggactcctgccatctggtccagctgggggccatgatggcccttgtgaacaccgtccccatgcccttcgggtcacagctcgtctcaaaattgcctcgagcacattagcctcacttccctagctagactgtaagcctcycgccaaaaggtgccacacactgagtgattttcactagcgacggcgtcataatagagcatcccatacttggccaggcagggtactgacagttttacatgccaccccacttaatcttgtgagaatgctagccaggggatactattaatgtctatttttaaaaattaaattaaattttattattttatttgcgagaagggtctcactgtattgcccaggctggagtgcagtggcacaatcacagaggcgcaaccttcccgtccgaagtgatcctcctgcctcagcctccgagtagctgggacc

SEQ ID NO: 177778 - DNA, 601 bp, Human
cctggggaatgcacaggtaagcacggggcccagcagtgcagcgggaggaaggatgtgcgcgactacgccgacacactgacccagaacagaaacagaatgatgtggggcatgatgccatttacatcaattaagaatacgtgcacatgaagtaggggtgcgaagtttatgagagcagatgctaacaaaagctgtaacattagaaatggggagggggcctaggtatcaactgcaggtggagaaatagagacaggaacggttattgatgagcgagtccccctcctacctgcccccatctcagctmtctgtgaagtcttggctccttttccccacgcaggcttccctgatgcagcccgtccttgctggagcaccagcgtggagcaccaacccagtctacaccacctgcacccacagacaggggagactcatctgaggactcctgccatctggtccagctgggggccatgatggcccttgtgaacaccgtccccatgcccttcgggtcacagctcgtctcaaaattgcctcgagcacattagcctcacttccctagctagactgtaagcctcccgccaaaaggtgccacacactgagtgattttcac

SEQ ID NO: 177779 - DNA, 601 bp, Human
agctcctcctccatcctgcatgcatctgttgtaaacagtccagaggtgcctttcacaaggacgctggagaaggtctgctgtgcagacacaggaccatgccaagctctgtggtgctcccaacccctaataccttcagactctgggccctaagagggtgtggacctgtgtcttcctaatccaccactctttctccattgctttccacagggtctaccgcacagcaggcaccccatacaaatgtgaggtaaaaccataacatgaccagaagaaaatgaacgcgaatacctttgtgacttacggyatggctccttaaacaaaatttttctttttctttttttttgagacggagtctagctctgttgcccaagctgaagcgcagtggtgccatctcggctcacttgcaacctctgcctcccgggtttaagcgattttcctgcctcggcctcccgagtagctgggatgacagcaggcagagcacacagagacacctctgtatgtgggtgcccagagggatgtgcctgagaacagcaaggcagctctacgcctgtggactggcaaccaccagagagtgggaaaggccaagtgtgggcagaggtgggtg

SEQ ID NO: 177780 - DNA, 601 bp, Human
gtcagctcctcctccatcctgcatgcatctgttgtaaacagtccagaggtgcctttcacaaggacgctggagaaggtctgctgtgcagacacaggaccatgccaagctctgtggtgctcccaacccctaataccttcagactctgggccctaagagggtgtggacctgtgtcttcctaatccaccactctttctccattgctttccacagggtctaccgcacagcaggcaccccatacaaatgtgaggtaaaaccataacatgaccagaagaaaatgaacgcgaatacctttgtgacttayggcatggctccttaaacaaaatttttctttttctttttttttgagacggagtctagctctgttgcccaagctgaagcgcagtggtgccatctcggctcacttgcaacctctgcctcccgggtttaagcgattttcctgcctcggcctcccgagtagctgggatgacagcaggcagagcacacagagacacctctgtatgtgggtgcccagagggatgtgcctgagaacagcaaggcagctctacgcctgtggactggcaaccaccagagagtgggaaaggccaagtgtgggcagaggtgg

SEQ ID NO: 177781 - DNA, 601 bp, Human
attttgtatttttagtagagacgggttttctgcatgttggtcaggctggtctcaaactcccgaactcaggtgatctgcccacctcagcctcccaaagtgctgggattacaggcgtgagccactgtgcccggctgagaacctcctttctagggtcctccggaggccgctctcctgcctcccagggatggaccttgggggccacatccctcacaatcaagctctgcctccagggaatccactcccttccccatgcccttccccgagcccaggactcgccctgccgcctgccctcctccaggcygcactcactccctctcagtgagccaggcttctaatcgttcctctgagaacccaatgtcagccaagcctcagttttaaagtcagctaggatgaggtggcagctggaatctcaaccatccctgtgcagaaacatccgtgcaatcaggagcagagaaaggggctctacctgaaacccagcagcttattgtcacaggcgtgctggggggactatccaaagaggccacgtcagctcctcctccatcctgcatgcatctgttgtaaacagtccagaggtgcctttcacaaggacgctggagaaggt

SEQ ID NO: 177782 - DNA, 601 bp, Human
gaattatgaataaagaagctataacgttcatctattggtcttttgtggggacataagctttcatgactcttcggtgaatacctaggaatggaaatgttaactgtacgtttaacaaaactgccgaactgctacccaaagtgactggacagctgtgcactgccatcagcaacgtatgagacttccctgtcctgcatgctcccagcacttagtattgccagggtgttttgttctgttttgttatttttagccattctacttagtgtagcaatattgcattgtgattttaatttgcatctttctraagtctaataatactgaaaatcttttcttatgactatttgccatctgtatgccttcttgagtaaagtttgttccttttttttctttttgagacagggtcttgctttgttgcccaggctagagtgcagtgccacaatcatggctcactgtggccttaacctcccaggctcaagtgatcctcccacctcagcctccagagtagctggaactacaggtacgcaccaccacacctggctaatttttgtattttttgcagagacagggttttgccgtgttgcctaggctggtcttgaattcctgg

SEQ ID NO: 177783 - DNA, 601 bp, Human
cagtatgccaaacagttgggaccgaggcaccccagcaacatcggccctgctgtccctttaatgaaacggttgtgtggtggccggtgaaggccatcactggaagtctctatcgccataaaccaccagggacagagcaatgtggcctttccacttccctgggcaaagcactgcagtcgtcccaggagcagagctactgctggctgcttctctaggtcgagatggaatctacacacaggcaaaactgcccactacagggtacacttagatctgaatgtggacaaacatataccactgtctaccrcctccacagcaaggaacaggacacttccatctctcatgaagtgcctttgtgcccccttgcagcccatcccctccccatacagcccccagcaaccacagacatgatttttgccccttttccaggatggcaaggatatatggaatacacagtatgcagcctggcttttgagactggcttctgtcacccaccataatgtttctgagactgatccatgttgctatctacgtcagaaggtcactctttcttactgctaagtagtattcgactgtgtaggtataccactatcagaagttcactctt

SEQ ID NO: 177784 - DNA, 601 bp, Human
tcacagctcactggaagtgacattatgtggttgcttcccttaaaatgaggccttactgtcattttgaaatttacagcaggatgaaaaaaatacccaacaagcaactcagtatcgttgagctggtggtaggaggagctgaggtaacacggccctaacttagccttgacagtcgacatgaagccacaacccagagctggttttcatctgcctattaccaacagtattcaaattggtaatcaccatcaaatcatgtattttggctctcttgaaacctgcttatctctgtgattttcagaaccamtggttaaaggtttagggaaaagaaaaggatatttcttaacaagtcacatgttggtaccacccatcggcacacacaggagctgcaaatacacatttacatgacaactcttgaaatgtggaaatccgtgatgaatacaggaagagtgtttccgtaagtacacatttcaggtttccaaataagctcccagttggtcctagaggctgcagaggagcctgtgctggtcctgtgaccactgctggggacaagaggcaagttggctgagcacagagccaacgggagaagggcagtatgccaaacagt

SEQ ID NO: 177785 - DNA, 601 bp, Human
gctgagctacatgggctgagatgactccactcctgtgagaaccagaatcctggtgaaaagcaaagacccctggaaggtggttagcctgggcagccttctccagaggcagatgagacttccggctctactcattccctccaaagacctcccccagcaaggctggcagctcggcagctcgtcaaaacatgagctgaacctgagcatccactccaaactagagcagctcctgtgaggaagtcggaagtgagcattttcacagctcactggaagtgacattatgtggttgcttcccttaaaatgrggccttactgtcattttgaaatttacagcaggatgaaaaaaatacccaacaagcaactcagtatcgttgagctggtggtaggaggagctgaggtaacacggccctaacttagccttgacagtcgacatgaagccacaacccagagctggttttcatctgcctattaccaacagtattcaaattggtaatcaccatcaaatcatgtattttggctctcttgaaacctgcttatctctgtgattttcagaaccactggttaaaggtttagggaaaagaaaaggatatttcttaacaagtcac

SEQ ID NO: 177786 - DNA, 601 bp, Human
ccagaggaaatatgacagaaaaacgatctcttttcagcctttttctcccaatgccttcaaaaatcttagtcaaccccttgtcagttttaccttttctaaaatctctttgcctggccctgcacagagatgggcaaggggagggaagggggctgcagcacctggaggaagggctgtccctgaggctgagctacatgggctgagatgactccactcctgtgagaaccagaatcctggtgaaaagcaaagacccctggaaggtggttagcctgggcagccttctccagaggcagatgagacttcyggctctactcattccctccaaagacctcccccagcaaggctggcagctcggcagctcgtcaaaacatgagctgaacctgagcatccactccaaactagagcagctcctgtgaggaagtcggaagtgagcattttcacagctcactggaagtgacattatgtggttgcttcccttaaaatgaggccttactgtcattttgaaatttacagcaggatgaaaaaaatacccaacaagcaactcagtatcgttgagctggtggtaggaggagctgaggtaacacggccctaacttagccttgac

SEQ ID NO: 177787 - DNA, 601 bp, Human
tgtcgtcaggctggagtgcagtggcacgatctcggctcactgcaacctccgcatcccaggttcaagtgattcttctgcctcagcctcctcagtagctgggactacaggcacgcatgccatcacacccagctagtttttgtatttttagtggagacagggtttcaccatgttggccaggatggtctcaatctcctgaccttgtgatccacccacatcagcctcccaaagtgctgggattacaggcgtgaggcaccgcgcccagcccaaaggcagtttttcaaagggttccaagtaggactgycttgatggcaaagctttgtcagggctaagctgagttttgactgccttttttcgtatatgaaaagaaaaactagttcatcaaagttataagtaataaaagagtaactgaggaaatgttaatggctaatttggggtgaaaacgaaaatgttcgatatgtttcattcttttagctgctggcttgaaaggctacagtcgctgataacttgagcacccagaggaaatatgacagaaaaacgatctcttttcagcctttttctcccaatgccttcaaaaatcttagtcaaccccttgtcagtttta

SEQ ID NO: 177788 - DNA, 601 bp, Human; identical to SEQ ID NO: 35630

SEQ ID NO: 177789 - DNA, 601 bp, Human; identical to SEQ ID NO: 35631

SEQ ID NO: 177790 - DNA, 601 bp, Human; identical to SEQ ID NO: 35632

SEQ ID NO: 177791 - DNA, 601 bp, Human; identical to SEQ ID NO: 35633

SEQ ID NO: 177792 - DNA, 601 bp, Human; identical to SEQ ID NO: 35634

SEQ ID NO: 177793 - DNA, 601 bp, Human; identical to SEQ ID NO: 35635

SEQ ID NO: 177794 - DNA, 601 bp, Human; identical to SEQ ID NO: 35636

SEQ ID NO: 177795 - DNA, 601 bp, Human; identical to SEQ ID NO: 35637

SEQ ID NO: 177796 - DNA, 601 bp, Human; identical to SEQ ID NO: 35638

SEQ ID NO: 177797 - DNA, 601 bp, Human; identical to SEQ ID NO: 35639

SEQ ID NO: 177798 - DNA, 601 bp, Human; identical to SEQ ID NO: 35640

SEQ ID NO: 177799 - DNA, 601 bp, Human; identical to SEQ ID NO: 35641

SEQ ID NO: 177800 - DNA, 601 bp, Human; identical to SEQ ID NO: 35642

SEQ ID NO: 177801 - DNA, 601 bp, Human; identical to SEQ ID NO: 35643

SEQ ID NO: 177802 - DNA, 601 bp, Human; identical to SEQ ID NO: 35644

SEQ ID NO: 177803 - DNA, 601 bp, Human; identical to SEQ ID NO: 35645

SEQ ID NO: 177804 - DNA, 601 bp, Human; identical to SEQ ID NO: 35646

SEQ ID NO: 177805 - DNA, 601 bp, Human; identical to SEQ ID NO: 35647

SEQ ID NO: 177806 - DNA, 601 bp, Human; identical to SEQ ID NO: 35648

SEQ ID NO: 177807 - DNA, 601 bp, Human; identical to SEQ ID NO: 35649

SEQ ID NO: 177808 - DNA, 601 bp, Human; identical to SEQ ID NO: 35650

SEQ ID NO: 177809 - DNA, 601 bp, Human; identical to SEQ ID NO: 35651

SEQ ID NO: 177810 - DNA, 601 bp, Human; identical to SEQ ID NO: 35652

SEQ ID NO: 177811 - DNA, 601 bp, Human; identical to SEQ ID NO: 35653

SEQ ID NO: 177812 - DNA, 601 bp, Human; identical to SEQ ID NO: 35654

SEQ ID NO: 177813 - DNA, 601 bp, Human; identical to SEQ ID NO: 35655

SEQ ID NO: 177814 - DNA, 601 bp, Human; identical to SEQ ID NO: 35656

SEQ ID NO: 177815 - DNA, 601 bp, Human; identical to SEQ ID NO: 35657

SEQ ID NO: 177816 - DNA, 601 bp, Human; identical to SEQ ID NO: 35658

SEQ ID NO: 177817 - DNA, 601 bp, Human; identical to SEQ ID NO: 35659

SEQ ID NO: 177818 - DNA, 601 bp, Human; identical to SEQ ID NO: 35660

SEQ ID NO: 177819 - DNA, 601 bp, Human; identical to SEQ ID NO: 35661

SEQ ID NO: 177820 - DNA, 601 bp, Human; identical to SEQ ID NO: 35662

SEQ ID NO: 177821 - DNA, 601 bp, Human; identical to SEQ ID NO: 35663

SEQ ID NO: 177822 - DNA, 601 bp, Human; identical to SEQ ID NO: 35664

SEQ ID NO: 177823 - DNA, 601 bp, Human; identical to SEQ ID NO: 35665

SEQ ID NO: 177824 - DNA, 601 bp, Human; identical to SEQ ID NO: 35666

SEQ ID NO: 177825 - DNA, 601 bp, Human; identical to SEQ ID NO: 35667

SEQ ID NO: 177826 - DNA, 601 bp, Human; identical to SEQ ID NO: 35668

SEQ ID NO: 177827 - DNA, 601 bp, Human; identical to SEQ ID NO: 35669

SEQ ID NO: 177828 - DNA, 601 bp, Human; identical to SEQ ID NO: 35670

SEQ ID NO: 177829 - DNA, 601 bp, Human; identical to SEQ ID NO: 35671

SEQ ID NO: 177830 - DNA, 601 bp, Human; identical to SEQ ID NO: 35672

SEQ ID NO: 177831 - DNA, 601 bp, Human; identical to SEQ ID NO: 35673

SEQ ID NO: 177832 - DNA, 601 bp, Human; identical to SEQ ID NO: 35674

SEQ ID NO: 177833 - DNA, 601 bp, Human; identical to SEQ ID NO: 35675

SEQ ID NO: 177834 - DNA, 601 bp, Human
ggagtcttaacccagtgtgacctaataaaatacaagtcaaaagaaaatgaaaacctcattatttcaatattatttaaatttctcattaatttcaatgccattgctattctttttagtattgttctatctctttgacttctcagtatggtggctgttaaatgatgctatagtactatattgagtcttacaaggaaatttacttggtagagaaatattgaatttagtggcttttttccccaatttttttccattaagtgggagaatgtatttgtacttcaggatcaaaagctataaggaaaargaggacaggaaggtcgtgagatagaagcagaaagaaactgggaagatggtatcagaagacctggtgaaaatcccagcaatcaactggtgttacatgcttctttatacaaaagtggattgctaccatctctcttggcctttggggagaatgggccacccccattcagaactcctttgctgactggataacatccggcaaagttgatacattactcaagaaaaaaaataagagtgttttctcaaatgccccaaagcctccccagatgactgctggtctgtaatcagggggcggcatggggca

SEQ ID NO: 177835 - DNA, 601 bp, Human
gtgacctaataaaatacaagtcaaaagaaaatgaaaacctcattatttcaatattatttaaatttctcattaatttcaatgccattgctattctttttagtattgttctatctctttgacttctcagtatggtggctgttaaatgatgctatagtactatattgagtcttacaaggaaatttacttggtagagaaatattgaatttagtggcttttttccccaatttttttccattaagtgggagaatgtatttgtacttcaggatcaaaagctataaggaaaaggaggacaggaaggtcstgagatagaagcagaaagaaactgggaagatggtatcagaagacctggtgaaaatcccagcaatcaactggtgttacatgcttctttatacaaaagtggattgctaccatctctcttggcctttggggagaatgggccacccccattcagaactcctttgctgactggataacatccggcaaagttgatacattactcaagaaaaaaaataagagtgttttctcaaatgccccaaagcctccccagatgactgctggtctgtaatcagggggcggcatggggcatagtaactggagtgga

SEQ ID NO: 177836 - DNA, 601 bp, Human
actctgtctcaaaaaatagataaataagatattacaaatatcttaattgatcctaaaatagaaattaaattaccacttgaaaatattttttcaaaattgataatttcagaaattgtctcatggcattccatacgtcatttgtgaaaagaagccagctctgaacttggattagtttcatacccacaataatttgtagtccatttgcatttttttcaagtaagaggtagttttccaataaaaatcagaagttatatttcatgtgtattcacactttgtctaattaaggaagcaattttctccyttttacatgaactggatttgaccagttaagaaacttactattggaagtggctatctttgctaagatgacttttgcttagccaagacagtttacctgtttagtccataactctttttcttcttgcaggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacggtgtgttaaaaa

SEQ ID NO: 177837 - DNA, 601 bp, Human
ctctgagcttccactggataatttccatagattaaactctagagtcattgaagaagtgccaatgaaatggtcctttcagtatttcattgccctttcataagaatataatcctaaattataaattattataagttgctttcttttctcagagaggctgaatacactctgggaatacagaatcctgggagatttgtttttacccaattctcagtgcatttagctcgcttttggatttggtggtatgctgactatttaggatgtggttaacttgaaggagacttgaccgcctgaactagcactrggggaacagctcactgaaacatcactggaataaaaaaaaaaaataatggcttcacaaaaataaagcaatcattattgattaatcaatgtcaccaagttagagctgatattctaaataatagatgaggcagtaactagatataacataaaatatagatctaaataaatatagccaaataggcagccaaattagttcaatatttgaattttttctaatctattaatatatacaacaaagattggatgctatgggatggaacaactcgctcctaaagctggcaatgtacatccttatgcagac

SEQ ID NO: 177838 - DNA, 601 bp, Human
catgcctgtaatcccagctactcagaaggctgaggcataagaatttcttgaacaattgcagaggctacagtgagccgagattgtgccactgcactccagcctgggcaacagagtgagactccatttcaaaaaacaacaacaacaaaaaataggcgtgtgcacaaaagacttgttatgttatgccttaaaagataaaataaaaatatttttaaaagtacaattaattacattacaattcttttaattttaaaatttatttttatttttattttttagagctggaggtctcactatgttgccyaggttggcctcaaactcctaggctcatgagattcttctgcctcagcctcccaattagctgggactaagggtgagcatcactacacctagccatttttttcttactatatttacttttttaaaattcatggctgggcacagtggctcatgtttataatctcagcactttcagaggcagaggcaggaggctcacttgaggtcaggagttcaataccagcctgggcaacattgcaagatccatttccacacaaaaaaaataaaaattaccagggctgggtggcacatgcctgtcatcccaact

SEQ ID NO: 177839 - DNA, 601 bp, Human
tctttctacatctttttttctttttttttttcttttttttgagacggagtctcactctgtcaccaggctggagtgcagtggcacaatctcggctcactgcaacctctgcctcccatgttccagcaattctcctgccccagcatcccgagtagctgggattacaggcgcctaccactacacctggctaatttttgtatttttagtagaggtggggtttcaccatgttggccaggctggtctcaaactcctgacttcaggtgatccacccgcctcagccttctaaagtgctgggattacaggygtgagccaccgcacctggccttgttttcttctttagctgacagactactgctatagagaaaagatagtttataaaaatagtttgatgaagacacaaagtagagttggggaattaagaacaaagtacaggcaggcacacctgtggtcccagctactttggaagctgaggcaggatgagcacttgagcccagtagttctgggctacagtgcgctatgctggtggggtgtccacactaagagcagcatcaatatgatgacctctcaggagtagggtaccaccaggttgcctaaggaggggtga

SEQ ID NO: 177840 - DNA, 601 bp, Human
ttataaaaatagtttgatgaagacacaaagtagagttggggaattaagaacaaagtacaggcaggcacacctgtggtcccagctactttggaagctgaggcaggatgagcacttgagcccagtagttctgggctacagtgcgctatgctggtggggtgtccacactaagagcagcatcaatatgatgacctctcaggagtagggtaccaccaggttgcctaaggaggggtgaacctgcccaggtcagaaacaagcagattaaaactcccgtgctgagaattgggaaggagcctatgaataracattgtatttcagcctgggcaatacagcaacatcctatcttatataaaataataaactactgtctttaggaggtttgaacaggctaatttgttatttcttggatttatattatataatttaccctttaggtaaatttagacttttcctctagaataaattacatatttagaaacctgtaaaacccttacctttttatatgtgtaaaagggttcctttcaagtcatgattcagataaaaatcaaatccttttacacctataaggtccaaaataatttttccagatttaaatcagtctatc

SEQ ID NO: 177841 - DNA, 601 bp, Human
cttagaggcttaattatcagtaacagccactttactagctgtataatattcatttgtgtgacatctcttttctaaaaattccttttcagatactgtggagatgagcttccagatgacatcatcagtacaggtaaggttttaaattgaggaccaaaactatgatttgtttctttacagtgtccctgaaagtaaagggacactgttaaatagtaaatagtagttattattcactttttaaagttgaaagaaccaacaccagatgcagcttgctaggttgtaaaatgcaaaaaaaaaaaaaaaattaaagatttatgccaactgcttgcactaaaaaatgtataaactcttctttgctgaaaatgtaatgtatctgagagtcttgaatctgcaaatccacaaatattgctatagtttatgatttccataaatgtgctaataaaatggctgaaatttttcattgataaagggttgaagtcatttataaagtcattaaaaatctttgtcactaaaacaatcttacatcatattcattacatttttatcttagtacaatattctccagagaatgtttcaaataacaaagttctgtgagatttaaata

SEQ ID NO: 177842 - DNA, 601 bp, Human
gttctgtggctttgggcaagctacttagtagtcactctgtgcctcagtttcttatctgtaaaatgaatatttaaaaagtatccccctcacctcgcagtgttgttgtgggggttaaatgagttaatagataaaagcaagcattaggaatgtatatactctgcttttgtttatatatatttgcagctcatgcctgtgaccccaacattttgggaagctggggtagaaggatcacttgagcacaggagcttgagaccagcctgggcaacatagtgagatcctgtctccaaaaacaaacaaaaaraaggcctttgcctcctttttgaaaaagatataaatattcctatattttatgttatataataaagtttttcctttttatttagcacattttggtctttatattacggtaaaatgtgtttaggtactctgtgtaaagtaggaatctagcttcatttctaataaatgtgaaacttgttgctctgacatcatttagtaaataactcatccacccatcgctggtttgacctgccctgccattctcctgtaattctgtggatgttccttctacaaagagtatcttcttttttttttttttgagacg

SEQ ID NO: 177843 - DNA, 601 bp, Human
caaaaagaaggcctttgcctcctttttgaaaaagatataaatattcctatattttatgttatataataaagtttttcctttttatttagcacattttggtctttatattacggtaaaatgtgtttaggtactctgtgtaaagtaggaatctagcttcatttctaataaatgtgaaacttgttgctctgacatcatttagtaaataactcatccacccatcgctggtttgacctgccctgccattctcctgtaattctgtggatgttccttctacaaagagtatcttcttttttttttttttgagacggagttttgctcttgttgcccaggctggagtgcaatggcagaatcttggctcactgcaacctccgcctcccgggttcaaggattctcctgcctcagcctcccgaggagctgggattacaggcacacgccaccacgcccggctgattttttgtatttttaatagagacggggattcaccatgttggtcaggctggtatggaactctcgacctcaggtgatctgcccacctcgacctcccaaagtgctgggattacaggcgtgacccaccaggcccagcccaagagtaccttttaaa

SEQ ID NO: 177844 - DNA, 601 bp, Human; identical to SEQ ID NO: 29183

SEQ ID NO: 177845 - DNA, 601 bp, Human; identical to SEQ ID NO: 29182

SEQ ID NO: 177846 - DNA, 601 bp, Human; identical to SEQ ID NO: 29181

SEQ ID NO: 177847 - DNA, 601 bp, Human; identical to SEQ ID NO: 29180

SEQ ID NO: 177848 - DNA, 601 bp, Human; identical to SEQ ID NO: 29179

SEQ ID NO: 177849 - DNA, 601 bp, Human; identical to SEQ ID NO: 29178

SEQ ID NO: 177850 - DNA, 601 bp, Human; identical to SEQ ID NO: 29177

SEQ ID NO: 177851 - DNA, 601 bp, Human; identical to SEQ ID NO: 29176

SEQ ID NO: 177852 - DNA, 601 bp, Human; identical to SEQ ID NO: 29175

SEQ ID NO: 177853 - DNA, 601 bp, Human
taaagacagcagcagtgccagagagccaagcaactggatttaggctatcttgattttgcacagccctttcagctgccatcagttcagcctactaggctgctgagttcagaccaccttgggggatatcaactctgctgtactgtgcctcaatttctccctaaaacacagccatgggacatatgagtaaggagaaaatgatggatatccacaagtagaatttttttctcctcaggtgtcagtatgtttccaagaccatcacatccagatttgccccagttctgcccatgcctcccccgtcaarattagcctcttctctcccttgccccctaacacctcctcccactcccagacaataatcgcgacctccagggccctttagagtttacccaacaactctcccaactttgggactcagtgaccacaggcctcccacaagttattttcctcacgttactgggtccgaggctcctcccctccaaagagtaatagtctctcccctcctcatcctagccgaccccctcacccctgcttctccgggatgactagtctgcccttctccgtccccgagttcggaccccgcattccgctcgtggaggtccgg

SEQ ID NO: 177854 - DNA, 601 bp, Human
cgcctcacaggttcaagtcatcctcccacctcagcttcccaagtagctgggactacaggcgtgtgacaccccacctagctaatttgtgtttttttgtttttgttttggttttggttttttatacagacaggatttcaccacgctgcccaagctggtctcgaactcctgagctcagtgatctgcccacctcagcctcccaaagtgctgggattacaggcatcacccactgtgcccgccaatactgatacttcaattctgccaaacacacccttcactgaatggctaggcacaagaaggtacytagcacaatctgactactatgatatgcagcaggaaaggagcccctcagctataccatggaagagtgatggccagtgtggatgtggttggtcaaaactctggccaggttggtgttatcttcctgattaaggggcagcaggaaagctggaagacccaaatatgcaccaaaattcagctcctgtaacatggcctggaacggagatgaagaggaaaagtttgagctaacaagcaaacagcttttttttttttttttttgagacaaagtctcactctgtcacccaggctggagtgcagtggcaca

SEQ ID NO: 177855 - DNA, 601 bp, Human
tttttttttttttgagacaaggtctggctctgtcacccaggctggagtgcagtggtgcaatctcagctaactgcaacctccgcctcacaggttcaagtcatcctcccacctcagcttcccaagtagctgggactacaggcgtgtgacaccccacctagctaatttgtgtttttttgtttttgttttggttttggttttttatacagacaggatttcaccacgctgcccaagctggtctcgaactcctgagctcagtgatctgcccacctcagcctcccaaagtgctgggattacaggcatsacccactgtgcccgccaatactgatacttcaattctgccaaacacacccttcactgaatggctaggcacaagaaggtacttagcacaatctgactactatgatatgcagcaggaaaggagcccctcagctataccatggaagagtgatggccagtgtggatgtggttggtcaaaactctggccaggttggtgttatcttcctgattaaggggcagcaggaaagctggaagacccaaatatgcaccaaaattcagctcctgtaacatggcctggaacggagatgaagaggaaaagtttgag

SEQ ID NO: 177856 - DNA, 601 bp, Human
gatccttatgtaaatatctgccttgtcttacgtaagtttccaaaataattacatttacatgttttgaaactctcttcataccacttttagatggagaggtgcgcaatactgacctttttttttttttttttttgagacaaggtctggctctgtcacccaggctggagtgcagtggtgcaatctcagctaactgcaacctccgcctcacaggttcaagtcatcctcccacctcagcttcccaagtagctgggactacaggcgtgtgacaccccacctagctaatttgtgtttttttgttttkgttttggttttggttttttatacagacaggatttcaccacgctgcccaagctggtctcgaactcctgagctcagtgatctgcccacctcagcctcccaaagtgctgggattacaggcatcacccactgtgcccgccaatactgatacttcaattctgccaaacacacccttcactgaatggctaggcacaagaaggtacttagcacaatctgactactatgatatgcagcaggaaaggagcccctcagctataccatggaagagtgatggccagtgtggatgtggttggtcaaaactctg

SEQ ID NO: 177857 - DNA, 601 bp, Human
tggtgccaccaagggtacccgcatccagaactgcacatgaacagtcacccttttagaactctcttttgaactcattgggtccagaaagtttccctcaataaaaaaaacttcatccagacctcgttaatccctttatatgcttttcccaatttgtaattttgtaagtgaacatgtaccttatatatagatccttatgtaaatatctgccttgtcttacgtaagtttccaaaataattacatttacatgttttgaaactctcttcataccacttttagatggagaggtgcgcaatactgacctttttttttttttttttttgagacaaggtctggctctgtcacccaggctggagtgcagtggtgcaatctcagctaactgcaacctccgcctcacaggttcaagtcatcctcccacctcagcttcccaagtagctgggactacaggcgtgtgacaccccacctagctaatttgtgtttttttgtttttgttttggttttggttttttatacagacaggatttcaccacgctgcccaagctggtctcgaactcctgagctcagtgatctgcccacctcagcctcccaaagtgctgggattaca

SEQ ID NO: 177858 - DNA, 601 bp, Human
catggttgtaatcccatcctccccaggtcatgctggccctgtgctttcctcaccctgggcaccacacagtacctgctggtactgagagtatttgatggggtccttttcaaacacttcatatgtctgagattccagattgtccatcagtggctgatgaatgaggaaaaggacaaagttagccagtttctggcaaaggacaatgcactaaaatatcaaaaactttccactgctttctgagttttagtaagatttggaggcatatattctcaagaaacattttccatcccaccttcctcctctmagtgcactccagacccacctgaagcggggactgcagatagtcttcatagcccttggcaaagagttcataggcattaggtggaggacggttctggcttaagtattccaggtattggaggtaggagcagaactccttctctgagtggtggttggtgcctgtgatgatgaactgcacctccaactgtgagaaaagtcagaccatcagacacagccctcaaaccaagattctggaatattatggtatatggccaaagagccctagtgtaaaataaggcccagatcaacagttctcttttttttt

SEQ ID NO: 177859 - DNA, 601 bp, Human
cctcttctggtactcggtctagcagacatttatagatggcctggagggaggagagaatatcccatggttgtaatcccatcctccccaggtcatgctggccctgtgctttcctcaccctgggcaccacacagtacctgctggtactgagagtatttgatggggtccttttcaaacacttcatatgtctgagattccagattgtccatcagtggctgatgaatgaggaaaaggacaaagttagccagtttctggcaaaggacaatgcactaaaatatcaaaaactttccactgctttctgagytttagtaagatttggaggcatatattctcaagaaacattttccatcccaccttcctcctctaagtgcactccagacccacctgaagcggggactgcagatagtcttcatagcccttggcaaagagttcataggcattaggtggaggacggttctggcttaagtattccaggtattggaggtaggagcagaactccttctctgagtggtggttggtgcctgtgatgatgaactgcacctccaactgtgagaaaagtcagaccatcagacacagccctcaaaccaagattctggaatattat

SEQ ID NO: 177860 - DNA, 601 bp, Human
caccctcatactctgccatctactgccatagacactcactcagagtgatgtcctgataaagcacagtctcaaagtagccggcaaagccatgtagtactgtgttcacctccacaggaaattccaaggtgcaatagcggttgttgtcaatcataggatctgtcaggaaataattatgtgggtgacaaggggccagaagctctagacaacttgataaagcatgagcaagacccaggaaaggaagagtagataaggcagactagggacagtaagggaagaaagcaggaggaaggaagaagcccgyacccctctagtcagaggacagccataaaagaacctacctctgttgggatggctgaaggtgaaacagggctggggtgcagagagctggtggaagttgtgcagccgtaccacataaggcatctcaaactgggcctgtcagagacagaaagagagagagagtgttggggaagacacacaagagagaactacttccccaaggattaaaaaaagttttactttagtgcttccccaatccctaacttctccttcacctcttcatccccagcagaagaaaatagctgatgcaaatacagaaaaagaa

SEQ ID NO: 177861 - DNA, 601 bp, Human
aggaagcacaccctcatactctgccatctactgccatagacactcactcagagtgatgtcctgataaagcacagtctcaaagtagccggcaaagccatgtagtactgtgttcacctccacaggaaattccaaggtgcaatagcggttgttgtcaatcataggatctgtcaggaaataattatgtgggtgacaaggggccagaagctctagacaacttgataaagcatgagcaagacccaggaaaggaagagtagataaggcagactagggacagtaagggaagaaagcaggaggaaggaaraagcccgcacccctctagtcagaggacagccataaaagaacctacctctgttgggatggctgaaggtgaaacagggctggggtgcagagagctggtggaagttgtgcagccgtaccacataaggcatctcaaactgggcctgtcagagacagaaagagagagagagtgttggggaagacacacaagagagaactacttccccaaggattaaaaaaagttttactttagtgcttccccaatccctaacttctccttcacctcttcatccccagcagaagaaaatagctgatgcaaatacag

SEQ ID NO: 177862 - DNA, 601 bp, Human
gctgtgacttttgcctatgctgaagagggtctcttctctaatcacacaaagatctccattcattgagcactgggccccccataaatctaaatgacacatgtacatataagctgcccaggaagcacaccctcatactctgccatctactgccatagacactcactcagagtgatgtcctgataaagcacagtctcaaagtagccggcaaagccatgtagtactgtgttcacctccacaggaaattccaaggtgcaatagcggttgttgtcaatcataggatctgtcaggaaataattatgtsggtgacaaggggccagaagctctagacaacttgataaagcatgagcaagacccaggaaaggaagagtagataaggcagactagggacagtaagggaagaaagcaggaggaaggaagaagcccgcacccctctagtcagaggacagccataaaagaacctacctctgttgggatggctgaaggtgaaacagggctggggtgcagagagctggtggaagttgtgcagccgtaccacataaggcatctcaaactgggcctgtcagagacagaaagagagagagagtgttggggaagacacaca

SEQ ID NO: 177863 - DNA, 601 bp, Human
aaaagagagataagatcaggccaggcgcggtggctcacgcctgtaatcccagcactttgggaggctgaggtgggcggatcatgaggtcaggagatcgagaccatcctggctaacacggtaaaaccccgtctctactaaaaatacaagaattagccgggtgtggtggctggcacctgtaatctcagcctcagggaggctgaggcaggagaatggcatgaacccgggaggcggagcttgcagtgagccgaaattgtgccactgcactccagcctgggcgacagagtgagactccatctctttaaaaaaaaaaaaaaaaaaaaagacagcaagagagataagatcaaatttgagtttttaaaagatgactcttgctcaaagtagagaacagacagaagagtagccagagtagatgcgggaaagccaggcagaaggccactccaaatactcccaacacctaccactgggatccaagagcatatgaaatcaggagaacatgagtcatagtcaactatcttcctgggagaaggaaagaagcacaacaccaaaggcaaaggttactgcttaactagagagtcttaaaagcagttcctaccttaatagg

SEQ ID NO: 177864 - DNA, 601 bp, Human
ttaagcaaaaaagagagataagatcaggccaggcgcggtggctcacgcctgtaatcccagcactttgggaggctgaggtgggcggatcatgaggtcaggagatcgagaccatcctggctaacacggtaaaaccccgtctctactaaaaatacaagaattagccgggtgtggtggctggcacctgtaatctcagcctcagggaggctgaggcaggagaatggcatgaacccgggaggcggagcttgcagtgagccgaaattgtgccactgcactccagcctgggcgacagagtgagactccrtctctttaaaaaaaaaaaaaaaaaaaaagacagcaagagagataagatcaaatttgagtttttaaaagatgactcttgctcaaagtagagaacagacagaagagtagccagagtagatgcgggaaagccaggcagaaggccactccaaatactcccaacacctaccactgggatccaagagcatatgaaatcaggagaacatgagtcatagtcaactatcttcctgggagaaggaaagaagcacaacaccaaaggcaaaggttactgcttaactagagagtcttaaaagcagttcctacc

SEQ ID NO: 177865 - DNA, 601 bp, Human
atcaagtcttacaagcaatgtcccagattttgacttttatcctaaagacaatgggaaggcattgaagagttttaagcaaaaaagagagataagatcaggccaggcgcggtggctcacgcctgtaatcccagcactttgggaggctgaggtgggcggatcatgaggtcaggagatcgagaccatcctggctaacacggtaaaaccccgtctctactaaaaatacaagaattagccgggtgtggtggctggcacctgtaatctcagcctcagggaggctgaggcaggagaatggcatgaaccygggaggcggagcttgcagtgagccgaaattgtgccactgcactccagcctgggcgacagagtgagactccatctctttaaaaaaaaaaaaaaaaaaaaagacagcaagagagataagatcaaatttgagtttttaaaagatgactcttgctcaaagtagagaacagacagaagagtagccagagtagatgcgggaaagccaggcagaaggccactccaaatactcccaacacctaccactgggatccaagagcatatgaaatcaggagaacatgagtcatagtcaactatcttcctggga

SEQ ID NO: 177866 - DNA, 601 bp, Human
ggggtggccccaggcagaggagccagggtatcctggtctgaagccccactggagccatcgttgtcattgagagacaggttgactaggtctggaaagcaagggaagagaggaagaaatcactgcttcaagaggctagggccccaagacaccgaatggagaggaactgggaacagttctcccagacccacccacgatggggctcaaaacaggggttcacaagggtctctgacaagaaactcccatctacttctgccatgagggcaggggcacagccactagcccacgtctttgcgggactcargtaagaggtgcaccttcccccggtggacacagtcctgcacctggcacatggcttgtccagcagcacatgggtggacgtcagcccccatcctcggccagtgcaggacctagtgcgggacacacactgctcgaccatccatggtggccctggctgcggtttctgggctaggtctagggttggagaggcagaacaaggtaggcaaagccacactcccagagttggggcagggggacttacagctctcacagccaccactgaggtctccgaagacgtaatagcactgctcagagaaggtgatct

SEQ ID NO: 177867 - DNA, 601 bp, Human; identical to SEQ ID NO: 23763

SEQ ID NO: 177868 - DNA, 601 bp, Human; identical to SEQ ID NO: 23764

SEQ ID NO: 177869 - DNA, 601 bp, Human; identical to SEQ ID NO: 23765

SEQ ID NO: 177870 - DNA, 601 bp, Human; identical to SEQ ID NO: 23766

SEQ ID NO: 177871 - DNA, 601 bp, Human
tactggtggcaaggatgcatggatggaagtactaggggctaggcatccaatcctactctcaccgtaagcacttggggtccaaacatttgtttggctctgtcagctgccatgagggtgcctgggcgattgtgtcctccagggctccctagaaagggagaagggcttcatgatgctgaaatgggaggctgtgacctccaagaaggccggttccatctggtggtttctttagtcctcaccctgcatgctgaggagatgagttcctgtgtgaacagtcaggctctgctggtatgcagctgatgtyagggtggtcaggtcactggagtgaaaggaagacaggtcaaagtcaaggacagatgccttctcttttgccattaaacactggttcttttactacctgatcccagttccacttggcccccatttcagtttttagcactctgatcccacctctgttcctttcgcctccgtttttcttcctcatgtaaaactttcttgagctgcaggaaaagctggtgcttctcttcctgtagagccaaaagcttctcctccaacttcagaatctgggatggggtgggaaaagaagatgaaggcagggagagtc

SEQ ID NO: 177872 - DNA, 601 bp, Human
aagaggaaggaaaaaccagatgatgtgggccacctgtcctacctaatcctgcttttccggatccctagtgtagggattctgacaggtaaattctattaccattcttacctttcctgctggctgcatctgcacagggagctggggggaagcaaggagtccaggggctggatgcagagcctgggggtgcatggggcgcagagaggactgcagagaacagagtcagggcctgaggcatactgaagctccccttaacatatccctaaccctgacctcccaaggtgccatactcactgagtcggaraagccagtctgctggttagcatgttccatctgcttttgcaaggacagggcaccaccaggctggaggaaacctaggtggggaagaggggcatgtgagatgagaatgaaacagggaggggaggacctgagagctagagctcctgcatgggatgttatcacctgtctgagtgggctgaaagtggccatgcacagcatagggctgtggctgtggctgagataggtactgcactgcagggaatgccgaaggagctgagaaaggaaaagacagagccattaaaatcttttactgaatggcattcct

SEQ ID NO: 177873 - DNA, 601 bp, Human; identical to SEQ ID NO: 177871

SEQ ID NO: 177874 - DNA, 601 bp, Human; identical to SEQ ID NO: 177872

SEQ ID NO: 177875 - DNA, 601 bp, Human
tgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcrcctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggtt

SEQ ID NO: 177876 - DNA, 601 bp, Human
aggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtsggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttg

SEQ ID NO: 177877 - DNA, 601 bp, Human; identical to SEQ ID NO: 22842

SEQ ID NO: 177878 - DNA, 601 bp, Human; identical to SEQ ID NO: 22843

SEQ ID NO: 177879 - DNA, 601 bp, Human; identical to SEQ ID NO: 22844

SEQ ID NO: 177880 - DNA, 601 bp, Human; identical to SEQ ID NO: 22845

SEQ ID NO: 177881 - DNA, 601 bp, Human; identical to SEQ ID NO: 22846

SEQ ID NO: 177882 - DNA, 601 bp, Human; identical to SEQ ID NO: 22847

SEQ ID NO: 177883 - DNA, 601 bp, Human; identical to SEQ ID NO: 22848

SEQ ID NO: 177884 - DNA, 601 bp, Human
gcggtggctcacgcctgtaatcccagcactttgggaggccgaagcaggtggatcactaggtcaggagatcgagaccatcctggctaacacagtgaaaccccgtctctactaaaaatacaaaaaaatagccgggcatggtggtgggcacctgtagtcccagctactcgggaggctgaggcaggagaatggcgcgaaccagggaggcggagcttgcagtgagccaagatcgcaccactgcactccaagcctgggcaacagggcgagactccatctcaaaaaaaaaaaaaaaaaaaaaaaaaaatgactacaatgcacttagcaactgaagtacaggcagaaaccacccaagagaaattacaagaccctctgcagttatagaaaaatatgacttagagaaggagtcaaagaaagacatttccaagggcatgagaaactagagaggactacagtgggggaaaaaggcctgaggggaactgaaggaaagggggaagggggatccactcttaacaagtgatgccatgggaaggtatctcttccccagctccccagggtgaaatcaaagaatgagacagaaatcaggagagtctctaggacaattcca

SEQ ID NO: 177885 - DNA, 601 bp, Human
tttttctccaagggtatctgtggtggaagtgagccccaagttctgctcagtctacgctcattgtgaaaataagcaggtgaaggcaagagcaggtgggtggaatgtattagggagccacctagatccagaggataacttgattcagtggccatagcatcacctggctttggcttctggagcctggcaccaagccagcagaggaagagagagccccaggttcctaggtactttggtttcctcaaattagaagatataaaattggtccccaccttcaccgtcttctagttctagactcccaaarcaaaggagggggttctaggagaagagcaggaacagtctgagtaaaaaccaagtactgaagctgaggatgccatgttgattaagaaaggaatggggattaggatatccagatgaggtttggagtaggaagattgcgccctggacggtgaatacttcatttgggagagtacaacttaaagaataaaatacattaggccattttgtacgtcttaagccattttgtacgtcttaagcatgatgactgcggtttcaagctcacggtgaggtatgcctccctcaacccttgttacggatgccagtc

SEQ ID NO: 177886 - DNA, 601 bp, Human
ataatatataaattagccaggcgtggtggcacatggctgtaacctcagttattcagggtggctgaggcatgaaaatcacttgaagccaggagttagagactgcagtcagtcaagatcatgccatcgcactgcagcctggacaacagggcaaactctgcctcaaaaaaaaaaaaagaagaaaagaagaaaagaaaagacaagactatcctttcttagctgaattgaactgccttttcatttctatcgaaaatcaggaagggcaatttaatgtataatgacagaagattggtagttgatggargacttttgggagtgacagaaatgttcattcctttgattgcagtgatggactcagttacatacatgtcaaaacttaacaaatggcacactttaaatatgtctactttgttgtatgtcaatttcagctcaataaagatgttttttaaaaaaattagagagcccatacaacacagggaaacctcatctctgcaaaaaatttataaattagcagggtatgatggcttgtgcctgtagtcccagctatttaggaggctaaggtgggaggatcacttgagccagggaggtcgaggctgtgatgagc

SEQ ID NO: 177887 - DNA, 601 bp, Human
cacgcctgtaatcccaacactgggaggccgaggctggcagatcagctgaggccatgagttcgagactagtctggccaatatggcaaaatcccattgctactaaaaaaaaaaaataataataataataataatatataaattagccaggcgtggtggcacatggctgtaacctcagttattcagggtggctgaggcatgaaaatcacttgaagccaggagttagagactgcagtcagtcaagatcatgccatcgcactgcagcctggacaacagggcaaactctgcctcaaaaaaaaaaaaagaagaaaagaagaaaagaaaagacaagactatcctttcttagctgaattgaactgccttttcatttctatcgaaaatcaggaagggcaatttaatgtataatgacagaagattggtagttgatggaggacttttgggagtgacagaaatgttcattcctttgattgcagtgatggactcagttacatacatgtcaaaacttaacaaatggcacactttaaatatgtctactttgttgtatgtcaatttcagctcaataaagatgttttttaaaaaaattagagagcccatacaacacagg

SEQ ID NO: 177888 - DNA, 601 bp, Human
gggcggtagcacacgcctgtaatcccaacactgggaggccgaggctggcagatcagctgaggccatgagttcgagactagtctggccaatatggcaaaatcccattgctactaaaaaaaaaaaataataataataataataatatataaattagccaggcgtggtggcacatggctgtaacctcagttattcagggtggctgaggcatgaaaatcacttgaagccaggagttagagactgcagtcagtcaagatcatgccatcgcactgcagcctggacaacagggcaaactctgcctcaraaaaaaaaaaagaagaaaagaagaaaagaaaagacaagactatcctttcttagctgaattgaactgccttttcatttctatcgaaaatcaggaagggcaatttaatgtataatgacagaagattggtagttgatggaggacttttgggagtgacagaaatgttcattcctttgattgcagtgatggactcagttacatacatgtcaaaacttaacaaatggcacactttaaatatgtctactttgttgtatgtcaatttcagctcaataaagatgttttttaaaaaaattagagagccca

SEQ ID NO: 177889 - DNA, 601 bp, Human
agagacagggtttcgctatgttgcccaggctggtcttgaactcctggactcaagcaatgcacccgccttagcttccaagaatgttggaattacaggtgtgaccactgtgcccagcccattttttacctaaagatatcttgttccagcactgtctgttgaagactatcctttctggccaggggcggtagcacacgcctgtaatcccaacactgggaggccgaggctggcagatcagctgaggccatgagttcgagactagtctggccaatatggcaaaatcccattgctactaaaaaaaaawaataataataataataataatatataaattagccaggcgtggtggcacatggctgtaacctcagttattcagggtggctgaggcatgaaaatcacttgaagccaggagttagagactgcagtcagtcaagatcatgccatcgcactgcagcctggacaacagggcaaactctgcctcaaaaaaaaaaaaagaagaaaagaagaaaagaaaagacaagactatcctttcttagctgaattgaactgccttttcatttctatcgaaaatcaggaagggcaatttaatgtataatgacagaag

SEQ ID NO: 177890 - DNA, 601 bp, Human
tccatctgcctcagcctcccaaagctggaattaaagatgtgagccactgtgcccagcctatgatccattttgaattaaattttatatataaggtgaggtattgatcaatgttttttaaatttttaaattcttatttatttttttgagacagagtttcgctcttgttgcccacgctggagtgcaatggtgcaaccttggctcaccgcaacctccgcctcccaggttcaagcaattctgcctcagcctcccaagtagctgggattacaggcatgggccacgaccctggctaattctgtatttytaagagagacagggtttctccatgttcgtcagactggtctcaaactcccgacctctggtgatccacccgcctcagcctcccaaagtgctgggattacaggtatgaaccatcgcaccaggccacttttttttatttttaatatatttttaaattaaaatttttttttaatagagacagggtttcgctatgttgcccaggctggtcttgaactcctggactcaagcaatgcacccgccttagcttccaagaatgttggaattacaggtgtgaccactgtgcccagcccattttttacctaaa

SEQ ID NO: 177891 - DNA, 601 bp, Human
tgggatgtatcttaaaccaaggatacaagaaaccagaggaaggaactaattaaaatcagaggacggcagggcatggtggctcatgcctgtaatcccagcactttgggaagctgaggcgggtggatcacctgaagtcagaaattcaagactagcctggccaacatggtgaaaccatgtctttacaaaaatgcaaaaattacccgagcatgatggcaggtgcttgtaatcccagctacttgggaggctgaggtggaagaattgcttgaacccaagaggcggaggttgcagttagctgagatcrcgccactgcactccagcctgggcaacagagcaagactccatctcaaaacaacaacaacaacaacaacaaaaaaatcagagggcactggattttagatgttgttaccataaatggaaggcaaatcgcctgaaactggggatgttcctgagagtttggctgatcacaacagtgataaaaggggaactgttgcattttacatttccataggctacatggctggatatggcttagttggggaggaaggaacatgaaccaaccagagaaaagcctagaatcctggggaaaagtgacatttagaaa

SEQ ID NO: 177892 - DNA, 601 bp, Human
aaagggtcagaggccgggcgtggtggctcacgcctgtgatcccagcactttgggaggccaaggcgggcggatcacgacgtcaggagttcaagaccagcctgaccaatatggtgaaaccctgtttctactaaaaatacaaaaattagccgggcatgtcgggcgcggtggctcacgtctgtaatcccagcactttgggaggccgaggcgggtggatcaggagatcagcagttcaggaccagcctggccaacatggtgaaaccctgtctctactaaaaacacaaaaaaaaattagccaggcgcratggcaggcgcctgtaatcccagctactcgggaggctgaggcaggagaatcgcttcaatctgggaggtggaggttgcagtgagccgagatcgcgccactgcactccagcctgggcgacagagtgagattccatctcaaaaaaaaaaaaattagccggcgtggtgacgcacacctgtaatcccagctactcaggaggctgaggcaggagaattgcttgaacccgggaggtggaggttgcagtgagccgagatcgtgccattgttctccagcctgggtgacaagagtgagacttcgtctcaa

SEQ ID NO: 177893 - DNA, 601 bp, Human
cttcattgcgggacataagtagcagtttggtgcgcaggcttcggaaatgcatatcacccagcagagatgctcgcttcacaggggcttctgtggttgactgggaggaaaccagtgggaaagtcattaaaactggcttggaataaacactaagggagagccagggactagaaatcaggatgcctaagtcccgggaaaagggttaagaaatgaagctaggagaccgggcgcggtggctcatgcctgcaatcccaggactttgggaggccaaggcaggcggatcacgaggtcatgagatcgagamcatcctggccaacgtggtgaaaccctgtctttactaaaaatacaaaaattagctgggcgtggtggcacatgcctataatcccagctactccagaggctgaggcaggagaatcgcttgaacccgggagtcggaggttgcagtgagccgagactgcgccactgcactctagcctggtgacagaacaatactctgttttcaaaaaaaaaagaaatgaagctaggaaggaggagactcattgtcagtcccacaaaggctgactatcagggtactgaaggaaaatggtttagagagaaagcaagg

SEQ ID NO: 177894 - DNA, 601 bp, Human
agggaggaagacaatacccttcagcagaaggaaaaggagctaaaagttacctctaggtgcttggtagcttcttcattgcgggacataagtagcagtttggtgcgcaggcttcggaaatgcatatcacccagcagagatgctcgcttcacaggggcttctgtggttgactgggaggaaaccagtgggaaagtcattaaaactggcttggaataaacactaagggagagccagggactagaaatcaggatgcctaagtcccgggaaaagggttaagaaatgaagctaggagaccgggcgcggyggctcatgcctgcaatcccaggactttgggaggccaaggcaggcggatcacgaggtcatgagatcgagaccatcctggccaacgtggtgaaaccctgtctttactaaaaatacaaaaattagctgggcgtggtggcacatgcctataatcccagctactccagaggctgaggcaggagaatcgcttgaacccgggagtcggaggttgcagtgagccgagactgcgccactgcactctagcctggtgacagaacaatactctgttttcaaaaaaaaaagaaatgaagctaggaaggaggag

SEQ ID NO: 177895 - DNA, 601 bp, Human
tagagctctgccatctggaggagtctgagataaaatagctgacccaggtttaattgcccagaaaaagccttagtctttgttctgtaaacacaagatcatggatggaggacagggtaggaagggaggaagacaatacccttcagcagaaggaaaaggagctaaaagttacctctaggtgcttggtagcttcttcattgcgggacataagtagcagtttggtgcgcaggcttcggaaatgcatatcacccagcagagatgctcgcttcacaggggcttctgtggttgactgggaggaaaccartgggaaagtcattaaaactggcttggaataaacactaagggagagccagggactagaaatcaggatgcctaagtcccgggaaaagggttaagaaatgaagctaggagaccgggcgcggtggctcatgcctgcaatcccaggactttgggaggccaaggcaggcggatcacgaggtcatgagatcgagaccatcctggccaacgtggtgaaaccctgtctttactaaaaatacaaaaattagctgggcgtggtggcacatgcctataatcccagctactccagaggctgaggcaggagaat

SEQ ID NO: 177896 - DNA, 601 bp, Human
cctagcactttgcaaagtacaggcagatggatctcttgagcctagaagttcaagaccaaggccgggcgcagcggctcatgtctgtaatcccagcactttgggaggccgaggcaggtggatcatgaggtcaggagtttgagaccagcctggtcaacatggtgaaaccccatcaatactaaaaatacaaaaatgagctgggtgtggtggcacaagcctgtagtcccagctactcaggaggctgaggcgggagaatcgcttgaacccagaaggtggatgttgcagtcagctgagactatgccaytacactacagcctgggtgacaaagtgagactccgtctcaaaaaaaaccattcagccaggtgtggtggctcacgcctgtaatcccagcactttgggaggctgaggcgggtggatcacatgaggccaggagttcgaggccagcttgggcaacatggcaaaaccccatcttactaataatacaaaacttagccgggtgtggtggcgcacgcctgtaatcccagctactcagaaggctgaggcatgagaatcgcttaaacacaggaggcaggggttgcagtgagccgagatcgtgtcattgcac

SEQ ID NO: 177897 - DNA, 601 bp, Human
taatcctagcactttgcaaagtacaggcagatggatctcttgagcctagaagttcaagaccaaggccgggcgcagcggctcatgtctgtaatcccagcactttgggaggccgaggcaggtggatcatgaggtcaggagtttgagaccagcctggtcaacatggtgaaaccccatcaatactaaaaatacaaaaatgagctgggtgtggtggcacaagcctgtagtcccagctactcaggaggctgaggcgggagaatcgcttgaacccagaaggtggatgttgcagtcagctgagactatrccattacactacagcctgggtgacaaagtgagactccgtctcaaaaaaaaccattcagccaggtgtggtggctcacgcctgtaatcccagcactttgggaggctgaggcgggtggatcacatgaggccaggagttcgaggccagcttgggcaacatggcaaaaccccatcttactaataatacaaaacttagccgggtgtggtggcgcacgcctgtaatcccagctactcagaaggctgaggcatgagaatcgcttaaacacaggaggcaggggttgcagtgagccgagatcgtgtcatt

SEQ ID NO: 177898 - DNA, 601 bp, Human
cccaaagtgctaaagtgctgcgattaaaagcgtgagccaccgcgcccaccctaaaaaataaatattctagtctaggctgcatgtggtggctcacacctgtaatcctagcactttgcaaagtacaggcagatggatctcttgagcctagaagttcaagaccaaggccgggcgcagcggctcatgtctgtaatcccagcactttgggaggccgaggcaggtggatcatgaggtcaggagtttgagaccagcctggtcaacatggtgaaaccccatcaatactaaaaatacaaaaatgagctgsgtgtggtggcacaagcctgtagtcccagctactcaggaggctgaggcgggagaatcgcttgaacccagaaggtggatgttgcagtcagctgagactatgccattacactacagcctgggtgacaaagtgagactccgtctcaaaaaaaaccattcagccaggtgtggtggctcacgcctgtaatcccagcactttgggaggctgaggcgggtggatcacatgaggccaggagttcgaggccagcttgggcaacatggcaaaaccccatcttactaataatacaaaacttagccgggtgtg

SEQ ID NO: 177899 - DNA, 601 bp, Human
aatactgaaattagggccaggtatagtggctcatgcctgtaatcccagtactttgggaggccaaggcaggtggatcacctgcggtcgggagttcaaaaccagcctgggcaacatggtgaaacactaaaaaagcaaaaattatccagacgtgggggcgcgtgcctattatcccagctacctgggaggccgaggcacaagaatcgcttgaacccaggagcgagaggttgcagggagcggagattgtgccattgcactccagcctgggtgacagagggaaactgtctccaaaaaaaaaaaaaaatagccaggtatggtggcatgcacctgtaatcccacccacccaaaggctgaggtgagaggatcacttgagctcggggggtagagactgcagtgagctgagatcgcaccactacatacactccagcctggataacagactgagactccatctcaaaacaaaaaacaaaaacaaaaaataaagtttgtatcatctgaaggtaatggtgaatttttacctgccagtgccctgagcaggatccctgaagaagtcaaagattatcatgacccagaaattgcacaggcacagaaaaaagcctcccaa

SEQ ID NO: 177900 - DNA, 601 bp, Human
cctgtaattccagcactgtgggaggctgaggcaggtggatcacaaggtcaggagatcaagaccatcctgccaacatagtgaaaccccatctctattaaaaatacaaaaattagctggccttggtggggtgtgcctataatcccagctgcttgggaggctgaggcaggagaattgcttgaaccagggagttggaggttacagtgagccgaggtcatgccactgcactccagcctggtgacagagcaaaactctgtctcaaaaaaaagtgaggggttaagaaaaacagaaaacatgcctctataacaccaggctttcacttcatttctcaatcagtccttagaggaacccctgggttcaggggcaggaagacaggaaaggttttagaggagtgaatcccatgttgtaagcaccaaatagaaacaatacctgaaaggagacattcctagattgaaatacactacttcccacttccaagttggataggactgaattataccaaggatttataccaggcaagaagagaaagttggaaaaataaactaagttgagtgttcaaaatcactacattaggaggggaggggaagagatctacaatgaccta

SEQ ID NO: 177901 - DNA, 601 bp, Human
cttcggcctctcttccctctatcccctaagagacccagaagaaagacatcctttgctgacctccccatagatgcggaaagtgcaggtctcttcacccaactcaatggcggtcaccccaggtacttttcgggcctgctggatgttggcaccgtgagtcccaattgccagtcccatcaggtcctctcgcactgtgaactcctcttggaaggctgctgccaactgcttgcttgtctgaaaggaaaagtcactgtaggaatcatggtggtagaatctcacagtcccaggcacacgaccctttgcrtaacttaaataaggaaaactgtgtgatattaatagaaagctagaaccactctggagtccgcggaccacgaggacctgtgtggaaaggtcaggaactttttgttttttctttgagatggcgtctcgctctgtcgcccaggctggagtgcagtggcgcgatctcagctcactgcaacctccgcctctcgacttcaagtgattctcatgcctcggcctcctgagtagctacgactacaggtgtccaccaccatgcctggctaatttctgtatttttagtagagacaaggtttcaccatgttgg

SEQ ID NO: 177902 - DNA, 601 bp, Human
gcctcggcctcccaaagtgcaggcgtgagccacagcgcccagcctgattccattctatatgaagttctccaacaggcaaaatggttatggagatcaaaataaaggtggggtcgggaatcgactgggaagagacgtgatgaaacgtttctgggacgatgaaaagggtctgtgacttggtaggcatcacggagcggttaggggccaaaactcatcttcctgtgcacttgctgtgtgcactggcgctgtgtgtaaatgccacctcgatttaggaaaaagatgacgtaagtacggcacaaagtgsccggtacgcggcaggtgcatgggaagaaactgcggaatgaaacaaccgcgagctaagagatggggcagcgggagaaatgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacaggtagattgtttttccgacaaattatcaaacgacccatcattgcactctttcaaaatttgattctcagac

SEQ ID NO: 177903 - DNA, 601 bp, Human
caaaatacagctactttttacttccaaactcgcaattcccctcctaagtatttctccaagaaacacgaaaacatatgatcacaaaaagaattgtacaagaatgtttatagcagctttatttcataaccgcaaatgggaaacaactcaaaaggccatcaaaaggacggatatacaatcgatggactatactaaatgaaaaggagcaaaatactgatatatacaacatgaacgaatgtcagacagtacattgaaggacagaagcccgacaaaaatgagcacataatgtatgattccccccttgtttttgagacggagtttcgttcttgtcgcccaggctggagtgtagtggcacgatcttggctcactgcaacctctgcctcccgggttcaagcgattctcctgcctcaccctcccgaatagctgggattacaggcacccaccacgcccagctaatttttgtattttttagtagagacggggattcaccacgttggccacgctggtctggaactcctatcctcaagtaatccgcccgcctcggcctcccaaagtgcaggcgtgagccacagcgcccagcctgattccattctatatgaagttc

SEQ ID NO: 177904 - DNA, 601 bp, Human
gaaggctgtggcacaaccataataactcccataccttgctagttggagtgtaaaatggtacaaccgctctggaaaactcagagcttctgaaaaagttcaaaatacagctactttttacttccaaactcgcaattcccctcctaagtatttctccaagaaacacgaaaacatatgatcacaaaaagaattgtacaagaatgtttatagcagctttatttcataaccgcaaatgggaaacaactcaaaaggccatcaaaaggacggatatacaatcgatggactatactaaatgaaaaggagcaaaatactgatatatacaacatgaacgaatgtcagacagtacattgaaggacagaagcccgacaaaaatgagcacataatgtatgattccccccttttttttgagacggagtttcgttcttgtcgcccaggctggagtgtagtggcacgatcttggctcactgcaacctctgcctcccgggttcaagcgattctcctgcctcaccctcccgaatagctgggattacaggcacccaccacgcccagctaatttttgtattttttagtagagacggggattcaccacgttggccacgctggt

SEQ ID NO: 177905 - DNA, 601 bp, Human
gaatgtataaagcagtcccacaactgaacaataaaaacaaacaaaaaaccaaaataacaggtaaaagactcgaagagctactttacaaacaaaatacgaatggccaataggcacatgaaaaaatgctgaacatccttagtcaatagagaactgtaaattacaaccacaaggatataccacattagaaagactgacaatacctaatgtccggaaggctgtggcacaaccataataactcccataccttgctagttggagtgtaaaatggtacaaccgctctggaaaactcagagcttctgawaaagttcaaaatacagctactttttacttccaaactcgcaattcccctcctaagtatttctccaagaaacacgaaaacatatgatcacaaaaagaattgtacaagaatgtttatagcagctttatttcataaccgcaaatgggaaacaactcaaaaggccatcaaaaggacggatatacaatcgatggactatactaaatgaaaaggagcaaaatactgatatatacaacatgaacgaatgtcagacagtacattgaaggacagaagcccgacaaaaatgagcacataatgtatgattcc

SEQ ID NO: 177906 - DNA, 601 bp, Human
caaaaattaacaaagaaaaaaagaaaatagcactaaaatggtagccctatactccaactgtaaaataattaaaattaaaagcattcagtagagaaaggaagcctatttcaacaagtggagacagaataactggatttccatacaggaaagataccagagactgactcctacacctcacaccataaacaattaattttaagaattaattaatggctcaaggaccttactgtaaaacttacaaccataaaggtcctaaaagaaaatgtaagataatatcttcatgaccctggggttaaaaaamaaaaaaaagatgtcctaaacaggacaaggcaaatactgaacataaaaaagataaatccactcctcttaagatactgtaaactctgtaaagcaaacaaataggcaagcaacagatcagaagaaaacattcacgacacatggatctgataaaggacttgtatccagaatgtataaagcagtcccacaactgaacaataaaaacaaacaaaaaaccaaaataacaggtaaaagactcgaagagctactttacaaacaaaatacgaatggccaataggcacatgaaaaaatgctgaacatcctt

SEQ ID NO: 177907 - DNA, 601 bp, Human
ctcccgagtagctgggactacaggcgcccgccactacgcccggctaattttttgtatatttagtagagacagggtttcaccgtgttagccaggatggtctcgatctcctgacctcgtgatccacccgtctcggcttcccaaagtgctgggattacaggcctgagccaccgcacccggccctcattatttctttttcttgcctggttaaaacctccagtatggtatcaacgttgtgagagtcaaatccttttctagttcctgatcttagaggaaaaagcgttgagttttcttttcttttttytttttttttttttttgagacgaagtctcactctgtcacccaggctggagtgcagtggcacgatctaggctctgcaagctccgcctcccgggttcacgccattctctcgcctcagcctcccgagtagctgggactataggcgcccgccaccatgcccggctaattttttgtttttgtatttttagtagagacggggtttcagcatgctagtcaggacagtctcgatctcctgacctcgtgatccgcccgcctaggcctcccaaagtgctggcattacaggcgtgagccaccgcgcccggca

SEQ ID NO: 177908 - DNA, 601 bp, Human
tttttagtagagatggggtttcaccatgttggccaggctggtgttgaactcctgacctcaggtgatccacccacctcggcctcccaaagtgctgggattacaggcatgagccactgtacccggccaacgcctggctatttttttaatattttaatagagacgaggtttcaccatctttgtcaggctggtctccaactccagacctcaggtgatctgcccacctcggcctcccaaagtgctgggattataggcgtgagacatcgggccactaatcattatttctttttctttttttttttttgagacacagtcttgctctgtcgcccaggctggagtgcagtggctcgatctcagctcactgcaagctccgccccctgagttcacgccattctcctgcctcagcctcccgagtagctgggactacaggcgcccgccactacgcccggctaattttttgtatatttagtagagacagggtttcaccgtgttagccaggatggtctcgatctcctgacctcgtgatccacccgtctcggcttcccaaagtgctgggattacaggcctgagccaccgcacccggccctcattatttctttttctt

SEQ ID NO: 177909 - DNA, 601 bp, Human
caagcaattctcctgcctcagcctcctgagtagctgggattagaggtgcccgtcaccacgcctggctgattttttgtatttttattagagttggggtttcaccatgttggccaggctggtcccagggaagccacctgcctcagcctcctaaaagtgctaggattacaggcatgagccaccacgcctggccccattaggacatgtatgtatagaatcatactggctgtgaatgtgttttatttcttcctttctaatcgttattttttttctttccttttttttttttttttttgacatggarttttgctcttgtcgcctaggctggagtgcaatgggacaatctcggctcactgcaacctctgcctcctgggttcaagtgattctcctgcctctgcctcctgagtagctgggactacaggcgttcaccactacccctggctaattcttttttttttgagacggagtttttgcttttgtcacccaggctggagtgcaatggtgcaatctcggctcactacaacctccgcctcccaggttcaagcgattctcctgcctaagcctcccaagtagctgggattacaggcgcccgccactacgcccg

SEQ ID NO: 177910 - DNA, 601 bp, Human
aagtgctgggattacaggcgtaagccaccacaccctgccggagtttcactcttgttgcccaggctggagtgcaatagcgcgatctcggctcactgcaacctctgcctcccaggtccaagcaattctcctgcctcagcctcctgagtagctgggattagaggtgcccgtcaccacgcctggctgattttttgtatttttattagagttggggtttcaccatgttggccaggctggtcccagggaagccacctgcctcagcctcctaaaagtgctaggattacaggcatgagccaccacgccyggccccattaggacatgtatgtatagaatcatactggctgtgaatgtgttttatttcttcctttctaatcgttattttttttctttccttttttttttttttttttgacatggaattttgctcttgtcgcctaggctggagtgcaatgggacaatctcggctcactgcaacctctgcctcctgggttcaagtgattctcctgcctctgcctcctgagtagctgggactacaggcgttcaccactacccctggctaattcttttttttttgagacggagtttttgcttttgtcacccaggc

SEQ ID NO: 177911 - DNA, 601 bp, Human
ataactatattgccctgtaacctgcaaccctgctatatttatttattagttttggtagctttttatggattttccattaggacttttttttttttttgagatagagtttcactctttttttttttttttgagacggaatctcgctctgttgcccggcgtggtgtgcaatggcatgatctcagctcactgcaacctccacctcctgggttcaagcaattcttctgtctcagcctcccaagtagctgggattacaggcgcccaccactacacccagctaattcttgtatttttagtagagacrgggtttcaccatgttaggttggtctcaaactcctgacctcaggtgatcggcctgcctcagcctcccgaagtgctgggattacaggcgtaagccaccacaccctgccggagtttcactcttgttgcccaggctggagtgcaatagcgcgatctcggctcactgcaacctctgcctcccaggtccaagcaattctcctgcctcagcctcctgagtagctgggattagaggtgcccgtcaccacgcctggctgattttttgtatttttattagagttggggtttcaccatgttggccaggctg

SEQ ID NO: 177912 - DNA, 601 bp, Human
caccacacctggctaattttgtacttctagtagagacggggtttcaccatgttggtcaggctggtcttgaactcccgacctcaggtgatccaccccccttggcctcctaaagtgctgggattacaggcgtgagccaccaagcctggcctacctagtactctgtgtattatgggaaatgtagagttgaggaaagtgctgggcacacagtaagagctcaacaaaggttagctctttctgcaattgttctatttcacttgttctatattattattctagagagaactgtgtgattgttagtgcrgatctgtggtactgctcccacccccactccattaatgcaagtacacctccttcagggatctattcagtcaacaggccaggaggtgctgtcctgaaatggggggcccaaagtctcaatcccacttggagggacacaggtctacagacaggtctccctgtctttatctctcaaatcttcagtagcaactaaaatctccgtgtttttcagagcaggaccttcccaggggtaccagcatcagtgggccaggatacaaatgtgccaggctgaactaggccttccaaatggccagggagccaagag

SEQ ID NO: 177913 - DNA, 601 bp, Human
caacctcctcccggattcaaatgattctcctgcctcagcctgctgagtagctaggactacaagcatgtgccaccacacctggctaattttgtacttctagtagagacggggtttcaccatgttggtcaggctggtcttgaactcccgacctcaggtgatccaccccccttggcctcctaaagtgctgggattacaggcgtgagccaccaagcctggcctacctagtactctgtgtattatgggaaatgtagagttgaggaaagtgctgggcacacagtaagagctcaacaaaggttagctstttctgcaattgttctatttcacttgttctatattattattctagagagaactgtgtgattgttagtgcggatctgtggtactgctcccacccccactccattaatgcaagtacacctccttcagggatctattcagtcaacaggccaggaggtgctgtcctgaaatggggggcccaaagtctcaatcccacttggagggacacaggtctacagacaggtctccctgtctttatctctcaaatcttcagtagcaactaaaatctccgtgtttttcagagcaggaccttcccaggggtacc

SEQ ID NO: 177914 - DNA, 601 bp, Human
aaacagctcctttaatggcaggctcttttctttttttattttattttattttattttattttattttattttattttgagacggagtctcagctcttattgcccaggctggagtacagtggcactatctccgcttactgcaacctcctcccggattcaaatgattctcctgcctcagcctgctgagtagctaggactacaagcatgtgccaccacacctggctaattttgtacttctagtagagacggggtttcaccatgttggtcaggctggtcttgaactcccgacctcaggtgatccrccccccttggcctcctaaagtgctgggattacaggcgtgagccaccaagcctggcctacctagtactctgtgtattatgggaaatgtagagttgaggaaagtgctgggcacacagtaagagctcaacaaaggttagctctttctgcaattgttctatttcacttgttctatattattattctagagagaactgtgtgattgttagtgcggatctgtggtactgctcccacccccactccattaatgcaagtacacctccttcagggatctattcagtcaacaggccaggaggtgctgtcc

SEQ ID NO: 177915 - DNA, 601 bp, Human
ttacattgtctgatacttttccttgtttattttatctgtttcctctaatagcatatacacttcctaagggcagggcagtgatctatcttgttgtcttgctgaccaaagtattagatcacaatgccttgcacctgcttgggctcaataaatgtgaataacacacaagcctgttatatgagaggttaagagagcgagaaagagcaaggggcagcccctgtgtggaccagcatcttgcacgaagttatgcaactatcatcgcaccttctcccagacaagctttcaaaggctttgccatgttttyttttgttttgtttttttgtttgttttttgagatggagtttggctcttttcgcccaggctggagtgcagtggtgcagtctaggctcactgcaacctctgccttctggtttcaagcaattctcctgcctcagcctcccgagtagctgggattacaggcccctgccaccatgcctggctgattttttgtatttttagtagagacagggtttcaccatgttggccaggctggtgtggaactcctgaccttgtgatccacctgcctcggcctctcaaagcgctgggattacaggtgtgagccact

SEQ ID NO: 177916 - DNA, 601 bp, Human
aaagctctagctagactggctgcccttctctgctaatcaactggtggttccttggctagccaggaacatgggggtaggctccttcccgtgcagactttaagtcatcctattttaattcacatcacctcatttgcattctcatagcacttacattgtctgatacttttccttgtttattttatctgtttcctctaatagcatatacacttcctaagggcagggcagtgatctatcttgttgtcttgctgaccaaagtattagatcacaatgccttgcacctgcttgggctcaataaatgtgrataacacacaagcctgttatatgagaggttaagagagcgagaaagagcaaggggcagcccctgtgtggaccagcatcttgcacgaagttatgcaactatcatcgcaccttctcccagacaagctttcaaaggctttgccatgtttttttttgttttgtttttttgtttgttttttgagatggagtttggctcttttcgcccaggctggagtgcagtggtgcagtctaggctcactgcaacctctgccttctggtttcaagcaattctcctgcctcagcctcccgagtagctgggattaca

SEQ ID NO: 177917 - DNA, 601 bp, Human
ctggcattctgggagcttcatctggacctgggtcttcagtgaaccattgttcaatatcgtccggggacagcatcaaatcatccattgcttgggacggcaagggggactgtagatgggtgaaaagagcagtcagaggaccaggtcctcagccccccagccccccagccctccaggtccccagcccaacccttgtccttaccagaacgttgttttcaggaagtctgaaagacaagagcagaaagtcagtcccatggaattttcgcttcccacaggtctctgctagggggctggggttggggtsggggtggtgggcctgcccttccaatggatccactcacagtttccataggtctgaaaatgtttcctgactcagagggggctcgacgctaggatctgactgcggctcctccatggcagtgacccggaaggcagtctggctgctgcaagaggaaaagtggggatccagcatgagacacttccaaccctgggtcacctgggcctgcagagaaggaaccccctcccccaacaccatgccagtgtctgagacagctcggcttcctgtggagcaggaaaagaatggctgcttcacattctctcttcc

SEQ ID NO: 177918 - DNA, 601 bp, Human
caaagctgttccgtcccagtagattaccactactcaggataggaaaagagaagcaagaggcagtaaggaaatcaggtcctacctgtcccatttaaaaaaccaggctccatctactcccaaccacccttgtcctttctggagcctaagctccagctccaggtaggtggaggagaagccacaggttaagaggtcccaaagccagagaaaagaaaactgagtgggagcagtaaggagattccccgccggggatgtgatgagaggtggatgggtagtagtatggaagaaatcggtaagaggtggrcccaggggtcagaggcaagcagaggctggggcacagcaggccagtgtgcagggtggcaagtggctcctgacctggagtcttccagtgtgatgatggtgaggatgggcctccggttcatgccgcccatgcaggaactgttacacatgtagttgtagtggatggtggtacagtcagagccaacctaggagataacacaggcccaagatgaggccagtgcgccttggggagacctgtggcaagcaggggaggccttttttttttttttttgagatggaatctcgctctgtcgcccaggctgga

SEQ ID NO: 177919 - DNA, 601 bp, Human
acaggcacaaacacgcacctcaaagctgttccgtcccagtagattaccactactcaggataggaaaagagaagcaagaggcagtaaggaaatcaggtcctacctgtcccatttaaaaaaccaggctccatctactcccaaccacccttgtcctttctggagcctaagctccagctccaggtaggtggaggagaagccacaggttaagaggtcccaaagccagagaaaagaaaactgagtgggagcagtaaggagattccccgccggggatgtgatgagaggtggatgggtagtagtatggmagaaatcggtaagaggtgggcccaggggtcagaggcaagcagaggctggggcacagcaggccagtgtgcagggtggcaagtggctcctgacctggagtcttccagtgtgatgatggtgaggatgggcctccggttcatgccgcccatgcaggaactgttacacatgtagttgtagtggatggtggtacagtcagagccaacctaggagataacacaggcccaagatgaggccagtgcgccttggggagacctgtggcaagcaggggaggccttttttttttttttttgagatggaatctc

SEQ ID NO: 177920 - DNA, 601 bp, Human
cgggcgtggtggctcacacctgtaatcccagcactttgggaggccgaggcggcgatcacatggtcagaagttcgagaccagcctggccaacatggtgaaaccctgtctctactaaaaatacaaaaattagccgggcgtggtagcaggcgcttgtagtcctagctattcgggaggctgaggcaggagaatcacttgaacccaggaggcagaggttgcagtgagccgagatcatgccactgcactccagcctgggcgacagagtgagactgagtctcaaaaaaataaaataaaataaaataaraataaataaataaaaattagccaggcatggtggtgcaggcctgtagttgaagcaacttgggaggctgagctgggaggatggatggagcctgggaggtggaggctgcagtgagctgtgactgcactactgcactctatccagcctgggtgacagagcaagaccttgtctcaaaaaagtaggctagagaccagcctgggcaacatagtgagactctatctatctacaaaaaattttaaaaattagctgggtatggtggtgtatgcctgtggtcctagctactggggaggcagagttaggggg

SEQ ID NO: 177921 - DNA, 601 bp, Human
ccactgtgcccggcccttttttaaattttagagatgatgtcttgctatgttgttcaggctggactcaaactcttgggctcaagagatcctcctgccttagcctctcaagtaactgggactacatgtgcatgcgactgtgcctcgtttcttttcttttttttctgagacggagtctcactctatcgcccaggctggagtgcagtggcgccatcttggctccctgcaacctccgcctcctggttcaagcgattctcctgcctcagcctcccaagtagctgggattacaggcacctgccatcaygcccggttaatttttgtattttagtagagacggggtttcaccatgttggctaggctggtcttgaactcctgacctcaggtgatccacccgcctcagcctcccgaaatgctgggattacaggcgtgagccagtgcgcctggccttttctttttttgagtctcgctctgcgcccaggctgtgcctggctcgactgtgcctcctttcatgcaaccatgctgtttctcactttcagtaacaatattcaataaatcacatgagatatacaacattttattactataaaaagggctttgtgttaga

SEQ ID NO: 177922 - DNA, 601 bp, Human
gcctgggcaacactgtgagaccccatctctacaaaacatgcaaaagttggctggccatggtggcatgaacctgtggtcccagctactccggaggctgaggcaggactgctcgagccggggaggcaaaggctgcagtaagccaagatcacgccactccactccagcctgggcaacaaagcgagacccagtctcaaagaaaaagaaaaaaaaaaaaaaaaaagaaaaaagaaattgaccctgagcataaaacaagtcttggtggatccagatcatcatatacaagagatgaaatcctccagggtgtgggatggggtgagatttccttttaggtactaaggttcaccaagaggttgtcagacagggtttggctgggccagcagagacttgacaactccctctacctaaccagctgcccaactgtagaaactaccaacccaccgaccaacagggagagggaacaagcaccctcaagggggtcaagttctagaccccatgtaataaaaggtggtttcaaggccagatgtacattatttcattaaccctcacaatgcactctgtgaggtaggtgcaaatgccagcatttcacagatatgggccttga

SEQ ID NO: 177923 - DNA, 601 bp, Human
agaactgggcccccgggagccagcggactgacagacagacagacagacagacagatgggtcagtgtcagacaggccggcgctgggccaaggcaaggctctcgccaagctagcggcagccgcagcaggtgctgagtcagcgtcaggcccagtcccacccccactcctgagggagagcccctaccctgtggtcaatttgctgctgccaagatcccccaccttcgcaaacacgctgccccttcagtacccctgctggtctccctctgtccctgccttttgatatatctctcccctccctcctcycccactccttcccccttctggttgagctgtagggtaggaattaagccatttaaataaatttcaataaattacactgaaagctcctggttataggaaacagaagggacccacaccagctttcccaggagtgaaagagaggtgggagagagcgtgcttggaggataagagagctggggccctgggaccctcttccttcctttcattctcctttcttccctctaatcctgccaagtgtaggaatgtttctgggaacggagatgtcattttcaaagatgaatgtctctctctccagagcctcag

SEQ ID NO: 177924 - DNA, 601 bp, Human
atagtgagagactgggagtacagtggagagaaggaatcttattgcaagacccctaaaagtctagttcttttttttttttttaaatagtgacagggtcttgctatgttggccaggctggtctggaactcctgacctcaggtgatccacccgcctcggcctcccaaagtgttgggattataggcatgagccactgtgcttggcccagagcctagttcttagccctcagccctcttccttgtcctccctttgctcccaggtcctacatggactcagaagttgtcctccccctcccccaaaaaggatttgtgctttccatgagctcctttctgcccagtgatgtgtctttttatctctctgtctttgtgcgcctttctgggtctttgtctccttagccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggagggtgggtatag

SEQ ID NO: 177925 - DNA, 601 bp, Human
ttctggccgggcctggtacctcggcctggacaaggagggccaggtcatgaagggaaaccgagttaagaagaccaaggcagctgcccactttctgcccaagctcctggagggtgggtatagactcaagaaaatgtgggccacaggagagggtattgaccttgatatggacatttaggggcagacagctcaggctacaagtgataagaggaccctttgtgacagatcaagccaggaaggctttgccctttgggggtttgggtgcggtcctcctgtggggttggggttcttggagggtgaatgyacgggaagggagcccttttggagcactggttctgcctgggtccctctgtgcctaactctccttcccctgctcctctctttctccccttcacagtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccc

SEQ ID NO: 177926 - DNA, 601 bp, Human; identical to SEQ ID NO: 22185

SEQ ID NO: 177927 - DNA, 601 bp, Human; identical to SEQ ID NO: 22186

SEQ ID NO: 177928 - DNA, 601 bp, Human
ctgtggcagccacaccgcaatcccgcccattcacccagagccgaagctccccagcaactgtgcgctccacgcccacgcggtccccttcaccaagctggtccaggtcctgaccatactcctccaacacagagcgtccatctctcagcacagagcagcccgacactacccacgagccccccttcaggcccgtggcactgcttggaaagtccagcacactggggtccagcgctgtcaccccaatctcaatggagccgctccaggagttgacctgggataggggtattggacagaggcttagaaygggccaccccccattccacaggccaccatatcttcccacctctcagacagctagctggctttctgtctcttggaacactaatccagagatgcagacagtgattttctggactccgtcttggtaattatttgggctttcctttagcaactctgctctctactcagtgtttactaaaccactcctttccaagccaagcacaaattccttggttccaacctcctgcctcctctaactttccttgtctctatggctctccaaccatccaaattctcctacttcctatacccacacctcttgctc

SEQ ID NO: 177929 - DNA, 601 bp, Human
gaaggctggggaccaggtgggatgggaggggaataagggttcagtccctgcttcacggcccatagccaggagaaccccccatcctctagctcctgctctcccattcaacagacttggggatcagggtggccctgcccacacccagcctgtcttgtcactctatttcccccattccgtccccaccccaccaccactgccctagctgtgttctcaccttcatctgcagaggtcccctgttcagccaaggcagagtcttcagtgggggccaagggctcgaggggaggtgtggggatgggagtakgggggctgaagcctggctcagggggtagcacggtgatctgggtgcacttgccataaaggtccacgacggcccagacacgagggggcaggcctgtggcagccacaccgcaatcccgcccattcacccagagccgaagctccccagcaactgtgcgctccacgcccacgcggtccccttcaccaagctggtccaggtcctgaccatactcctccaacacagagcgtccatctctcagcacagagcagcccgacactacccacgagccccccttcaggcccgtggcactgcttggaaagtcca

SEQ ID NO: 177930 - DNA, 601 bp, Human
ccaatttcaatggagccagcccatttgtccaccatcttgtcgatgcgcacctggaacacctctccatcccgcagggctctgctgctcagcaccacgccgtgattgaagtcatcggtggcactgagggcacagcaagtggagagtcagatccccaacacacgctctcaatgtgccaaggcttagcccagcaatgcctgccaacactcactgccccaagccaaagaactaaagctcaacctccaggaagctgcccccgccaggctccctctgccttccacttccttgccccgcccccccccccattagaatcccttcttcaggcttctccccaccccatgggccatactggggcctcagggcagtgcgtccctcgtgggtgatggctgccttctgcccacagttggggtggaagagcaggcgctcaggttctgcctgggcggcaggggcagcacggcggagagcaccctcgggggacagcgcccgcaggatggcgttgtttcggcggagacggtcactgtggttgttattgtggacgatggtcaccttcactgccatcccgtacaagtccaccacaccatacaccactgggggcgtcaagggg

SEQ ID NO: 177931 - DNA, 601 bp, Human
acaccaatttcaatggagccagcccatttgtccaccatcttgtcgatgcgcacctggaacacctctccatcccgcagggctctgctgctcagcaccacgccgtgattgaagtcatcggtggcactgagggcacagcaagtggagagtcagatccccaacacacgctctcaatgtgccaaggcttagcccagcaatgcctgccaacactcactgccccaagccaaagaactaaagctcaacctccaggaagctgcccccgccaggctccctctgccttccacttccttgccccgcccccccycccattagaatcccttcttcaggcttctccccaccccatgggccatactggggcctcagggcagtgcgtccctcgtgggtgatggctgccttctgcccacagttggggtggaagagcaggcgctcaggttctgcctgggcggcaggggcagcacggcggagagcaccctcgggggacagcgcccgcaggatggcgttgtttcggcggagacggtcactgtggttgttattgtggacgatggtcaccttcactgccatcccgtacaagtccaccacaccatacaccactgggggcgtcaag

SEQ ID NO: 177932 - DNA, 601 bp, Human
caggacttcccagaattcaaggggaggggacaggtagatcccctaggtctgtcactacccacagccaccataggcccaaaccttgcttccctgatcccagccagctccactcagccccaagctggtccccaaagcaggaagcccaacctcagcatccatgtgtcatagtcaatgtctgtcatggtgttggggaattccaggtcttcaggccgaatagcagtcactcctgggaggaggcaggggtaagtcaaggccgatccccaaggcacagacatccaacagcccccaacacacacagacrgccctcaccagcctcaatggagcctgaccagcggtccaccatcttctgaatgacaatttcaaacagctctccatcccgcagggccctgccaggagactggcgatcagagaggctctacttgcatggctgaggctgggcaggaggaaggtggggacatgaaagttgagagactgaccggttggagatgacgatggcgtcattaaactcgctgcgacagttgtggcggagggcggtgcggcccccgttagtgatgactgcgttactgccgtgcagctgatggaagcgcaggtcagagccccc

SEQ ID NO: 177933 - DNA, 601 bp, Human
agtgacgttcttgccgcaagtactgtggaatcggtgagccacgccagccactgtgaagagatggcaccagtagaaggggtaggattggggcagcgagcttcaggcagaacacagagcaaagctttcagatgaaacgaaatggggacgccaacgccccatctgccatctgccattacacctcagggcctcctgacacctctttattgtattttgttgaggcagagtctcgctctgtcactcaggctggagtgcaggggcacagtcgtggctcactgcagcctcgacttcctgggatccagckatcctcccacctcagcctctcaagtagctgggaccacaggtgcatgccaccacacctgcctacattttgtatttttggtacagacggggtttcgccatgtttcccaggctggtctcaaactcttgtgctcgagagatccacctgccttgaactcccaaagtgctgggattacaggcgtgagctactgcgcccggccctgatacctcttttcaccacagcaaggcccatttccaaacctggcatgctcagcttatggtgtcctggccccttggtggcagggaagtgtccaggctctaagta

SEQ ID NO: 177934 - DNA, 601 bp, Human
agagatcagcagaagacctcaaccatcctcccagaacccaaggaagcgttcaggtctaccttggcaatgccagtggctgcaggccccatatcctctccatccaccaggatgtgcatcgtgtcatctgccccccgacgaacacccacacggctccccacctaggaccgaggtaggacaaggacggacgatgttcagcccacctctccctgccacctccactcccaacccctcccctgtccctggagccagccacttcacccccagcctctctaggttccggccatagttcatcctctggagstgcccatcacgcctcacttcacagctggataccatccaagtggtcttcgtccggagctctggcagggaaggaggcagccctgggccaccaccgcctgccccgggtcccatctcccccggtgctagtgtggtcagccccagccgcagggaacctgcccacttctcatctagctcttccactttcacctacgagacagagaaaacataagctggccctgtcgtgatggggctcgcagcccctctgtcacatcactacggcctacctcaaagacttcctcagccctcagctccttggtactga

SEQ ID NO: 177935 - DNA, 601 bp, Human; identical to SEQ ID NO: 177928

SEQ ID NO: 177936 - DNA, 601 bp, Human; identical to SEQ ID NO: 177929

SEQ ID NO: 177937 - DNA, 601 bp, Human; identical to SEQ ID NO: 177930

SEQ ID NO: 177938 - DNA, 601 bp, Human; identical to SEQ ID NO: 177931

SEQ ID NO: 177939 - DNA, 601 bp, Human; identical to SEQ ID NO: 177932

SEQ ID NO: 177940 - DNA, 601 bp, Human; identical to SEQ ID NO: 177933

SEQ ID NO: 177941 - DNA, 601 bp, Human; identical to SEQ ID NO: 177934

SEQ ID NO: 177942 - DNA, 601 bp, Human
aatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaaggtgagtagaattagggaatgagagtgagaaatctgcattaaagacgggcatgaggaggggaggaatggagactggactggagaatggggcaagaagcaagaaagcccagggaagctagtgggtaggtagacaggcctgtgtgsggcctggaataggggctggaggagcacctacttcaccaaagcccctctcccgcagcaagtggaacagaagtcatcagcaactctgcttctgacctggggcctggaggatgtggagcatgtgttctctgaggaggattaccacacgctcaccaactacaaagccttcagccagttcatgaggtgcggtaagactggggaatcctcgctaattgacacttttaatttgagggaggtcctggaccccttggaatctgatgaaagctatgaaactgctctccagagaattcacggtgtatacac

SEQ ID NO: 177943 - DNA, 601 bp, Human
aaggcactttaacatatcagttcagtgctctggaggcagctgctgaggttcacatctggttacattttgggcaagtgactgaacttcttcaatcctcaatttcctcttctataaacggggaataataatatatacctcataggaatctgtgtgggtttggtgggataatgaatggaaagcacagtaccgtcagtgcctggctcctagggagcattcagtaactggtgactgtcattagtaacgttgtctcacctaccttactgctgaacttggggcttttctcagcaccatggatcacccrtgtccgcacaagagttgagcaccccaccccagagcagaaccagcatggtctgactctttcacactccgtcctacggaagcccatcttcagggcccatggaacttactagtaaaatgcagagaatcatagcaactcaagagtattattgtgaggacaagataaggtggaatgtatgtgaaagggttttatgaactgtaaagtagtatacaaaagtaaagcatttttgttgattttattttaaccttttatgcttttaagttttatttcgctgttttttatttccccttttttttttttttt

SEQ ID NO: 177944 - DNA, 601 bp, Human
attattgtgaggacaagataaggtggaatgtatgtgaaagggttttatgaactgtaaagtagtatacaaaagtaaagcatttttgttgattttattttaaccttttatgcttttaagttttatttcgctgttttttatttccccttttttttttttttttttgagatggaatctcactctgtcgccaggctggagtgtagtggcgcaatcttggctcactgcaacctctgcctcccaggttcaagcaatttttctgcctcagcctcccgagtagctgagactacaggtgcgcaccactacrcccagctaatttttgtatttttagtagagacggggtttcgccatgttggccaggatggtctccatctcttgacctcgtgatcctcccaccttggcctcccaaagtactgggattacaggcgtgagccactgcgcccagcctatttccctttttttaaagacagggtctcattctgtcacccaggctgcactgcagtggtgtgatcatagctcactatatcctccaactcctgggctcaagccaccctcctgcctcagcctcaggtgctgccacacccagctaattatttttttttatttt

SEQ ID NO: 177945 - DNA, 601 bp, Human
gcgtttctcaggccttctttctgtttgtgatctgtgcaatattttcctcctgctcctccccatggcctcctgccccacagtgtggataaaaaggggaattaccactatctagtaaaatggagggacttaccatatgaccagtccacgtgggaggaagatgaaatgaatatccctgaatacgaagaacataagcaaagctactggagacaccggtgagggaatgagcttgtggattcaagggattctgacgatgagggcatgaaagccaaaactccagcataaaatgagggtacagtagggmctgattcaacctggagttcagggcaatggccacctgagctgggttgtttgagataggcttgctaaagaggtagtgtaaggaacagaaacaagatctggctgagtagtggagaagaggatgttcaagagtggggagggctggctcttgaggtgaaatccaaagggcaagggtaaagagcctgggaaaaaggaaatatgggaaaatctaggtcatggacagtgggaagtaggtctggaatgggttcagaaaagaaagcgtaggactcccaaggatgaggcctcattcagacccactcttttt

SEQ ID NO: 177946 - DNA, 601 bp, Human
gctgggttgtttgagataggcttgctaaagaggtagtgtaaggaacagaaacaagatctggctgagtagtggagaagaggatgttcaagagtggggagggctggctcttgaggtgaaatccaaagggcaagggtaaagagcctgggaaaaaggaaatatgggaaaatctaggtcatggacagtgggaagtaggtctggaatgggttcagaaaagaaagcgtaggactcccaaggatgaggcctcattcagacccactctttttccagagaactaattatgggggaagaccctgcccagccmcgcaagtataagaagaagaagaaggagctacagggtgatgggcctcccagttctcccactaatgatgtgagtcctctcagttgtcatttcttgtttctggagtgatggtgatcgaagattttccaagggctactgatggaacttcccagagattcagtaacctctgtgaacagtagctcttccttcagcatccagtcttgccccaagagtggctaagaattttggcctgaaagggcaggagccactagagatagcccactggtggctctgtcaccagctggcccttccccatggtgctgc

SEQ ID NO: 177947 - DNA, 601 bp, Human
ttgtcttaaggaatgagggggaggggctgaagactagatgtgagaacttttgtaaactcaggccatagtagagggaattgtaatccaacttggtatccatgccagggaggaagagactaagactggaggagccgccgactatttccttgagctttctgacttcttgtctctatagcctaccgtgaaatatgagactcagccacggtttatcacagccactggaggcaccctgcacatgtatcagttggaagggctgaactggctacgcttctcctgggcccagggcactgacaccattctmgctgatgagatggggctaggcaagaccatacaaaccatcgtcttcctctactcactctacaaggaggtgctggattctaggaccttgaaggggaccgcctggactggggaagtggggagggggaagataaaggggtgtagctggcagaggactagggtatacggcctctagcctagacttatgctgcccccattcttgactcccagggccacacaaaaggtcccttcctggtgagtgccccactctctaccatcattaactgggagcgggagttccagatgtgggcacccaaattctatg

SEQ ID NO: 177948 - DNA, 601 bp, Human
gtatgagctgatcaccattgatcaggcagcacttggttccatccgctgggcctgtcttgtggtagatgaggcccatcgactcaagaacaaccagtccaaggtgagtgaggtttccagacctaaaaaacttgaagttgtggacttcccacttgccttggtcctaaaaaacaacaaaaattctggggattttctgtagtctgggaggacgtccaggttggaagagggagagggccagagatttggggcctctgatcctgagtgaaatgggagctggggcagggaaaggctgatgctgtgggtyggtcacttgtcactaataagcccattttcctgccttgccttgccccatcttttagtttttcagggttctcaatggttacaagatagatcataagttgctgctgacaggaaccccattgcagaataatctggaggagctcttccatctcctgaacttcctcaccccagagagatttaagtaagtggttccctaagggtagttggcagagatgagaggtggagcagataaaatgagctggtagaggattaatctgaggtggtaagtctgagatcaggggcaaggaacttgccgacctgttaa

SEQ ID NO: 177949 - DNA, 601 bp, Human
acctgacctcaggtgatctgcccgcctcggtctcccaaagtgctgggattactgtatagcaagttcattcttggcctctgatgcctgttcttaaggttgctggaagttgaggtccagctctagttccttttcagctgcatgagggaagggggagggtgagccatctgcctccttagggactggtattatttcttcatcttattggcaggtgagggtgaagggcacagaccctttggaaatgtgatgaaagctctgggtctactcaccagaaaactgcacatacaatgacacaattttgtayggattttcagggggttcctggatttccctgaaaccttttcatgggtctcagagaacctctgccttaggagaaacaatcttaaatcaagagagtgtgacaagagggccagacgtggtggctcacacctgtaatcccagcactttgggaggccgaggcaggaagatcacttgaggtcaggagtttcaagaccagcctggccaacatggtgaaaccctgtctctacttaaaatacaaaaattagctgggcgtggtggcgcacacctgtagtcccagctactagggaggctgaggcggtaggat

SEQ ID NO: 177950 - DNA, 601 bp, Human
cactttgggaggccgaggcaggaagatcacttgaggtcaggagtttcaagaccagcctggccaacatggtgaaaccctgtctctacttaaaatacaaaaattagctgggcgtggtggcgcacacctgtagtcccagctactagggaggctgaggcggtaggatcacttgaacccaggagtggaggttgcagtgagcagagatggcaccactgcactccagctagggcaacagaatgagactccatctcaaaaaaaaataaaaataaataaaaataagaaaagagagtgtgacaagaaggtrgaataatgaggagcttaagacagggcaggggttcaggtgtaaagattagggttgagtttgtgtaaaggagtagttagaataagcaagcatcccaccacctcattattgcagactccatccttttctcttgctctagatgaccaaaatgttagacttgcttgaggacttcttagactatgaaggctacaagtatgagcgcatcgatggtggtatcacgggtgccctgaggcaggaggccatcgatcggtttaatggtgagggagatacactggtccctggtgggtgtgggaggcctgagaa

SEQ ID NO: 177951 - DNA, 601 bp, Human
ttgctagatggggaagaggcagggtaggtcatcctaggttttccctgctcctagtgtgaaacggcatgatgtgtttgaaaattcatctttgtagttgcacataactaatgcctcagatatatttgttgcctttatttaatgtagctgcacagtacgcccattgacttctaagccagagagggactaatgttgggactgtagctcctacagtgctttcgggtccctccgccaaaaggttggaacttcacgttctcagaagtcccagggttctttagagggaaaacgagaagataatccctgrggtcctctcagccttccaaatggagcttagctctttcaccccagtccttactttcctgctgcgtacacttcggcggtgtcaaacaggtttacaccatgctcataggctacagtcagcacatcctctgctgtctagggaggtgaaagaggtaaagatcaactactgctcctcagttacctccctcactgtactctaacccatcacatctcagccctgggttctctagtctctcccctctccccatcctccagcctcagatccctcattccctgtgcttgttgtccaaacccctatccaggt

SEQ ID NO: 177952 - DNA, 601 bp, Human
gcgtggtggctcatgcctgtaatcccagcactttgggaggccgaggtgggcggatcacctgaggtcaggagtttgagaccagcctggctaacgtggtgaaaccccatttctactaaaaatacaaaaaattagccaggcgtggtggcgtgtgcctgtaatcccagttactcgagacgctgaggtaggagaatcccttgaacccgggaggaggaggttgcagtgagccgagatcgtgccattacactccagcctggacaacaagagtgaaactccgtctcaaaaaaaaaaaaaaaaaaaaaaraaattcagaccttgcccccttgccatggccacctaaatccctattcaaagcctccagaagttcagagaatgttccctactcctctggcttccatatcccctcactttgggtttccagcccctaactctcaccctcaatgatgtgctttcggcttaaacctcgctcggtttctgccctgtaggaaaaggtaagtcaaagatgagatgtgacaaagataggggaccggggctggcttggagccataaggaaatgggattgcacgagtcttcacaggcatggtgcggacctggtgcaggatag

SEQ ID NO: 177953 - DNA, 601 bp, Human
agatggtgctccgcttgttcacacactggaggaatcagattgaactgtctggccatggagtaggcctcctgggttggggttggggaaaagaaagtggtcagagcactacttccgttttcttctctgccttctcccccagtgcagtgggctttggagtaaccacgtgaaaagtgggaaccagttgtgggacaggggcaaggtggggtcacacactcaccatgatttctgcagccccccatcgggatgtcccccagtatagggccaggccctggttgatgacataggtcatggctcgcacaatctctaggtacacaggagagggaaagccttactgtcagagccctggaatctaagactccagatttgcagacctccacctgccccaccaaggccccaggcaactctatggagtcatgaaagttaatatctactctttgcctctcttcctgtccacatcctggagtctcagcctccactgtggagttttggaggccttctgagcaggggctggcttcctgctgagggtttgaggaagtgctcaatttttgtattttagattttttgagacagggtctcactctgtcactcaggatgtagttca

SEQ ID NO: 177954 - DNA, 601 bp, Human
catcttcactctgcactttgtccttgagccactggtagccctggaggccaagaagaatcaacagaagaccccgccatcaccaccaccaccaccacactcacaaagcagccccccgtaactccccccaaagcagcccatatagcccagtcctgccatcgagagcccccagatctcaccttgatggaggccctgcaagtatctgggactcgcccatcatacttgctagtaatgagaccacaggctagagggtaccaagtgactgatccaactcctaagggaagaacactgggtgtcaggaaaaggacctagccatggatgaggctaaggtaaaggcagggatgagggctgcaaaccaatcttgtggtagagctctggcagctgcatctccaccttctccctctgaaacagatggtgctccgcttgttcacacactggaggaatcagattgaactgtctggccatggagtaggcctcctgggttggggttggggaaaagaaagtggtcagagcactacttccgttttcttctctgccttctcccccagtgcagtgggctttggagtaaccacgtgaaaagtgggaaccagttgtgggacagggg

SEQ ID NO: 177955 - DNA, 601 bp, Human
ttgaaaggctctttagtcaggctacttgcaatgggagagttgcgccagcaaagacagctggggatgtatgggggagttggagtggggatctgggtggggtcagtggatggaaagtgattaagggaaggctccaagggtaggggcttctccctaagctgacctagcaggcttctccagaaaggcaggttgaaggcctagccggcaacggtctgtcggggaggaggagctgatgagatgtggagctgggggtagccagcagcaggcggaagtggacgggtagggtccaggcccagtggagagkagaggcggaggggcctgcagagcattggtcagggagggtctgtgtagtttctggggaggcatctgtgtctgttgttgacaaggctaaaaatgatgactctggactctctaactggactgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacg

SEQ ID NO: 177956 - DNA, 601 bp, Human
ctgttgttgacaaggctaaaaatgatgactctggactctctaactggactgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcstgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggca

SEQ ID NO: 177957 - DNA, 601 bp, Human
agtttagcagggtccctttgcacagatttctctggtttcggctttcccgcccttggtaagaacatggctttcctcctggcctagggcagtcctctctggcatggtggctgtgccttctgctcttaggaaggccgagggtcacagcaattcttacacctgcccttttttaagtgccttcagctcaaaataatccaaggtggcacattctgggtgacgtattttgatcccctgcccctcctgaggagggtctctggggtgggtgcagtttcagcgagcacaactggactctaggcaggaggtrgggggatcgctgatcccaaatcctgcggtttgtgtgtcccacagttgaagctggaggaggacatggagtaccttcgggagcagatcaccaggacagggaatctgcaggccagggaggagcagagcttagccgagtggcaggtgggtgcccagggctgtccagtccctttcctgctgctgctccatcttcctgcatttccacgtctgtgtctgcccgtggggatatgctgccgcagtggcaggaaaagaagaaagttgcctctacccttctaggttctgtggctggcctcagaatgaaact

SEQ ID NO: 177958 - DNA, 601 bp, Human
cctggtgatcccacggcacactcactgctctccatgtcggcctgggcagcagccagccgcttcaccaggctctcctcggtttcagtgttgcgctgccgcagccgctgctcctaaaaagggggtggcaatcagagcctggcatgccctggcccccagcccccaaccctgcccagcacacaccagcacgtgcagtgaaggcggctgcacagagatgtagatgggccgcagatcggtggccttgatgttccgcacaccctgcaggtccacgtccagcacacagatgcggttcatggcctgcacrgcctgcaccgccaccttgctggggagaggtgccaggtcagcaggggtgccagggctctctgaggcctacaggagcttcagggacacccaggccctcccgggcccagcgttctcctcccacagctgagcctaggcctggcctggacccagcacccgacagcatctcaaacctgctacccccacgccctgccccgcctacagggaacagaggccacccactccccaaggtgcctgtagtgagcatgaggtgtcctgtgcacccttcaccctgccaggacaatgcacggtggcaggaccgggc

SEQ ID NO: 177959 - DNA, 344 bp, Human
cagagcagcccactggcctgcggctgtcctcactgcggctgtgrgacagctttccagcccagccgggcctgtgcagggtagggaagggccgccccctgggcctcagtcctcaggcaccactcctgctctctctggagccccagaacttgggtctggacaccagcacccatcaggactctggttaggggctacactatcctctacacacacagcagaacattaaatgccctcttcttgtgggctgcagtcagacccagagaagaggcaacagctgtaagaggatgcacatgacacccccggggctagaaggttggggacatctcatgggaccctgggcgatgggg

SEQ ID NO: 177960 - DNA, 601 bp, Human
tgaagtggtatctgccacaggacttttctgtgttgttgttcaaagcaaagtacttgttgctgtctccgaatttagttaaataatagttataaagagggccagctgctaagaaaccacgtagatttttttcattccctttgttttcaaaatgtcagttatgatttagcatcacagtatctgaataccagagtttactcagtaatttctttcttcatggaaaagttcttaatataatccttggatcagggaaactaggtgaagttctgttggatcaccaactgttccacttaaacagtgattycaggggctgtaaagcataaatgtaaaagtctccctaccctccaggggttgacagatgatgacacactttgtgtaagacacaatccattctgtattttgtcttagaaaaaaaggttaaaagtgtgtttgttggtggtggtatttgtgtttaatcaaacaagtagaaaatagcctaaaattaaggtttatcagaaatatgcttcagacagaattgttatgcatgagaggtcagacattgctatggaggacaaagcagttagggtgatcttaattaaaatcagggtattaaacgtagaaggag

SEQ ID NO: 177961 - DNA, 601 bp, Human
gattttgttaaaatgcaaatcagatcatgttgccttcttttttaaaatccttaatggcttcccattgcacttggaatgaaatctaaacttcccatggcctgaaaagctctttgtgatctggtttctgcttacctctatgacctcaacttgtaccacccaccacccctttctcactatattcaagccacactgccatctttctgctctgtgacactcattcccacctcctagcctttgaactagctgttctgatgttgcccagggctggctcctttccatcacagaggctctaagtttcacwtctttagagaggcctctctgaccaccttattctagggtacttacctgttactatttgctggtttgccgtttacttccttattgtaatttctatatggtttttcttctcttttttttcctccatcagaatctgggacagacaaatcatctgtcttgtttatagaagtattcctagtgcttaacacagtggatatggtagatgctaaaaatatttgttaaatggcagtgaggcataggcatgtcttgacaacagtttgttaggagtttgcaatatgtagttatgatttagcatggtatagta

SEQ ID NO: 177962 - DNA, 601 bp, Human
tttttgagttatatcttttatctgagaatttgaattatttgtgtaagacatacatctcatgtgtacctcaaccttggaaagatttttaatcttgctctctaagaccacagatgtcattttaaaagggagagtaaaatggtaagctttggcatataatttattatagattagtctttagccccatcgaagacggtataattattagaagaactagaagcatctcctgaggtctcaagtgtcatatggctctgagacttgacccctaaggctggtgatattaagccttcatgtatcttgaatgatattccttttttccttttccactcttactttgctaagtcgtttgacattagcagtgccctagagtccagacaaaagtctttggaatttttgctgccgtaagaaagcagaggtcagttggctccgttcaccatagtgcataaattgagaaattgtggttgtctcctgggatctttatatctttgcctttaaacccctttgtttattcattatcttttttctttcttttccttttttttttttttgagacagagtctcgttttgtcgcccaggctggaatgcagtggtgcaacctcggctc

SEQ ID NO: 177963 - DNA, 601 bp, Human
ccatcgaagacggtataattattagaagaactagaagcatctcctgaggtctcaagtgtcatatggctctgagacttgacccctaaggctggtgatattaagccttcatgtatcttgaatgatattccttttttccttttccactcttactttgctaagtcgtttgacattagcagtgccctagagtccagacaaaagtctttggaatttttgctgccgtaagaaagcagaggtcagttggctccgttcaccatagtgcataaattgagaaattgtggttgtctcctgggatctttatatmtttgcctttaaacccctttgtttattcattatcttttttctttcttttccttttttttttttttgagacagagtctcgttttgtcgcccaggctggaatgcagtggtgcaacctcggctcacagcaacctctgtctcccaggttcagtgattctcctgcctcagcctcccaagtaactgggattacaggcataagccaccacgcccaactaattttttttttttttttttttctgaggcagagtttcactcctgttgcccaggctggagtgcagtcgcgccatctcggctcattgcagcc

SEQ ID NO: 177964 - DNA, 601 bp, Human
ctgccgtaagaaagcagaggtcagttggctccgttcaccatagtgcataaattgagaaattgtggttgtctcctgggatctttatatctttgcctttaaacccctttgtttattcattatcttttttctttcttttccttttttttttttttgagacagagtctcgttttgtcgcccaggctggaatgcagtggtgcaacctcggctcacagcaacctctgtctcccaggttcagtgattctcctgcctcagcctcccaagtaactgggattacaggcataagccaccacgcccaactaattttttttttttttttttttctgaggcagagtttcactcctgttgcccaggctggagtgcagtcgcgccatctcggctcattgcagcctcttcctcccacgttcaagcgattcttctgcctcagcctgccgagtagctgggattacaggtgcctgccaccacgcctggctaatttttttgtatttttagtagtgatggaattttgccatgtcgggcaggctggtctccaactcctgacctcaggtgatccacccaaagtgctgggattacaggcgtgagccaccgtgccctgcccaaattt

SEQ ID NO: 177965 - DNA, 601 bp, Human
gttcaccatagtgcataaattgagaaattgtggttgtctcctgggatctttatatctttgcctttaaacccctttgtttattcattatcttttttctttcttttccttttttttttttttgagacagagtctcgttttgtcgcccaggctggaatgcagtggtgcaacctcggctcacagcaacctctgtctcccaggttcagtgattctcctgcctcagcctcccaagtaactgggattacaggcataagccaccacgcccaactaattttttttttttttttttttctgaggcagagtktcactcctgttgcccaggctggagtgcagtcgcgccatctcggctcattgcagcctcttcctcccacgttcaagcgattcttctgcctcagcctgccgagtagctgggattacaggtgcctgccaccacgcctggctaatttttttgtatttttagtagtgatggaattttgccatgtcgggcaggctggtctccaactcctgacctcaggtgatccacccaaagtgctgggattacaggcgtgagccaccgtgccctgcccaaattttttttcttttttttctttctttctttcttttt

SEQ ID NO: 177966 - DNA, 601 bp, Human
catagtgcataaattgagaaattgtggttgtctcctgggatctttatatctttgcctttaaacccctttgtttattcattatcttttttctttcttttccttttttttttttttgagacagagtctcgttttgtcgcccaggctggaatgcagtggtgcaacctcggctcacagcaacctctgtctcccaggttcagtgattctcctgcctcagcctcccaagtaactgggattacaggcataagccaccacgcccaactaattttttttttttttttttttctgaggcagagtttcactyctgttgcccaggctggagtgcagtcgcgccatctcggctcattgcagcctcttcctcccacgttcaagcgattcttctgcctcagcctgccgagtagctgggattacaggtgcctgccaccacgcctggctaatttttttgtatttttagtagtgatggaattttgccatgtcgggcaggctggtctccaactcctgacctcaggtgatccacccaaagtgctgggattacaggcgtgagccaccgtgccctgcccaaattttttttcttttttttctttctttctttcttttttttttt

SEQ ID NO: 177967 - DNA, 601 bp, Human
ggccaggctggtcttgaactcctgacttcaggtgatccgcctgccacagcctcccaaagagttgggattacaggtatgagccaccatgtcagctgatgtggttcttgtaggttcttctcactcatacctctcccgctatcaagagcacaagcatgaatccattatactgagtgataccatactgggctcagaatggttccttgcccctcattacacattacatgtggaagaagccactaagccttgactttcttcctttgagatgagttcttctctggaggctgtgcaggtccttttgccattagactcctggcatgcttgccttacagaatgtccaaacaggcccaggcatccaaaccaaagtctcctcccttgtacctcttcttggctcctctgccccattgacagaggttctgtagccatgttgtctgccacaagttggaggtctagcacttgtctgttaactcttgggaactttgagtcttgatcattttcagctattaggaatttaattctttttttttcttcagtgactgcaaatttagaagaactgcagtgaggcttgctgaaccttgcacactaatgaaattggtgaatggat

SEQ ID NO: 177968 - DNA, 601 bp, Human
catacctctcccgctatcaagagcacaagcatgaatccattatactgagtgataccatactgggctcagaatggttccttgcccctcattacacattacatgtggaagaagccactaagccttgactttcttcctttgagatgagttcttctctggaggctgtgcaggtccttttgccattagactcctggcatgcttgccttacagaatgtccaaacaggcccaggcatccaaaccaaagtctcctcccttgtacctcttcttggctcctctgccccattgacagaggttctgtagccaygttgtctgccacaagttggaggtctagcacttgtctgttaactcttgggaactttgagtcttgatcattttcagctattaggaatttaattctttttttttcttcagtgactgcaaatttagaagaactgcagtgaggcttgctgaaccttgcacactaatgaaattggtgaatggattaataatgaacagaggtgatgctaatttgtaatcaggttgaataatatggatttaagaccagaaaatgggccgggtgccgtggctcgcgcctgtaatcccagcactttgggaggctgaggtg

SEQ ID NO: 177969 - DNA, 601 bp, Human
tgattgtgggatgctgccctgtactctctagggactactacataatatatagtataggtattgtattaattttttaaaatctgaaaaattctatattctgaaatacacctggccttaagacttttcgattagcttgttggcttgtacaatatcttatctcagaaatttccttctactcttgtaagtactaagaactacaaaatattgcctgggcaacatggcaaaactgcatctttgggaagattgcttaggagtggaggctgaagtaagccatgtttatgccactgcactccagcctggrcaacagagggagaccctgtcccaaaaacaaaaacaaacaaaaaaaatacaaaatacagtttagttatttattttttcatttttagaaatgtggtctcactatgatgatcaggctggagtgcagtggctggcaattcacaagtatggtcaaagttccctgtagcctcaaacttttgggctcaggtgatcctcctgtctcagtctccaagtacctgggactacaggtgtgtgccaccaaaccccagctctttttagttctttttttgagatgagtctagctctgttgcccaggttagagtgc

SEQ ID NO: 177970 - DNA, 601 bp, Human
aacagagggagaccctgtcccaaaaacaaaaacaaacaaaaaaaatacaaaatacagtttagttatttattttttcatttttagaaatgtggtctcactatgatgatcaggctggagtgcagtggctggcaattcacaagtatggtcaaagttccctgtagcctcaaacttttgggctcaggtgatcctcctgtctcagtctccaagtacctgggactacaggtgtgtgccaccaaaccccagctctttttagttctttttttgagatgagtctagctctgttgcccaggttagagtgcartggtgcgacctcagctcatcacaacctctgcttcctgggttcaagcaattctcttgccacagcctcctgagtagctgggattacaggcatgcactgccatacctggctaatttttgtagagatggggtttcgccatgttgaccaggctggtctcgagctcctgacctcaggtgacccgcctgccttggcctcccaaagtcattttagttctttaaatgttttggtccacaaagctagtgtgctttccacttaagagctttcattgaaactcctttagaaatttatgctactttggactca

SEQ ID NO: 177971 - DNA, 601 bp, Human
ccaccaaaccccagctctttttagttctttttttgagatgagtctagctctgttgcccaggttagagtgcaatggtgcgacctcagctcatcacaacctctgcttcctgggttcaagcaattctcttgccacagcctcctgagtagctgggattacaggcatgcactgccatacctggctaatttttgtagagatggggtttcgccatgttgaccaggctggtctcgagctcctgacctcaggtgacccgcctgccttggcctcccaaagtcattttagttctttaaatgttttggtccayaaagctagtgtgctttccacttaagagctttcattgaaactcctttagaaatttatgctactttggactcagcctgtcttttattcaaggaattctaaatctgtgaactggcacacgtttgggaattgattgaagggtcctgactttctgtttttatgattcacattagactttttgttcacttgacctagaacttttctgtttatatagatcaagtaagaatttagtaggtttcctatctatttcacttgtaggaataccgtgaccagctgatcaatgccatagatctgtgagagtcag

SEQ ID NO: 177972 - DNA, 601 bp, Human
gcaattctcttgccacagcctcctgagtagctgggattacaggcatgcactgccatacctggctaatttttgtagagatggggtttcgccatgttgaccaggctggtctcgagctcctgacctcaggtgacccgcctgccttggcctcccaaagtcattttagttctttaaatgttttggtccacaaagctagtgtgctttccacttaagagctttcattgaaactcctttagaaatttatgctactttggactcagcctgtcttttattcaaggaattctaaatctgtgaactggcacamgtttgggaattgattgaagggtcctgactttctgtttttatgattcacattagactttttgttcacttgacctagaacttttctgtttatatagatcaagtaagaatttagtaggtttcctatctatttcacttgtaggaataccgtgaccagctgatcaatgccatagatctgtgagagtcagacttccagctgtgccttgactctgctgtccatcatggtaatcatgcctaccttgcttttagcagttcagtgctgccatttggcccctgtcatcccatgatccaattattcccactg

SEQ ID NO: 177973 - DNA, 601 bp, Human
agtcctaggtacctgaaaggctgaggcaggaagattgtttgagcccaagagttcaaggctgcagtgagctatgattgagccactgcactctagcctgcaacagagcaagaccctgtttaaaaaaaaaaaaagatatgtcctctggacactcacaggtgagtaagtagatcttaaaagataaatgcactgtaggccgggtgcggtggctcacgcctgtaatcccagcactttgggaggccaaggcggacggatcatgaggtcaggagatcaagaccatcctggcttacatggtgaaaccccstctctactaaaaatacaaaaaattagccaggcatggtggcgggcacctgtagtcccagctactcgggaggctgaggcaggagaatggcgtgaacccaggaggcagagcttgcaacgagccaagattgcgccactgcactccagcctgggtgacagagcgagactccatctcaaaaaaaaaaaaagataaacccactgtaacactccagtctccctaggcctttgaatgccttcctccatagtaagccgaggcaggcctggcatttcaagttcatttactgagggccacattttggtccat

SEQ ID NO: 177974 - DNA, 601 bp, Human
actgcactctagcctgcaacagagcaagaccctgtttaaaaaaaaaaaaagatatgtcctctggacactcacaggtgagtaagtagatcttaaaagataaatgcactgtaggccgggtgcggtggctcacgcctgtaatcccagcactttgggaggccaaggcggacggatcatgaggtcaggagatcaagaccatcctggcttacatggtgaaaccccgtctctactaaaaatacaaaaaattagccaggcatggtggcgggcacctgtagtcccagctactcgggaggctgaggcaggrgaatggcgtgaacccaggaggcagagcttgcaacgagccaagattgcgccactgcactccagcctgggtgacagagcgagactccatctcaaaaaaaaaaaaagataaacccactgtaacactccagtctccctaggcctttgaatgccttcctccatagtaagccgaggcaggcctggcatttcaagttcatttactgagggccacattttggtccatgtttcagccagcaaaccaaactgttagagccctttctaacaccctgagttgcgtaacattaaatgcagaatctctgattag

SEQ ID NO: 177975 - DNA, 601 bp, Human
aaaaagatatgtcctctggacactcacaggtgagtaagtagatcttaaaagataaatgcactgtaggccgggtgcggtggctcacgcctgtaatcccagcactttgggaggccaaggcggacggatcatgaggtcaggagatcaagaccatcctggcttacatggtgaaaccccgtctctactaaaaatacaaaaaattagccaggcatggtggcgggcacctgtagtcccagctactcgggaggctgaggcaggagaatggcgtgaacccaggaggcagagcttgcaacgagccaagatygcgccactgcactccagcctgggtgacagagcgagactccatctcaaaaaaaaaaaaagataaacccactgtaacactccagtctccctaggcctttgaatgccttcctccatagtaagccgaggcaggcctggcatttcaagttcatttactgagggccacattttggtccatgtttcagccagcaaaccaaactgttagagccctttctaacaccctgagttgcgtaacattaaatgcagaatctctgattagtgggcccatatcagtaaatttggcctaacccaacttgacgttccc

SEQ ID NO: 177976 - DNA, 601 bp, Human
aaaagataaatgcactgtaggccgggtgcggtggctcacgcctgtaatcccagcactttgggaggccaaggcggacggatcatgaggtcaggagatcaagaccatcctggcttacatggtgaaaccccgtctctactaaaaatacaaaaaattagccaggcatggtggcgggcacctgtagtcccagctactcgggaggctgaggcaggagaatggcgtgaacccaggaggcagagcttgcaacgagccaagattgcgccactgcactccagcctgggtgacagagcgagactccatctcaaaaaaaaaaaaagataaacccactgtaacactccagtctccctaggcctttgaatgccttcctccatagtaagccgaggcaggcctggcatttcaagttcatttactgagggccacattttggtccatgtttcagccagcaaaccaaactgttagagccctttctaacaccctgagttgcgtaacattaaatgcagaatctctgattagtgggcccatatcagtaaatttggcctaacccaacttgacgttccctccaccatgatcccatacccttaatatccattcccacacatattcc

SEQ ID NO: 177977 - DNA, 601 bp, Human
tgggtggatggctgcttccactggcaaaaaagactcataagaatttagggattcaatgtttccagctccataagggagttcccacatttctccattccaatattcaggatccctttccttcccaatcaatgccctcactttagtagcagacaccctgcagacgttgggaattcagtttgtgctgtagttgagtcatttgcagaataagattctggatttgattttcagcaatttcagctctatggctaacagagataaggatatctttcagacataaagttttctgttcagatatgtagtgctcaagctgggaatttgaatccctgagctcatccatttcttttctcactttgtccattgtcattaggagtaaccaacaaatctcattatactcattagtttgacaaaaatgtttaaaggtatagtatatgtggtcacccagaaccttattcttatacgtgtttgattaaaagtacccaatggtgacattttgcatatctccattgccacatcatacccatacttttactactggaaatagtcattagtgtcctttaatccagttagagagccaagtcctgaaaccctagaatcaattcag

SEQ ID NO: 177978 - DNA, 601 bp, Human
actcattagtttgacaaaaatgtttaaaggtatagtatatgtggtcacccagaaccttattcttatacgtgtttgattaaaagtacccaatggtgacattttgcatatctccattgccacatcatacccatacttttactactggaaatagtcattagtgtcctttaatccagttagagagccaagtcctgaaaccctagaatcaattcagagaactcatccttaagattctgctcctttagagccactcttaaaaccaaaattagggttctccagagaaacagaaccagcaagatgtgcrtgtgtgtgtgtgtgcactctctttttctttatataaatatagatagataacctatctatatcttgctggcatagatagatagataggaattcgctcatatgattgtggaggcttggtaagtccaaaatctgcagggtaggctggcaggctggagacctagggaaaagttgcaattcaagtccaaaggcggtctgctggcagaattccttctttttcagggatggtcagtctttgttattgttaagacctttaactgattggataaggcacacctacattataatggagggtaatctgctt

SEQ ID NO: 177979 - DNA, 601 bp, Human
ttgctggcatagatagatagataggaattcgctcatatgattgtggaggcttggtaagtccaaaatctgcagggtaggctggcaggctggagacctagggaaaagttgcaattcaagtccaaaggcggtctgctggcagaattccttctttttcagggatggtcagtctttgttattgttaagacctttaactgattggataaggcacacctacattataatggagggtaatctgctttactcagagtcccccaattgtaatattaatcttatcagaaaacagcttcacagaaataactartgaattttaaaagataagccatagtggagatctcaaattgtggtttcccatgattgtaaacaattctattctttgttgtctctattttagcactttctctttacatctcaacttggtgctatctgacttcctcctcctctcactatttgacactttgataaaggccatctgatattaccaaatcaactaacctgtttcagccttttctttccagacctttttgctttccttaacatggttgaccactttgatctcatttcctttgcctttgtgacattactcctggttctcatctctctt

SEQ ID NO: 177980 - DNA, 601 bp, Human
aatgttgattttccttaggcaggttctgctctcagccctttgctagtctcactgcatgcttgtctttggtaatttcgtccatttttgtctgtttgttgacagtgaatatgtggcagctataggcattcaatacgtatttgttgaataaatggtgactcccaaatatatccccagtgctctgaactgcagaatcttaccaactgaccattacatacaactggacatacccatttgaatgtccagaggcacctcaaactctgtatgctcagaactcaactctatatatctctcctcctcaaaytgtgcttcctccggcatgccactcgctattgttattgcttgctgctgtcctatttgtctttccctcaagtcagccaagccaaaaatttggtcttcatcctagaatccttccctttcctcacctcacctccctggatttaatcagatctctgccagtgtttaccttttatttctgaacccactccctcctttccattgtcccaggacaaatgccagtcattttaagttcatgttactgcaagaggcttgagactcctagatcgtctctctaatggtagtcatcttcccttcaggtctgccc

SEQ ID NO: 177981 - DNA, 601 bp, Human
ctctgtatgctcagaactcaactctatatatctctcctcctcaaactgtgcttcctccggcatgccactcgctattgttattgcttgctgctgtcctatttgtctttccctcaagtcagccaagccaaaaatttggtcttcatcctagaatccttccctttcctcacctcacctccctggatttaatcagatctctgccagtgtttaccttttatttctgaacccactccctcctttccattgtcccaggacaaatgccagtcattttaagttcatgttactgcaagaggcttgagactcmtagatcgtctctctaatggtagtcatcttcccttcaggtctgccctcccaactgttgccagagggatctctctcttgggcaaatttaattgtaccactcttctgttaagatcctccatctctccccattatctctgggatgtacttaggtctgccatccccttccttgtactttattgattttttgcaacatttctgcataatactgctgttttatgtctccttgaattcgtgtatgatattttcactcttctgattacccttgtcccttatttacctggctaactcctatttagctttc

SEQ ID NO: 177982 - DNA, 601 bp, Human
gtagatgtttattgaatgacctcaatggctctggccatcaagctatcatagcctaaaacacccctttcttcacagtaggaatataactgacaggtgcattggattagttacattacctcttcactgggcagtgatgcagtgtgctgacaatgacactttagatatgaggatatggcctagaaacattgattggcctttttctggatcttaaagagatttcctggatggagagcctgtcatttagagtagattatctctacagagaaccaatatcatccattgagtactgagatttcttgtktttttttgtttgtttgtttgtttgtttgttttgagacagagtcttgctctcgctcaggctggagtgcagtggcgcaatctcggctcgctgcaagctccgcctcctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccacc

SEQ ID NO: 177983 - DNA, 601 bp, Human
gtttattgaatgacctcaatggctctggccatcaagctatcatagcctaaaacacccctttcttcacagtaggaatataactgacaggtgcattggattagttacattacctcttcactgggcagtgatgcagtgtgctgacaatgacactttagatatgaggatatggcctagaaacattgattggcctttttctggatcttaaagagatttcctggatggagagcctgtcatttagagtagattatctctacagagaaccaatatcatccattgagtactgagatttcttgtgtttttgtgtttgtttgtttgtttgtttgttttgagacagagtcttgctctcgctcaggctggagtgcagtggcgcaatctcggctcgctgcaagctccgcctcctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccaccgcgcct

SEQ ID NO: 177984 - DNA, 601 bp, Human
tttattgaatgacctcaatggctctggccatcaagctatcatagcctaaaacacccctttcttcacagtaggaatataactgacaggtgcattggattagttacattacctcttcactgggcagtgatgcagtgtgctgacaatgacactttagatatgaggatatggcctagaaacattgattggcctttttctggatcttaaagagatttcctggatggagagcctgtcatttagagtagattatctctacagagaaccaatatcatccattgagtactgagatttcttgtgttttttggtttgtttgtttgtttgtttgttttgagacagagtcttgctctcgctcaggctggagtgcagtggcgcaatctcggctcgctgcaagctccgcctcctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccaccgcgcctg

SEQ ID NO: 177985 - DNA, 601 bp, Human
ctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccaccgcgcctggccaagatttcttgttttaaaattcattacctttttttgatttaactaaataatcaggtctctaccagatttcaagatatttagtacgctaatgttraattgaaagaaccttggacttgagtcagtgcacaaaaatgaacatgaagaccacaaatactcatgtctgctaacaacatagtgatacaaataagatgtccgtgtaactactaaccccattatttactgatctccattgctgtactttgtatttttcctactatttatagctggaaatatattgatatggtttggctctgtgtccccacccaaatatcattttgaattgtaatccccagtgttggaggtgggaactggtgggaggtgattggatcttgggggtggggatttctcatgaatg

SEQ ID NO: 177986 - DNA, 601 bp, Human
gttccaccgtgttagctaggatggtctcaatctcctgacctcgtgatccgcccgcctcggcctcccaaagtgctaggattataggagtgagccaccgcgcctggccaagatttcttgttttaaaattcattacctttttttgatttaactaaataatcaggtctctaccagatttcaagatatttagtacgctaatgttgaattgaaagaaccttggacttgagtcagtgcacaaaaatgaacatgaagaccacaaatactcatgtctgctaacaacatagtgatacaaataagatgtccrtgtaactactaaccccattatttactgatctccattgctgtactttgtatttttcctactatttatagctggaaatatattgatatggtttggctctgtgtccccacccaaatatcattttgaattgtaatccccagtgttggaggtgggaactggtgggaggtgattggatcttgggggtggggatttctcatgaatgatttagcaccatactcttggtgctgttctcttgacagtgagtgagtgagtgagttattgcgagatctggttgtttaaaagtatgtagcacatcctcctctc

SEQ ID NO: 177987 - DNA, 601 bp, Human
tgagttattgcgagatctggttgtttaaaagtatgtagcacatcctcctctctctcttgctcctgctcttgccatgtaagacatgcctgctccccattcaccttctgccatgattgtaagtttcctgaggcctccccagaagccgagcaaatgccagcatcatgcttcctgtgtagcctgcagaaccacgagccaattaaacctcttttcttaataaattacccagtctcaggtatttctttatagtaatgtgagaatggaccaatacatatattttggtttttcggagtttttttgagakagggtctcactgtcacccgggctggagtacagtggctcaatcttggctcactgcaacctccacctccaggttcaagcgattctcccacctcagtctcgcgagtagctgggaccacaggtgcacaccaccatgcccagctaagctttgtattttttggtagagacagggtttcaccatgttagtcaacctggtcttgagctcctgacctcaggttatctgcctgccttagcctaccaaagtgctgggattataggtgtgaaccactgcacccagccaaagggactaatacatacacataca

SEQ ID NO: 177988 - DNA, 601 bp, Human
tcaaaaattctaagatgtaatttaccttatacagatgtagaaattgagctctcaagttctctgtatgtgctgccttcccataaacattaaacattgccatgacacccagagaagccccagggagcctggtaagcagccatatacctggggaatatagctagagaacttttgttttctgcctcactctcaaaagtgtctggatttgccccctcatttgtcatatccctgttaactacagtcactactctaaacatctactttggctctctttccttacccctcttatctgctcagaacctcmttaccagaaaatgtagcaactccacaatcttttcccacccttcaagcaccatatccttttatagtttcactacgacagtttctggagctcatcaagtcttcccatccctccctgcttttgttttgtattcgttacttcctggctgcttccctctcccgctccaacttggagtccatagttcattgttataatcattcctttgtaaaggctcctacttccccagcccttctgtgccatcattgcacttacctggcaatccctcaaccctgggaaaaccctaccatctctttttacatcctt

SEQ ID NO: 177989 - DNA, 601 bp, Human
ctttaaaaaccaaaaaaaggccgggcacagtggctcatgcctgtaatcccagcactttgggaggccaagacgggtggatcacctgaggtcaggagtttgagaccagcctggccaacatggcaaacccctgtctctactaaaaatacaaaaattagtgggccatggtcgtgtgcgtctataatcccagctacttgggaggctgaggcaggagaaacacttgaacccgggggtcagaggttgcagtgagccgagatcgcaccacttcactccagcctgggcgaaagagcgaaactcagtctcaaaaaaaaaaaaaaaaaagaacctccaaatagcagtttgcccattttctccttccaagttcacatatagaccttaataaaagttatagactccaacaactagtaaatatttttttccacttgtttcgttaaatttatttccattaaattgggagtaagatcaaaacagaataatgtttactgtcatcagtttaagaataaatgttgtgcttactccgcagaggcggatggatccactacttctccccccactgcaaaatttggttaagatgtggaaactgatgataccatatgtgcaccag

SEQ ID NO: 177990 - DNA, 601 bp, Human
tttgtggtttactgcctttcattaattctgacacagtttttaatattttaatatctctgatattgggatatgccttacaattgttggcgagtcatagccagcatttttatttcttggggacacagaaaataatgtgtcttaccctcagtggtgtcttcaattacatgaactatgacaatttttacacctttataagtcttttaaaataaaaaattcatttatacttcagaaaaaatacctatgattagaccacgagttaggggagactttgcagtggtgattgccttggagttgccttgamggaagagtgggagttggcccaacgggagtgggttggtggagaaggcattcagactgagagatagcatatacagcatattataaagagtgtgctgtgttggggaaagggctagaagtttgatgtggcaaaaatgtaggctctgggatgagatgagaatgataaactggctggaatggtaacctggagccagcctttgaaaggctctgtgtgccgtgcgagggagttgaggctgtcttggcatgttaggcagcattgtaaagcagctctccctccctgtttgcatcagcaaaggggtgggca

SEQ ID NO: 177991 - DNA, 601 bp, Human
ggcattcagactgagagatagcatatacagcatattataaagagtgtgctgtgttggggaaagggctagaagtttgatgtggcaaaaatgtaggctctgggatgagatgagaatgataaactggctggaatggtaacctggagccagcctttgaaaggctctgtgtgccgtgcgagggagttgaggctgtcttggcatgttaggcagcattgtaaagcagctctccctccctgtttgcatcagcaaaggggtgggcagcattggcaccaataacagaagagtgaagacaatacatatgtcraataagatctctagcacagagttctccaaaatggaaagggctgcaccctggaatcagatggaagggagaactttaccaagggggtgctatttccttctgctctgttgtgaatggagttggggttcagtggcctgttttagaagcctgtttgtgggcaagctgtgtgacaaagttgttgaaaaatgaggaatggctttcagagggcagtattaatccatttggatggaaatttaggagtggaacatgtgtttctaagctgtttttggctttttcctaagggctatatattcttaaattaaa

SEQ ID NO: 177992 - DNA, 601 bp, Human
agcgaattgttttgcatagagcctgcattgctaagccagtagaaggaactagtcttttaaaaacattttctaatttcattcccttttatttttgagacagggcctcactctgtcgtctaggccggagtgcagtggtgcgatctcagctcacagcagcctcaactatccaggctcaggcagtcttcccatctcagtctctcaaataactgggatttacagcatgagccaccatgcctggcaaatttttaaaaaatgttttgtagaaacaggggtctcactatgttgcccaggctggtctagtactcctaggctcaagtgatcctcctgcctcagcctcccgaagtgctgaatgaaccaccacaccaggtcttttatttcacgtttaaataaaaatgttagatagtagtatgttgacatagttcaaaagttaaaaaagaatacatgataaaaagtcttcctcctagtcccctgtccctttgctgaggaactcagtgttagtatcctgtgtatggttccagagatattttatggagatgtgagcaaatctataagtgatagcatctcatacacatggttctacagctgcttttttttttaacag

SEQ ID NO: 177993 - DNA, 601 bp, Human
tcttacctttaagtctatgttttatttgagttaatttttgtatatgatgtgctttacattttgtacttttcatttaataatatcttgggagatcattctattccagcactaaagaacttcctcagtttttcttatgatactatagtattctcttatgttgatatatcatagctactttaaacagtctctcattgatggagatttacacaaacatttgggtttggaaattatctcaaaatgacattgtggcttgaaagttgtttcatatcacccttctcaaaaatacaatttcatccatttcacagatttggttgttccaggcaactcatgctattcagaagccctggaataaatcccagtcctttgggtagaatgaccccaaggaattcaagatatttcattccattaaatgtttacagtaagtcaggaagcaaaagtttctttcaattatctgaaaatatatggaaaaatacttttggagggacaaggtgctctaaaattttgttgtaccgtctaagctacagtcagtttcagatgacttaatggcatgtgttcttttactcttttgttgaattgttgtctgtgtgtataaatcaaagtg

SEQ ID NO: 177994 - DNA, 601 bp, Human
gttaactcaggctgccagtgcagtcttcagaataaagtagatttttgtaatttctctgccgacatgtaaacttatacaagtgtgttattgattaagaagctgagtagagcactgccctggtattttgaaaagttcaggttcatgcatgtgcactaataatgtattttacaagtgaacatacctatacctacagtcaatcaaatgccaggcaaggtgtggctcgtctgcttcaggcatggtcttattgtataatagcatcgtaagtgaagtcccaacatctcatttgtatgctgggtagtamttacatgtttcaaatcacctgggggccttttaaaaatcctgatacccaggccataccccttaccaattaaatcagaattcctggaggtaggggtgggacccaggcattagtattcttttaagagttagactgtttagagcagttatggtttacagcaaaatagagcagaaggtacagatttcccatctgtctcctccatggcctctcctattattggtatcccccaccagagtgatacattgttacagttggtgaacctacagtaacacatcattatcacccaaagaccattatatttac

SEQ ID NO: 177995 - DNA, 601 bp, Human
tatacctacagtcaatcaaatgccaggcaaggtgtggctcgtctgcttcaggcatggtcttattgtataatagcatcgtaagtgaagtcccaacatctcatttgtatgctgggtagtaattacatgtttcaaatcacctgggggccttttaaaaatcctgatacccaggccataccccttaccaattaaatcagaattcctggaggtaggggtgggacccaggcattagtattcttttaagagttagactgtttagagcagttatggtttacagcaaaatagagcagaaggtacagatttsccatctgtctcctccatggcctctcctattattggtatcccccaccagagtgatacattgttacagttggtgaacctacagtaacacatcattatcacccaaagaccattatatttacgttagggttccttctttctgttgtacgttgtatgggtttcaacagatgtacaatgacatatatctattattataatatcatatagagtaatttagtatttttcagtagtttcagtaggcatcagtatttttaaatttttaaaaattttttgctgtattttggaggagaggaatatattctta

SEQ ID NO: 177996 - DNA, 601 bp, Human
attcagattgagattctagtctttagtgacatggaatgtagattagaacaatagtttctgtatatctcaatggtctttacatttgcatttttagccattttaactagcccctaaaaactctcttttatgactctgtggatgagctatctgaattcaacaataattttactatgtattcccataatactcctagtcatttaaaaaaaggcaggggaatggacaaagcaaatcattcccaattgtttaagaaaccagtgaactcatcccttgcttggactgcatagaatacagcctgagaggraaacctgtgatttagtttctctctttacccacacaggagaacacttctgacaagatgccattcgtgctcaccgtagttggtcagaaactgcggctctgtgcttggcaaaagttaatttggattttagatgctgtgtgcaaggaaaccatgtgcagttttaagcaaggatcttcactgaaatttctcgctgcaatcaactacgcagagtgcccagctctcagcatttgacacagttggccactcttcccttgtctctcatggcatcgtgatttcctgggatacctttggtctctttgtcca

SEQ ID NO: 177997 - DNA, 601 bp, Human
ctagttgctgtgaagtggggaaggctgaaggaggcagacaccaattaggaagctatcaatacttaatccaggtgaaagatgacagtggcttggaccaagatggtgacaccaaatgaggcagagagagatcaatttctagataggtttcttttgttttgttttgttttgttttttgagacagagtctcgctctgtcaccccgcccagagtgtagtggtgtgatctcagctcactgcaagctccgcctcccgggttcacgccattctcctgcctcagccttccgattagctggtactacaggygcccgccaccacacccagctaattcttttgtatttttagtagagacggggtttcaccatgttagccaggatggtcttgatctcctgacctcggtgttccgcccactttggcctcccaaagtgctgggattacaaacgtgagccaccgcacccggcccctctagataggtttctaagtagagatgacatgtgtagctgacagcttggaggaaagttgtgcaaaagagaggagtcacaaaacagtccagggttttggtctcagccactagaaaactggtgttaccatttactgatttggaga

SEQ ID NO: 177998 - DNA, 601 bp, Human
gtggggaaggctgaaggaggcagacaccaattaggaagctatcaatacttaatccaggtgaaagatgacagtggcttggaccaagatggtgacaccaaatgaggcagagagagatcaatttctagataggtttcttttgttttgttttgttttgttttttgagacagagtctcgctctgtcaccccgcccagagtgtagtggtgtgatctcagctcactgcaagctccgcctcccgggttcacgccattctcctgcctcagccttccgattagctggtactacaggcgcccgccaccacacccagctaattcttttgtatttttagtagagacggggtttcaccatgttagccaggatggtcttgatctcctgacctcggtgttccgcccactttggcctcccaaagtgctgggattacaaacgtgagccaccgcacccggcccctctagataggtttctaagtagagatgacatgtgtagctgacagcttggaggaaagttgtgcaaaagagaggagtcacaaaacagtccagggttttggtctcagccactagaaaactggtgttaccatttactgatttggagaagaccatggaaagg

SEQ ID NO: 177999 - DNA, 601 bp, Human
actttcaaaggttttagatagggcaataagacaagatttgagaattaaccatggaggtcattgcattccttaacaaaaacagtttctatggagtaacggagatgaaagcctaaattggatttatccaagagaacagaagaggagagaaattggacacagtgtgtacagacagttctttcaagattgataaaataaaggaggacaaaggggccagagctgcagggagatgcagggtcaaggttttttttctctaaacctgggatataaatataaatatgtatgtttatattgctgctggtgrtaattcagtagtgagtgaaaaattcagaagagggagaattgctggatcaataaatgtccttaggtaggcaagagatgagatgcaatgtgcagtggagaggttcatcctggagagggatgcagacagacactttctacataggagtgcagggaaagcagaatgggcacagatgcagggaggtgggtagctatggtgtctggacatagggaggttctcttctcattgcttctgttttctcagtgaaataagcagctcagtcattagctgggagtgagaaaccagaggaagtggaaatttgag

SEQ ID NO: 178000 - DNA, 601 bp, Human
tgcagtggagaggttcatcctggagagggatgcagacagacactttctacataggagtgcagggaaagcagaatgggcacagatgcagggaggtgggtagctatggtgtctggacatagggaggttctcttctcattgcttctgttttctcagtgaaataagcagctcagtcattagctgggagtgagaaaccagaggaagtggaaatttgaggttagagaggaaggtttaaactagtcctctagggaaatggaaagcagatggattagggcaatgtgggtggattgctagacagcattargagtccctttaaggttagtgaccatacatttaaggcgaaaatagtcagtgggattgtgtgcttttgtccagctgtggtcagccaccctggtggagatgcatagtggatagagaattgaatttaaccaggatagaggttccaggtgaaggccctgaagggagaggcaagagagctgattgtgtatgcaagggggtgagtataatggtggcctatggggtttagtctgagtaaggcaaatgaagacatgctgggattttagtttctgatgcagcttagggatcagtgaactcagggttttgg

SEQ ID NO: 178001 - DNA, 601 bp, Human
aaaaaattctgaaaatgaccatcagtcctggctgacaatactcttccttattctgcccgtctgttacattctaagaattattgcaacactgcagatatttattccaaacgatttctttaaaaaatatggaagatgggtatttttaagttaccaattttgggccaaataagttttttttttctgactttcattttgtctgtgaaagcatttcttttatagcagtatgttcaaattagcaatctttaagaatttggcaaatacttttaacagcaatccttaacaattcctgcagttgcctackattgcagatcttgaaaaaagagccatttttatattctaagtggtagacacatttcaattactatttcctgggcttaggctaactgacaaaacttgatgggtgaaatgaaaatgtgatatacggtgtaatcagctgtttacttacctagcacagtgaaatcttatggtaggtatgattgcactaacaaaaccaaaacatgcatttttcttccttaagttctttataagaaaaggatcagttaaataataaatgtggctttaaaatgaagttatatcttaggatagttttaattgcattaca

SEQ ID NO: 178002 - DNA, 601 bp, Human
tgcttagggagtgaaactattctgtatgatactgtaatggtggagacgtcactattcacctttgtcaaaatccataagatctacaacactaacacaaatcctaatgtaaactatggactgtggttaacaatgatgtaaccatattggctcatcaattaaaacaaacgtataacactaatgccagatgttaataataggagaaacaggttggccatgggagagtgagggaatatgagaattctaccttctattcaatgtttctgtaaacctgaaactgctctttaaaaagtctattagtttaaaaaaaaaattcaatataaccagactaataaaaatatcttaactaaaaagcaatacaaacctaaactgtcagcaattattctgtttatagtgctattctgattgaacttagctgtagaatattctgccagaaatatgtaatggcagtgaattactgtatatatctagtaactttgctgtatcttttcttgtctggcaaaaatgcacagtggtattcatgttaagtcctactttcaactacccttattcctttctcttcagtgacagctggagtatcagccttggaagtatatacgccaaa

SEQ ID NO: 178003 - DNA, 601 bp, Human
ttgggcccatcatatgcctatgccatttaatcttcacagctctatgaggaagacagggtggggaggatgggagacactgactcaagagttattcacctgtggccataccacacaggttagaattgtttaaacttcaatacggtatgatttcccttatgtattatttctctctcaggtagaaaaatctgctaataatatttacggcctcataggttttagggattacctaaggcagtgcttctcagtattttttaaaatttatttttaaaaggagccttttcacatttttcttaatctctgcccccttccatgaaattttaatattgtagatatcctctgcaactgttttacatataaaagagaaagattttctcaaagcttcccacccaagagccagtgtttgctcccttgggggagaatctcccctatggagaatgcatagtctagaggtctttataagagaggccttcccttacagtagccataagggtgagcacaggaatccatacagataccatggaaagacataaagaggcattctctgcttcacgtaaatatggcatcagcatagaacatacactaatgttcccatagaggcaag

SEQ ID NO: 178004 - DNA, 601 bp, Human
gtccaagatgatgaaaacataaaaacagatattgtcagtgggaaccgaatagagagaagagagaactgagagaaactaatgagacattgacaatattgggggattaactggataggaagaaagagaatcaaggatgacttcaagatttatggttttggaaagaaacagtagccatcagtgaagacacgatacatgaagaggggaagatgaagtttgtaagagagggtgacaagcttgggggagaggggcagccaggtggtaaagtgagtaggcaaggagtctagagcttaggggacgctaytgatggagagagaggtttgggagttaagaaaatctagatgatcattaaatcataggaatggatgagtctgcactggggttttcaccgtgctcaaagggttctgaaaatgttctgtttgaattgctaatagagctggtttctatccccagctccaccatcaccccgtccattaaccagaacaaagacatcaggcctccagcatagctgcttggattagagccaagtgtgaggatagatcccctcccactgggccttaaccctgcttccaggtgctgagtttgacaaggtttactttgagaa

SEQ ID NO: 178005 - DNA, 601 bp, Human
tccattaaccagaacaaagacatcaggcctccagcatagctgcttggattagagccaagtgtgaggatagatcccctcccactgggccttaaccctgcttccaggtgctgagtttgacaaggtttactttgagaagacagttcctttgctgaaagcaggactgaggagagactgaggagtggaaagagaaaggggctaaaggctgaactttcaaaagccggcaagagtatcttgtgttatctgggctttgttcctttcacacacccatgacttttccataggaaaccagaaggaagagggmgaaactcagattagctgatctgagatatttaggattcttctcctttgtgcttctgtgtatcttagtggtaagctaactcaacactaagctttctgaagccttgggaatcactgggctcaatcatggtgttactggaagaacattggctttgaagactcagatgggcctaaattttactctgggtccccaatttactatcattggtaccttgggaaaatggcttctcttaagtctccattttgtcttttataaaattatgggtggtaataattatatcaatgaaatattgagaggattaga

SEQ ID NO: 178006 - DNA, 601 bp, Human
tggatggatggatggatggatggatggatggatggatggatagatttaaaaaaataataatttaataattaattacaataaaaaatcaggagaaatcaatcagaaacaaattcagaatggatggaaatgatgggattcataaacaaagaccttaaaatgagtattatcaatcttattagtaaacttaaagatgtaaaggaaagcttgaacccaatgaggaaagaaatagatatctaaaacagaccaaaatggaacttctggaaataaaaaaaaattggatggtgttaacaacagattagayactgcaaaaaaaaaaggtcaatcaacttgaagacatagcaatagaaactatccaaaatgaagctcaaagagaaagacagatggcagggtgaaagtgaacagagcctaacacggtgaaaacccatctctactaaaaatacaaaaaattagttgggcatggtggcacgtgcctgtagtcccagttactcaggaggctgaggcaagaaaatcacttgaacctgggaggcagaggttgcagtgagctgagatcatgccactgtactccagcctgggcaacagagcgagactctgtctcaaaaaa

SEQ ID NO: 178007 - DNA, 601 bp, Human
caagagtccatcagtatacaagtggataaatagaatgtggtatatatatacacaatggaatattattctgtctttaaaaggaaagaaattctgacacatgctacaacatggatgaatcttgaagatatgccaagtgaaataagccagccacagaaagacatactatgtgattctactaatatcccataccctacagtggtccagttcatagagacagaaagtagagtggtagttgttggggaaggaagaatagggagttgtttaattggtacagtttcagtttttgcaggatgaaaatatygtagagattggttgcacaaggatgtaaatgcacttaacactactaagctgtacactttaaaatggtaaagatgctaatttttatgttatatatattttaccacattttttaaacagtaaaaggatggaaatgatatgctacattaacactaatcaagagaaatctgggtggtaataatatcagaataggcttcagaacaagaaatagaaccagggataaagacagactttttatgatgacaaagtgatctactcatgaagaagacataatcctaaatatttatacttctaataatagagc

SEQ ID NO: 178008 - DNA, 601 bp, Human
aattatctactgctacgtaacaaaccccccaaaatatagtggcttaaaacacgcactatttatttggctccccattctgtggattggtcgagcagattctggtctggatgagctcagctgatctctgctggctcacttgtgcatctgcagttggctagaaggttgactggtagctggacagtctacagtggtctcacttacagtctaaccattggcaggctgttggccaggcagacagaggacagctgggccatgcatctctcatcagccatcaggctgactttggcttcttcacatggtmgtggtggctgtgtgggtcccaagatcagtgagagtggaagtggcaaggtctgttgaggtctgggtgtggaaactgcacagcatcactgctgcctcattctgttagtcagagctgatcacaagatcagcccagattcaaggggtagagaaacagatttctactcttgattggaaggacctacagcattatgttgcaaagagtaagatgcagagaaggaaagagtttgtagccatttgtgcagtcagtcacacattgtaaaccccttctcccatgaacataccctaaaactcttagtgagtt

SEQ ID NO: 178009 - DNA, 601 bp, Human
acttgtgcttagaaatttacaaatgtgcccagggccacgtgaccagtgctcttctctaaggttcaacaaagacgatatcataattcagactgcagatctgccaacattcaaatggctctagtcctcgagtgttattttctaactccgcttttagatgcaccattgtatagcccttacaactgggcctgtcccttctgtagatgtgggagtagctgaactccacagaaccccaggttacacactaaggacacaggttgttagggctcctggatgagggtaagtgtgtttattttaaaccacstgcttttggctattgagcttatgatttcaaaggtgaaagcttaagcacgttattagacttctcaaggagagttcccctagattgggagaaaagttgacattgggtaatattaaatctttcttttaaaaccagggctattttgttgttgtttacaattttaagagtctagactgaaagagtcatgaaatgcagccacctatctgacctcttcccccaacagttagggaattcgctctgcccccaggccacccaaccttcccttgctctcctgaatgggaccctgacaattccctggaattg

SEQ ID NO: 178010 - DNA, 601 bp, Human; identical to SEQ ID NO: 32049

SEQ ID NO: 178011 - DNA, 601 bp, Human; identical to SEQ ID NO: 32050

SEQ ID NO: 178012 - DNA, 601 bp, Human; identical to SEQ ID NO: 32051

SEQ ID NO: 178013 - DNA, 601 bp, Human; identical to SEQ ID NO: 32052

SEQ ID NO: 178014 - DNA, 601 bp, Human; identical to SEQ ID NO: 32053

SEQ ID NO: 178015 - DNA, 601 bp, Human; identical to SEQ ID NO: 32054

SEQ ID NO: 178016 - DNA, 601 bp, Human; identical to SEQ ID NO: 32055

SEQ ID NO: 178017 - DNA, 601 bp, Human; identical to SEQ ID NO: 32056

SEQ ID NO: 178018 - DNA, 601 bp, Human; identical to SEQ ID NO: 32057

SEQ ID NO: 178019 - DNA, 601 bp, Human; identical to SEQ ID NO: 32058

SEQ ID NO: 178020 - DNA, 601 bp, Human; identical to SEQ ID NO: 32059

SEQ ID NO: 178021 - DNA, 601 bp, Human; identical to SEQ ID NO: 32060

SEQ ID NO: 178022 - DNA, 601 bp, Human; identical to SEQ ID NO: 32061

SEQ ID NO: 178023 - DNA, 601 bp, Human; identical to SEQ ID NO: 32062

SEQ ID NO: 178024 - DNA, 601 bp, Human; identical to SEQ ID NO: 32063

SEQ ID NO: 178025 - DNA, 601 bp, Human; identical to SEQ ID NO: 32064

SEQ ID NO: 178026 - DNA, 601 bp, Human; identical to SEQ ID NO: 32065

SEQ ID NO: 178027 - DNA, 601 bp, Human; identical to SEQ ID NO: 32066

SEQ ID NO: 178028 - DNA, 601 bp, Human; identical to SEQ ID NO: 32067

SEQ ID NO: 178029 - DNA, 601 bp, Human; identical to SEQ ID NO: 32068

SEQ ID NO: 178030 - DNA, 601 bp, Human; identical to SEQ ID NO: 32069

SEQ ID NO: 178031 - DNA, 601 bp, Human; identical to SEQ ID NO: 32070

SEQ ID NO: 178032 - DNA, 601 bp, Human; identical to SEQ ID NO: 32071

SEQ ID NO: 178033 - DNA, 601 bp, Human; identical to SEQ ID NO: 32072

SEQ ID NO: 178034 - DNA, 601 bp, Human; identical to SEQ ID NO: 32073

SEQ ID NO: 178035 - DNA, 601 bp, Human; identical to SEQ ID NO: 32074

SEQ ID NO: 178036 - DNA, 601 bp, Human; identical to SEQ ID NO: 32075

SEQ ID NO: 178037 - DNA, 601 bp, Human; identical to SEQ ID NO: 32076

SEQ ID NO: 178038 - DNA, 601 bp, Human; identical to SEQ ID NO: 32077

SEQ ID NO: 178039 - DNA, 601 bp, Human; identical to SEQ ID NO: 32078

SEQ ID NO: 178040 - DNA, 601 bp, Human; identical to SEQ ID NO: 32079

SEQ ID NO: 178041 - DNA, 601 bp, Human; identical to SEQ ID NO: 32080

SEQ ID NO: 178042 - DNA, 601 bp, Human; identical to SEQ ID NO: 32081

SEQ ID NO: 178043 - DNA, 601 bp, Human; identical to SEQ ID NO: 32082

SEQ ID NO: 178044 - DNA, 601 bp, Human; identical to SEQ ID NO: 32083

SEQ ID NO: 178045 - DNA, 601 bp, Human; identical to SEQ ID NO: 32084

SEQ ID NO: 178046 - DNA, 601 bp, Human; identical to SEQ ID NO: 32085

SEQ ID NO: 178047 - DNA, 601 bp, Human; identical to SEQ ID NO: 32086

SEQ ID NO: 178048 - DNA, 601 bp, Human; identical to SEQ ID NO: 32087

SEQ ID NO: 178049 - DNA, 601 bp, Human; identical to SEQ ID NO: 32088

SEQ ID NO: 178050 - DNA, 601 bp, Human
tcaagatattactaaggaactcagagtctgataaaacactaggccaggagttcaccataacagagtaaaccgttgtcttcatgaatagtttgaattaacaatgcaaacaagatggcaggcagaggttgacaaggggactaaagttttcagttcactctaagtgcttcagcatccatcattaggagacaaattattgagaagctaattataaatcatttatctactcatacaacaatctcttaatgactatctttgggttttatagatgctggcttttaaaaatacttggataggccaggcrtggtggcttacgcctataatcccagcactttgggaggctgaggtgggaggatcacctgaggtcaggagttagagaccagcctggccaacatggtaaaaccctatctctactgaaaaaaatacaaaattgctgggcatggtggcgcacgcctgtaaccccagctacgtgtgtggctgaggcaggagaatcgcttgaacctgggaggcagaggctgcagtgagctgagatcgtgccactgcactccagcctgggagacagagtgagactctgactcaaaaaaaaaaattaataaataaaaat

SEQ ID NO: 178051 - DNA, 601 bp, Human
caaccatagtcacttgcatttttggttattaccaactttgtattttgtttatttagacggtatggcataaatggccattctctcttttagttacgcatcatcatggattggttaagcacctgttgtgccaagtcagatgcagaaaggaatcaaccatagttcctgcttttatgaagcattaaattttgtctagtgggtaacatcaagatattactaaggaactcagagtctgataaaacactaggccaggagttcaccataacagagtaaaccgttgtcttcatgaatagtttgaattaayaatgcaaacaagatggcaggcagaggttgacaaggggactaaagttttcagttcactctaagtgcttcagcatccatcattaggagacaaattattgagaagctaattataaatcatttatctactcatacaacaatctcttaatgactatctttgggttttatagatgctggcttttaaaaatacttggataggccaggcatggtggcttacgcctataatcccagcactttgggaggctgaggtgggaggatcacctgaggtcaggagttagagaccagcctggccaacatggtaaaa

SEQ ID NO: 178052 - DNA, 601 bp, Human
acagagcgagactccgttttttttttttaaaaaaagaatgattgaagagcatgggaatgggctattgctataagccagctaggccatgcaggctggatatgtcttgctggaagagtgaggagtgggtggtggtggtgagggttgtaggctgatgcatgagtgtgggagtgcctcctatcttgaccagcatctgcacggattctctgtcttttctttctttctgccgcgtagtcccattcctttggctcatctagcagcacacctttcttccactttcataccctcaaagcacagctttttyaattgtccatatcccagggacagttctgcttatagtcaatctgcaacttaaccacaatgttttctactaggcagagccacaggaagagaagtctctcttctatcactgaacttcgccgcacttgctcaactccaacctttaccttcagtgatccctcatcctgggttaggagggtgttgggtaaagaaagtgagggtcaatgacagcctttaaaactattcccctctgctcctggatgaaccggcagacccttctggttccttaagcaaggtcgctagcccctcaaaaggcctcaatccc

SEQ ID NO: 178053 - DNA, 601 bp, Human
gtctctactaaaaatacaaaaattagctgggtgtggtggcacgcctctgtattcccagctactcaggaggctgaggcaggagaatcgcttgaacccgggaggcagaggttgcagtgagcccatatcgcgccagtgcactccaacctggtggcagagtgagactccatctcaaaaaaaaaaaaaaaaaggaattgcattgcagtattatggtgctcaaagtaaggcctgaagaaaccctttatagaaggtaccattaagacccaggagatggcattagtaaagctcaaggagtgggtaatgwcatgaggctttctccttcatctctggagcttctgaggttcttggcctttcctgatcaatgtttgtacagtctccccactccccaccccactgcctattgtggctttgtaaaagtacagtcttctatttgtaacatctaaaatactccagacctgtacataaatgatgagaaagaatgattcaaagatgtttctgatgtttctcacttggatggagttttcagggaagggtaagtagctaaagttcagatacgttaatattagatgcctatttgacatccagtggaagtcgcccataggta

SEQ ID NO: 178054 - DNA, 601 bp, Human
atccacttgaagtctttctgctatgtggcatatagaaagggtgcccgcatgttcttatatgcttgcaacagctcccatttgcgcaattatataaggcaacgcagtcctattttatgcctgttgtcatattataattatgaataatgatctctttgaaagtattgagatttgaacaatgaatttcacagtcacctacatatagagaatgtctttttaggctcagtgtggtggctcatgcccataatcccagcactgtgggagggtgaggcgggcagatttcttgaggtcaggaatttgagaycagtcaggccaacatggtgaagctccatctctactaaaaatacaaaaagttagctgggtgtggtggcgcatgtgggaggctgaggcaggagaattgcttgaacccgggaggcggaggttgcagtgagccaagatcatgctgctgcacttcagcctgggtgacagagtgagactctgtctcaaaaaaaaaaaaaaaaaaaaaaaggaagtctttttattttaatggaacattttactatttactagtagctgctgttttttttttcttaaatcttaaaattccagctgtccagatccctga

SEQ ID NO: 178055 - DNA, 601 bp, Human
cggtatctttaaggacttctcttctttgggttcagggtctggttttggtaaagttgtaaaaggttgtctttggtcttattttcaaccctcttagctgtacctcttcaccaggtaaacatttttcctacctggaattttcccagtgactcacagagtccatcttatattccattgctaaagaccttgttttcaactggttgcaattaaagaagcataatgtattatatctcttgagaatggctgggggagaatggggtgacttttttaagcttcaaaagccatgaagagtcaagcaatgcargcactaggggtaatgtttttacaatgggctgaaggtggcagggtgcattctgatacctctccaattcactctatgaaggcagctacccactggacaggcctttgttacaaagatttcctccaggacacaacagcattttgatgggactaagtattaaagcaggcatatattaggagggtggatagcctgtgcaaaaattgtagaagtcagatagaccagggtccaaatcctagctatatcttttacttgacaacctcaggaaaggctgtagtgttctctgggtctcagttttctcatgca

SEQ ID NO: 178056 - DNA, 601 bp, Human
aataaaaaacttctgtcagactatgtattctgagttttggcttggaaaagaggactacggtatctttaaggacttctcttctttgggttcagggtctggttttggtaaagttgtaaaaggttgtctttggtcttattttcaaccctcttagctgtacctcttcaccaggtaaacatttttcctacctggaattttcccagtgactcacagagtccatcttatattccattgctaaagaccttgttttcaactggttgcaattaaagaagcataatgtattatatctcttgagaatggctgsgggagaatggggtgacttttttaagcttcaaaagccatgaagagtcaagcaatgcaggcactaggggtaatgtttttacaatgggctgaaggtggcagggtgcattctgatacctctccaattcactctatgaaggcagctacccactggacaggcctttgttacaaagatttcctccaggacacaacagcattttgatgggactaagtattaaagcaggcatatattaggagggtggatagcctgtgcaaaaattgtagaagtcagatagaccagggtccaaatcctagctatatcttt

SEQ ID NO: 178057 - DNA, 601 bp, Human
aagagatttaataatttctaattaaccaatgtgctaatttttttcttttcttttttttttttttagagacagggtcttgctctgtccccaaggctggagtgcagtggcaccatctcggctcactgcaagctccgtctccttgctcaagtgatcctctcacctcagcctccctagtagctggggctacaggcacgtgccaccacacccaactaatttttgtatttttgtggagatggggttttgccatgttgtccaggctggtcttgaactcctgggctcaagtgatccacctgtctgggcytcccaaagtgctgggattacaggcatgagcctggccttgatttttcaaataaaatcattcacaaataaataaaaaacttctgtcagactatgtattctgagttttggcttggaaaagaggactacggtatctttaaggacttctcttctttgggttcagggtctggttttggtaaagttgtaaaaggttgtctttggtcttattttcaaccctcttagctgtacctcttcaccaggtaaacatttttcctacctggaattttcccagtgactcacagagtccatcttatattccattgct

SEQ ID NO: 178058 - DNA, 601 bp, Human
aatgcagccatgcttcctaattgcctagaaggtcctggtttcatgtaattttattctttttataaaagagatttaataatttctaattaaccaatgtgctaatttttttcttttcttttttttttttttagagacagggtcttgctctgtccccaaggctggagtgcagtggcaccatctcggctcactgcaagctccgtctccttgctcaagtgatcctctcacctcagcctccctagtagctggggctacaggcacgtgccaccacacccaactaatttttgtatttttgtggagatgrggttttgccatgttgtccaggctggtcttgaactcctgggctcaagtgatccacctgtctgggcctcccaaagtgctgggattacaggcatgagcctggccttgatttttcaaataaaatcattcacaaataaataaaaaacttctgtcagactatgtattctgagttttggcttggaaaagaggactacggtatctttaaggacttctcttctttgggttcagggtctggttttggtaaagttgtaaaaggttgtctttggtcttattttcaaccctcttagctgtacctcttcaccag

SEQ ID NO: 178059 - DNA, 601 bp, Human
atcttgttacttgttatttatctgttcaggttttagatttcttcagggtccaatattggtaggatgtatgtgtataggagtttatacatttcttctagattttccaatttattggcatataattgctcatagtagccaccaatgatcctttgaatttctgtattatcagttgtaatgtctcctctttcatttctgattttatttatttgggtcttttctcttctgttcttagttaacatggctgaaagtttctaaattctttctctgtgttatcttgaatttctttgagtttcctcaaacrgcttttttgaattacctgtctgaaaggtcacatatctctgtctctccaccctggtgccttatttagttcctttggtgaggtcatgttttcctggatggtcttgatacttgtggaagttcgtcagtgtctggacattgaagagttaggtatttattgtagtctttgacatttaggactgtttgtacctgccctccttgggaaggctttccatatattcaaaaaaacttgggtgttgtgatctaagccatatctatattacagagcaccgcaagtgcagtaatgctatggttcttgcagact

SEQ ID NO: 178060 - DNA, 601 bp, Human
gttggtattagttcttcaagtctttggtagaattcagcagtgaatacttcgggtcccagatcttgttacttgttatttatctgttcaggttttagatttcttcagggtccaatattggtaggatgtatgtgtataggagtttatacatttcttctagattttccaatttattggcatataattgctcatagtagccaccaatgatcctttgaatttctgtattatcagttgtaatgtctcctctttcatttctgattttatttatttgggtcttttctcttctgttcttagttaacatggytgaaagtttctaaattctttctctgtgttatcttgaatttctttgagtttcctcaaacagcttttttgaattacctgtctgaaaggtcacatatctctgtctctccaccctggtgccttatttagttcctttggtgaggtcatgttttcctggatggtcttgatacttgtggaagttcgtcagtgtctggacattgaagagttaggtatttattgtagtctttgacatttaggactgtttgtacctgccctccttgggaaggctttccatatattcaaaaaaacttgggtgttgtgatct

SEQ ID NO: 178061 - DNA, 601 bp, Human
agtacggttggtattagttcttcaagtctttggtagaattcagcagtgaatacttcgggtcccagatcttgttacttgttatttatctgttcaggttttagatttcttcagggtccaatattggtaggatgtatgtgtataggagtttatacatttcttctagattttccaatttattggcatataattgctcatagtagccaccaatgatcctttgaatttctgtattatcagttgtaatgtctcctctttcatttctgattttatttatttgggtcttttctcttctgttcttagttarcatggctgaaagtttctaaattctttctctgtgttatcttgaatttctttgagtttcctcaaacagcttttttgaattacctgtctgaaaggtcacatatctctgtctctccaccctggtgccttatttagttcctttggtgaggtcatgttttcctggatggtcttgatacttgtggaagttcgtcagtgtctggacattgaagagttaggtatttattgtagtctttgacatttaggactgtttgtacctgccctccttgggaaggctttccatatattcaaaaaaacttgggtgttg

SEQ ID NO: 178062 - DNA, 601 bp, Human
gtatcagggtaatactggccttgtagaatgagtttggaagtattccctcctcttctatgtttcagagtagtttgagtacggttggtattagttcttcaagtctttggtagaattcagcagtgaatacttcgggtcccagatcttgttacttgttatttatctgttcaggttttagatttcttcagggtccaatattggtaggatgtatgtgtataggagtttatacatttcttctagattttccaatttattggcatataattgctcatagtagccaccaatgatcctttgaatttctgtrttatcagttgtaatgtctcctctttcatttctgattttatttatttgggtcttttctcttctgttcttagttaacatggctgaaagtttctaaattctttctctgtgttatcttgaatttctttgagtttcctcaaacagcttttttgaattacctgtctgaaaggtcacatatctctgtctctccaccctggtgccttatttagttcctttggtgaggtcatgttttcctggatggtcttgatacttgtggaagttcgtcagtgtctggacattgaagagttaggtatttattgtagtc

SEQ ID NO: 178063 - DNA, 601 bp, Human
tttgggccgggcgcggtggctcacgcctgtaatcccagcactttgggaggccgaggcgggcggatcacgaggtcaggagatcgagaccatcctggctaacacggtgaaacctcgtctctattaaaaacacaaaaaattagcggggcgtggtggcgggcgcctgtggtcccagctactcaggaggctgaggcaggagaatagagtgaacccgggaggcggagcgtgcagtgagccgagacagcgcaactgcagtccagcctgggcgaaagagggagactccgtctcaaaaaaaaaaaaaaaraaaaagaaagaaaaagaaatgctgatttttgtatgatgattttgtatactgtgaccttgttgaatttgtgtatcagttctaatggttttttggtggagtctttaggtttttccaaatataataagatcatctgaaaacaaggataatttgacttcttcctttccaatttgtatgccatttctttctttctcttgtctgattacataggacttccagtattatgttgaaaaacagtggtaaagtgggcatccttgtgttctagatcttagaggaagggcttttagtttctccctattcatt

SEQ ID NO: 178064 - DNA, 601 bp, Human
tgttatcccatctgtccatttttgctttggttgcctgtgcttgtggggtattactcaagaaatctttgcccactccaatgtccttgagagtctccccaatgttttcttgtagtagtttcatggtttgatgtctcaaagtccattttgacttgatttttgtatatagcaagagataggagtctagtttcattcatctgcatatggatatccagttttcccagcacaatttattgaagggattgtcttttcctttatattcttggctcttttgtcaaaaattagttcactgtagatgtatgartttatttcttgtttctctattctgttccactggtctatgtgtctgttttcatgccagtactatgctatttgggttgctatagctgtggtataatttgaagtcagataatatgattcctcctgatttattctttttgcttcagatagctttggctactctgggtcttttgtggttccatgtaaattttagaattttttttttctatttctgtgaagaatgtcattggtattttgttaggtattgcattgaatctgtagattgctttgggtagtatgaacattcttccaatctataagcatg

SEQ ID NO: 178065 - DNA, 601 bp, Human
attatgcacccataaaaaggatgagttcacgtcctttgtagggacatggatgaagttggaaaccatcattctgagcaaactatcacaaggatagaaaaccaaacaccacatgttctcactcataggtgggaattgaacaatgagaacacttagacacagggtggggaacatcacacaccagggcctgtcgtgggctggggggaagggggagggatagcattaggagatatacctaatgtaaaagatgagttaatgggtgcagcataccaacatgggacatgtatacataacgtaacaaacytgcacattgtgcacatgtaccctagaacttaaaagtataataaaaataaataaataaatataaaaataaaagattaaaaaaactcatcaatgaaactaattttttatctgataaaataattctaaaaaaaaaaaacacttgatgttatcccatctgtccatttttgctttggttgcctgtgcttgtggggtattactcaagaaatctttgcccactccaatgtccttgagagtctccccaatgttttcttgtagtagtttcatggtttgatgtctcaaagtccattttgacttgattttt

SEQ ID NO: 178066 - DNA, 601 bp, Human
aaaggattataaatcatgctgctataaagacacatgcacatgtatgtttattgtggcactattcacaatagcaaagacctggaaccaacccaaatgtccatcagtggtagactggattaagaaaatgtggcatgtatacacagtggaatattatgcacccataaaaaggatgagttcacgtcctttgtagggacatggatgaagttggaaaccatcattctgagcaaactatcacaaggatagaaaaccaaacaccacatgttctcactcataggtgggaattgaacaatgagaacacttrgacacagggtggggaacatcacacaccagggcctgtcgtgggctggggggaagggggagggatagcattaggagatatacctaatgtaaaagatgagttaatgggtgcagcataccaacatgggacatgtatacataacgtaacaaacctgcacattgtgcacatgtaccctagaacttaaaagtataataaaaataaataaataaatataaaaataaaagattaaaaaaactcatcaatgaaactaattttttatctgataaaataattctaaaaaaaaaaaacacttgatgttatccc

SEQ ID NO: 178067 - DNA, 601 bp, Human
tcccatgagaactcattcactatcacgagaacagcaagggtataatccacccctatgatccaatcacctcctaccagtcccctccaccaacattggggattataattcaacatgagatttgggaggggatacaaatccaaaccatatcaatgattaaattattttttactatagttaccctgttgtactagcaaatactaggtctttctcattctttctctttttttgtactcattgaccacccccaattcctcctcatcccccactacccttcccagcctttggtaaccatccttatatkctctacccccatgagttcaatcattttaatttttttttttttttttttttgagacggagtctcgctctgttgctcaggctggagtgcagtggcgcgatctcggctcactgcaacctctgcctcctgggttcaagcgattctcctgcctcagcttccagagtagctgggattgcaggcatgcaccaccatgcctggctaatttttgtatttttagtagagacggggtttcactgtgttagtcagactggtctcgaactcctgacctcatgatctgcctgccttggcctcccaaagtgctgg

SEQ ID NO: 178068 - DNA, 601 bp, Human
tatcctaatctgtgtttcagcatcctcatctatataatgaggataatgacaagagcaacctactgctcagagtggtcatgaggatgaaatgagtcaatagagatcaggtcctgagaacagtgcctggcacatagtaagtgccatatccaccatagaagttataattataaacaaagactggccttctaggttaaatttctttttttgtttagttgagacggagtctcacgctatagcccaggctggagcgcagtggtgcgatctcggctcactgcaacctccgcctctcaggttcaagccwttgtcctgcctcagcctcctgagtagctgagattacaggcacgtgccaccgcacccagctaatttttgcatttttagtagagacagggtttcactatgttggccagtctggtcttgaactcctgacctcaagtgatccgcccacctctgcctcccaaagagctgggattacaggcgtgagccaccacgcccagcctctaggttaaatttcctgtgtctattctcaccaatgtgcttgtccatgaatgctaacctaaaactattggtaggttcccatcccatagttcacacttaccttgtc

SEQ ID NO: 178069 - DNA, 601 bp, Human
cataatttttaaggagttctagcttattccaggaattaagagaagtaactatttaatgttaacaggaaagtattacaggagcccctcattccatcaacatatagcctcccactgctcccctctcatgactacatatttctctactcatacatagccccagaaatgcacactctgcaagcattgagggctccatggcttggctccatctggaagactctaaagtttctgagggcagggctcatgtctcactcatttttgtgcttcctcccgcaaagcccagtggcaaggtgctgtgtttgcrgaaagaaagctggagatgagctgacccagcacacctgtgtactcgtgtctcacagtgtgtccaacgatcccacagaagacaatcccactggcaacaccgatggatacagttctggtgcaggggagacaagatttgtggggaaagaaataaagataatgagcgtagagaaagtgggaagggtgggaaataatgtctgggttgggaaagggtgggaaaggattttctctacccgttggaattagtttatggcatttctacatggcccggagatgcgaaggaggaacaacagtttgagacaca

SEQ ID NO: 178070 - DNA, 601 bp, Human
acacgtttatcactttcaacagcagctggctgcttgtaagccttcaattaatattactacaaatgaggtagcaaatgtgtcactttaacataaacttgaatacttctgaacaaggtactctttttgaaaactatttattgtggagaaatttgaccataaaataaaatataatgaatttccatatacccatcaccccatcccaacaagccattagcccatggctaatcctgccccatcctcacccccatacactccccaccctgtgtacttttgaagaacatctcagacattgtatcatttyagacataactatcgtggtattttacatatattcagtattttagatgcattattgctgaaaatcttaaaccctgataggatggaaaagggaagtaatagagttgtgaaatctggagataagatttacttattactactctcttttgagagtgtcattatttttcagtaatatcaacattcataatttttaaggagttctagcttattccaggaattaagagaagtaactatttaatgttaacaggaaagtattacaggagcccctcattccatcaacatatagcctcccactgctcccctc

SEQ ID NO: 178071 - DNA, 601 bp, Human
gggtggtttatgaagattaattagttaatacacgtttatcactttcaacagcagctggctgcttgtaagccttcaattaatattactacaaatgaggtagcaaatgtgtcactttaacataaacttgaatacttctgaacaaggtactctttttgaaaactatttattgtggagaaatttgaccataaaataaaatataatgaatttccatatacccatcaccccatcccaacaagccattagcccatggctaatcctgccccatcctcacccccatacactccccaccctgtgtactttygaagaacatctcagacattgtatcatttcagacataactatcgtggtattttacatatattcagtattttagatgcattattgctgaaaatcttaaaccctgataggatggaaaagggaagtaatagagttgtgaaatctggagataagatttacttattactactctcttttgagagtgtcattatttttcagtaatatcaacattcataatttttaaggagttctagcttattccaggaattaagagaagtaactatttaatgttaacaggaaagtattacaggagcccctcattcca

SEQ ID NO: 178072 - DNA, 601 bp, Human
gattgaagcacaggctctgaaggcagactgtgcagggttgaacaccagctctacccctaactatgtgcaaactacttgggacaattactttaaataactcctcatgcctccattctctaacctataaaatagggatgataatagtaactctctgagagggtggtttatgaagattaattagttaatacacgtttatcactttcaacagcagctggctgcttgtaagccttcaattaatattactacaaatgaggtagcaaatgtgtcactttaacataaacttgaatacttctgaacaagktactctttttgaaaactatttattgtggagaaatttgaccataaaataaaatataatgaatttccatatacccatcaccccatcccaacaagccattagcccatggctaatcctgccccatcctcacccccatacactccccaccctgtgtacttttgaagaacatctcagacattgtatcatttcagacataactatcgtggtattttacatatattcagtattttagatgcattattgctgaaaatcttaaaccctgataggatggaaaagggaagtaatagagttgtgaaatctgga

SEQ ID NO: 178073 - DNA, 601 bp, Human
agaagaggcgtgcatggaggattgaagcacaggctctgaaggcagactgtgcagggttgaacaccagctctacccctaactatgtgcaaactacttgggacaattactttaaataactcctcatgcctccattctctaacctataaaatagggatgataatagtaactctctgagagggtggtttatgaagattaattagttaatacacgtttatcactttcaacagcagctggctgcttgtaagccttcaattaatattactacaaatgaggtagcaaatgtgtcactttaacataaacktgaatacttctgaacaaggtactctttttgaaaactatttattgtggagaaatttgaccataaaataaaatataatgaatttccatatacccatcaccccatcccaacaagccattagcccatggctaatcctgccccatcctcacccccatacactccccaccctgtgtacttttgaagaacatctcagacattgtatcatttcagacataactatcgtggtattttacatatattcagtattttagatgcattattgctgaaaatcttaaaccctgataggatggaaaagggaagtaa

SEQ ID NO: 178074 - DNA, 601 bp, Human
taatctgaaacattgtccccaaatagcatttttaccctttactccctttgctgttcatgagtgacacagaagcctagtctcaagacccatattcagccaatggctattcacaaaatgtgcagggagttagttagccattagcaaagtttctgcctcacttgggaggtcaagagaatgacctgctcagggatggaaggggcttgagtatggagcaggctctgtaagtgggatggccacagcactgaaggctctcagagaaggtgtcagttggtcttctgccacaaggtggacaagcacatgyttgggcctggggtactgatctccatatgagacataaaattgtgtctgcatgctcctatgaataaaccttcatttggcgatttctcgatttagtaaatgggctagaagaggcgtgcatggaggattgaagcacaggctctgaaggcagactgtgcagggttgaacaccagctctacccctaactatgtgcaaactacttgggacaattactttaaataactcctcatgcctccattctctaacctataaaatagggatgataatagtaactctctgagagggtggtttatgaagattaatt

SEQ ID NO: 178075 - DNA, 601 bp, Human
cattattgaggacctactgtataccaagcactggggatataagaataaagaaataattagtatcttcaaagagttcacagtgtaacaagtgaaaactgtaggaagtgaataattgtgatatagggcaaggagtgttctaatagaagcatatgctataggaggaaaaaaggaagaggaagaaggaagacaaagggggaaagagcttaactgtctagctgggatggggaattcatagaggaatgtctatgaatccctcgagctgggtttcaaaaattgactgcggttttcccaatagaccagkattaggtgggtgctgatgaggacaatctacttaaacaacccagaggagggggaacaggaggagatgaggttggaaaggcaggtggtaccttgtatgtcactgcaaagattttgaacatcaccatgaaaatgactgaaagccattgaaggattttaagcttcaaagtgacacccataaatctatgctgagcttttggggaatgtatttcactaaagacttagaggagaaataatatcttatactcttttaaccctaacaatgcctcggcatacagttgacataattagtaaataatattaa

SEQ ID NO: 178076 - DNA, 601 bp, Human
aaattattattcattcatgtattcaaactgcactttattgatggcctatgtatgccaagcacagtgctaagcctcaggaatactgaagggaataataaagacaccttgacccaactgcagccctggttctgttatctgactcttgaagacctcgattccagcttgctaatctaatgaataacaactttctgctctctgtgccattcatttattcatcattattgaggacctactgtataccaagcactggggatataagaataaagaaataattagtatcttcaaagagttcacagtgtarcaagtgaaaactgtaggaagtgaataattgtgatatagggcaaggagtgttctaatagaagcatatgctataggaggaaaaaaggaagaggaagaaggaagacaaagggggaaagagcttaactgtctagctgggatggggaattcatagaggaatgtctatgaatccctcgagctgggtttcaaaaattgactgcggttttcccaatagaccaggattaggtgggtgctgatgaggacaatctacttaaacaacccagaggagggggaacaggaggagatgaggttggaaaggcaggtg

SEQ ID NO: 178077 - DNA, 601 bp, Human
tcacgcctgtaatcccagccctttgggaggccgaggtgggcagatcacgaggtcaggagatcgagaccatcctggctaacacggtgaaaccccatctctaccaaaaatacaaaaagaaattagccaggcatggtggcggttgcctgtagtcccagctactcagggggctgaggcaggagaatggtgtgaacccgggagggggagcttgcagtgagccgagatcgcaccactgcactccagcgtgggcagcagagccagactccatctcaaaaagaaaaaaaaggactactggccaggcacrgtggctcatgcttgtaatcccagcattttgggaggccgaggcaggtggatcatctgaggtcaggagtttgagaccagcctgaccaacatggtgaaaacctgtctctactaaaaatacaaaaattagctgggcgtggtggcttgcgcctgccatcccagctactctggaggctgaggcaggagaatcgcttgaacccaagagacagaggttgcagtgagccaagatcacgccattgcattccatcctgggcaacaaaagcaaagctccatctcaaaaaaaaaaaaaaaaaagtactactct

SEQ ID NO: 178078 - DNA, 601 bp, Human
acctgatatacgacccagtagatttcaatgtggtgcagagtcacacatcctgcaaagattccaccaattgctcaaacaataatagcgcgccttttattggagcacatgctatgtgtctggcgcagttccaagtgctttacatgcatcattttctttaatcctgacaaaaacactgttaagaagtactacttggctgggcgcagtgactcacgcctgtaatcccagccctttgggaggccgaggtgggcagatcacgaggtcaggagatcgagaccatcctggctaacacggtgaaaccccrtctctaccaaaaatacaaaaagaaattagccaggcatggtggcggttgcctgtagtcccagctactcagggggctgaggcaggagaatggtgtgaacccgggagggggagcttgcagtgagccgagatcgcaccactgcactccagcgtgggcagcagagccagactccatctcaaaaagaaaaaaaaggactactggccaggcacggtggctcatgcttgtaatcccagcattttgggaggccgaggcaggtggatcatctgaggtcaggagtttgagaccagcctgaccaacatggtg

SEQ ID NO: 178079 - DNA, 601 bp, Human
tggtagtggagaatccaaagaactcaggtagcatctgtttccatagcatctggcacattgttcaataaatgcttgttgagtctgcactggtagagaaacccctttctggggagatcagacacctgatatacgacccagtagatttcaatgtggtgcagagtcacacatcctgcaaagattccaccaattgctcaaacaataatagcgcgccttttattggagcacatgctatgtgtctggcgcagttccaagtgctttacatgcatcattttctttaatcctgacaaaaacactgttaagwagtactacttggctgggcgcagtgactcacgcctgtaatcccagccctttgggaggccgaggtgggcagatcacgaggtcaggagatcgagaccatcctggctaacacggtgaaaccccatctctaccaaaaatacaaaaagaaattagccaggcatggtggcggttgcctgtagtcccagctactcagggggctgaggcaggagaatggtgtgaacccgggagggggagcttgcagtgagccgagatcgcaccactgcactccagcgtgggcagcagagccagactccatctcaaaaag

SEQ ID NO: 178080 - DNA, 601 bp, Human
taagctgcacagttatcattgatgtacttttctgcatgttttgttttagttcaataaagaagtttaaaatcaaggcctactacctacccagcaaagggtaatcctcctttctgttgcagatgaggcacgccataccaaacatgctgaagagaagaacaaaagaacagatgctagattcaaaacagggacatattgagagcaagagtgattagttcttagttcccagaaagtttccttctcaattgctaacaagagtctatcccctgactcaagggtcgcaaacgccaaaagaaggagaaasgagaaggtctgacttggtagtggagaatccaaagaactcaggtagcatctgtttccatagcatctggcacattgttcaataaatgcttgttgagtctgcactggtagagaaacccctttctggggagatcagacacctgatatacgacccagtagatttcaatgtggtgcagagtcacacatcctgcaaagattccaccaattgctcaaacaataatagcgcgccttttattggagcacatgctatgtgtctggcgcagttccaagtgctttacatgcatcattttctttaatcctgaca

SEQ ID NO: 178081 - DNA, 601 bp, Human
aaattgcaccctttgtcccaacaatttcagtcctacgttttactcctaccttgtactcaacagaaatgcatacatgcattcaccaaaagacttgtgtaagaatgtttatggcaatattattcataagaaccaaaaactggaaataacccaaatgttgcacagcaacagaatgggtaaattgttgtatatttataaaaatggaatactacatagtaatgacatagaataaattacagctacacccaacaatatggatgaattatataacataccattgagtaagagaaagtatatataagcygtatataattatacaatgtatgattccatctgtatcaattttttaaacaggcataagtaatcgagggtgttagaagactttggggaaaggaagaaggaaagagtaatcctggtgtattgctatttttctatttcttaacctggatgatgattatattttcattttgtgataattcattaagctgcacagttatcattgatgtacttttctgcatgttttgttttagttcaataaagaagtttaaaatcaaggcctactacctacccagcaaagggtaatcctcctttctgttgcagatga

SEQ ID NO: 178082 - DNA, 601 bp, Human
aaaagacaggtaaatttgattacattaaagttaagaattctgtttattaaatgcataattgagagtaaaaaggcaaacacagagtgggaaaagtgatatacagtagaaacaaatgacaaaggacccatctctagaatgtgtaaataattccaaaagataatcaaaatataacccagttgaaaaataggtgaaaaattgtacaggtactttaaaaaaatgtctgggctgggcacagtggctcacgcctgtaatcccagcactttgggaggctggggcaagtggatcacttgaagttaggagwtcaagaccagtctggccaacatggtgaaaccctgcctccactaaaatataaaaattagctgggcatggtggcggacacctgtaatcccagctactcaggaggctgagtcctgagaatcacttgaacccaggaggtagaggttgtagtgagccaagattgctcctttgtactccagcctgggcaacagagtgagactctgtctcaaaataaataaataaataaataaatccaaatggccaataaacttatgaagaaggagctcaaccacatcagggaaatacaaatggaaaccataataag

SEQ ID NO: 178083 - DNA, 601 bp, Human
ttcgagaccagcctcaacatggagaaaccccgtctctattaaaaatacaaaattagccgggcgtggtggtgcatgcctgtaatcccagctactcaggaggctgaggcaggagaattgcttgaacctgggaggcggaggttacagtaagccgagatggcgccattgcactccagcctgggcaacaagagcaaaactccatctcaaaaaaaataaagtttcctaaggaagcttaaaaaaaaaaaaaagcctgcatagctgactcttccagctccctgtgttctattcatacagaacacctacyggtagaaccttatggagtatctttagctggattctaaaatgagattgtctccttaacttgaaatgcatgcaccttgtttctatctaagcaaagcctcaatatcggggactgttgtatgcagtttttaccctaaaaagccactatttatttattatagttttgttgtcaaccatgctgttgcaatttcatttatagcagcccttgtaaaagaagggcatttcccatgctgctagcctctgacaatctgtgtttggttatagcttgaaggaaaggtatgtggacctgatctttatgtcatac

SEQ ID NO: 178084 - DNA, 601 bp, Human
cggtggctcacgcctgtaatcccagcactttgggaggccgaggcgggtggatcccctgaggtcaggagttcgagaccagcctcaacatggagaaaccccgtctctattaaaaatacaaaattagccgggcgtggtggtgcatgcctgtaatcccagctactcaggaggctgaggcaggagaattgcttgaacctgggaggcggaggttacagtaagccgagatggcgccattgcactccagcctgggcaacaagagcaaaactccatctcaaaaaaaataaagtttcctaaggaagcttaaaaaaaaaaaaaagcctgcatagctgactcttccagctccctgtgttctattcatacagaacacctaccggtagaaccttatggagtatctttagctggattctaaaatgagattgtctccttaacttgaaatgcatgcaccttgtttctatctaagcaaagcctcaatatcggggactgttgtatgcagtttttaccctaaaaagccactatttatttattatagttttgttgtcaaccatgctgttgcaatttcatttatagcagcccttgtaaaagaagggcatttcccatgctgcta

SEQ ID NO: 178085 - DNA, 601 bp, Human
ttgggtgaaatattccctttctgaaaatgcatttgaacctcaatttcgtgagatgttttgtgtttttctttggcctgaatgaagctcacataggaacttagaagatgaggcttcaaaggctgcatagctgcacaccaacatggcacatgtatacatatgtaacaaacctgcacgttgtgcattgtgtaccctagaacttaaagtataataataaaaaataaataaataaaaaataataaagtttccaggctgggagcggtggctcacgcctgtaatcccagcactttgggaggccgaggcrggtggatcccctgaggtcaggagttcgagaccagcctcaacatggagaaaccccgtctctattaaaaatacaaaattagccgggcgtggtggtgcatgcctgtaatcccagctactcaggaggctgaggcaggagaattgcttgaacctgggaggcggaggttacagtaagccgagatggcgccattgcactccagcctgggcaacaagagcaaaactccatctcaaaaaaaataaagtttcctaaggaagcttaaaaaaaaaaaaaagcctgcatagctgactcttccagctccctgtg

SEQ ID NO: 178086 - DNA, 601 bp, Human
aatttctgtcaaaaaagttggagactcattgagagctaactattccttctgtgctgggcagatgaatgtggaggcccattttgttattcactgatagaacaaataaatatccaggtattatctaatgtctttgttgaaggaccattaattcaagtgtagacatttaataaaaagaagctaagtgctttgcttggtaatatacatttctgagtatggcttagtgagaactacttagcagactgtattgcttcttttgggtgaaatattccctttctgaaaatgcatttgaacctcaatttcrtgagatgttttgtgtttttctttggcctgaatgaagctcacataggaacttagaagatgaggcttcaaaggctgcatagctgcacaccaacatggcacatgtatacatatgtaacaaacctgcacgttgtgcattgtgtaccctagaacttaaagtataataataaaaaataaataaataaaaaataataaagtttccaggctgggagcggtggctcacgcctgtaatcccagcactttgggaggccgaggcgggtggatcccctgaggtcaggagttcgagaccagcctcaacatggag

SEQ ID NO: 178087 - DNA, 601 bp, Human
caatttgccttcagaaatcatgtacagattatttctatcataagagcaacttaaattcttagtgaaaatagattataggttttttctgattataaaactaacatatgcttgctgtagaaaatatggaaaacttggaaaagaaaaaaataaaaatcaccttgggttacaacccttatttttcttgtgtgtttttaaatactgtaacagccctgggtgaaatctgaaaccctgctgtaaggagctgtaagaattgtaatttctaagcagtgagcaatttctgtcaaaaaagttggagactcattgagagctaactattccttctgtgctgggcagatgaatgtggaggcccattttgttattcactgatagaacaaataaatatccaggtattatctaatgtctttgttgaaggaccattaattcaagtgtagacatttaataaaaagaagctaagtgctttgcttggtaatatacatttctgagtatggcttagtgagaactacttagcagactgtattgcttcttttgggtgaaatattccctttctgaaaatgcatttgaacctcaatttcgtgagatgttttgtgtttttctttggcct

SEQ ID NO: 178088 - DNA, 601 bp, Human
attcaatttgccttcagaaatcatgtacagattatttctatcataagagcaacttaaattcttagtgaaaatagattataggttttttctgattataaaactaacatatgcttgctgtagaaaatatggaaaacttggaaaagaaaaaaataaaaatcaccttgggttacaacccttatttttcttgtgtgtttttaaatactgtaacagccctgggtgaaatctgaaaccctgctgtaaggagctgtaagaattgtaatttctaagcagtgagcaatttctgtcaaaaaagttggagactcattgagagctaactattccttctgtgctgggcagatgaatgtggaggcccattttgttattcactgatagaacaaataaatatccaggtattatctaatgtctttgttgaaggaccattaattcaagtgtagacatttaataaaaagaagctaagtgctttgcttggtaatatacatttctgagtatggcttagtgagaactacttagcagactgtattgcttcttttgggtgaaatattccctttctgaaaatgcatttgaacctcaatttcgtgagatgttttgtgtttttctttgg

SEQ ID NO: 178089 - DNA, 601 bp, Human
ctggcattaaatcaggatatccatgggtcagcccagtttctctttttcttagctctatgtgtttattgttagttatctatttagcacaagggtcatggcatccaataattgtaggttatagataatttacataaggcaagttataggaaggagaggagcatcaaaataaatcaggattctatgggttcacacagaacaatcattccaagacactcacctgtgattcttaccttgggccaggtactcaattttcataagtatctggctttttccatatcctggtaatccctcatacattaaracttggctgctgttagatatcaaaaatttcttcatagtatacatgaagtagttgatctctttattacgtcctgttatttttagttttaaaaaagagcaaactcaatcaacgtaaaatagtctagagatataaaaagtcacatagaaaccctccttctaaaaatatccttgggccaggcgctgtggctcactcctgtaatcccagcactttgggaggccgaggtgggcggatctgctgaggtcaggagttcgtgaccagcctggccaacatgatgaaaccctgcctctactgaaaatacaa

SEQ ID NO: 178090 - DNA, 601 bp, Human
gtgaccaccagtgctcacagcccctgtcacgtaccccctggcttactcaatcgatcacgaccctctcatgcagacccccttagagttgtgagcccttaaaagggcagaagttgagcaccttgacgagctcggattttgagacgctagcctgccgattctcccagctgattaaagccactcccttcactatctcggtgtctgaggggttttgtctgcagctggtcctgctacactgtcagctagctggataaacttaagtgtttgttctgcagaccaaatctagccttgatctcaacatctmtgccaattgttctcgatctgtctgaatattgggattacttaggaaactttaaataaccaagcccttcctggcattaaatcaggatatccatgggtcagcccagtttctctttttcttagctctatgtgtttattgttagttatctatttagcacaagggtcatggcatccaataattgtaggttatagataatttacataaggcaagttataggaaggagaggagcatcaaaataaatcaggattctatgggttcacacagaacaatcattccaagacactcacctgtgattcttacctt

SEQ ID NO: 178091 - DNA, 601 bp, Human
ccctctcatattgttttatattgttttatactcagaaaaggacagagaagcgaaactaaaggcaggtagcccggcgcctaagaaccagacccgaaaccaggcctgggcctgcctgacctaagcctggtagttaaaattcgacccctgacctagcaactgttgttatctatagattccacacattgtatggaaggacattgtgaaatctctcgttctgttctgtttcactgtgaccaccagtgctcacagcccctgtcacgtaccccctggcttactcaatcgatcacgaccctctcatgcrgacccccttagagttgtgagcccttaaaagggcagaagttgagcaccttgacgagctcggattttgagacgctagcctgccgattctcccagctgattaaagccactcccttcactatctcggtgtctgaggggttttgtctgcagctggtcctgctacactgtcagctagctggataaacttaagtgtttgttctgcagaccaaatctagccttgatctcaacatctatgccaattgttctcgatctgtctgaatattgggattacttaggaaactttaaataaccaagcccttcctgg

SEQ ID NO: 178092 - DNA, 601 bp, Human
gccaaactctctctgctatccctgtgggtcagcccccgagggccatccagcctccgtctcccaacactaagttcacttcatgtctctcaccacagagaggaaacttaggattccttggagacctgaagtgatgcaatgagcttaagaattttcaagagcttatcaatcagtcagcccttgttcatccccaagcggatgtgtggtggtattgtggtggacctttactgggcactctgccgaataactggagtggcacttatactttagtccagttggctatccctttcaccctggcatttcrtcaacaagagggaggaaaaataagacatcgtaaagcgagagaagcccccttataggtctttcgactctcacgtccatttagacgcaattggagtcccacgaggaataccagatcaatttaaagcttgaaatcaaatagctacaaaatttaagtcaatattttagtgagtgatgttaataaaaatgtaaattagataaattatatctattacaaacaacagcaacaagcttttcatgagttgaaagaaaaactcaggtcggccccagccctggggctacctgacctgacgaaagtgcacac

SEQ ID NO: 178093 - DNA, 601 bp, Human
tggatcaaatattccatctgcacattaaacaaaagcagttgttatgcttgtgcacatggcaggccagaggccctcattgtcccccttccactaaagtggtcctccagtccaccaggcgtgggctgcatggtagctcttttccaggattctacagcctggagtaataagtcatgccaaactctctctgctatccctgtgggtcagcccccgagggccatccagcctccgtctcccaacactaagttcacttcatgtctctcaccacagagaggaaacttaggattccttggagacctgaagkgatgcaatgagcttaagaattttcaagagcttatcaatcagtcagcccttgttcatccccaagcggatgtgtggtggtattgtggtggacctttactgggcactctgccgaataactggagtggcacttatactttagtccagttggctatccctttcaccctggcatttcatcaacaagagggaggaaaaataagacatcgtaaagcgagagaagcccccttataggtctttcgactctcacgtccatttagacgcaattggagtcccacgaggaataccagatcaatttaaagcttga

SEQ ID NO: 178094 - DNA, 601 bp, Human
tctgtacgtagacaattacagctggttttagacccccttcgcccccacagtagttaagagaggcagaaagagaggaagaaacagaggcaaaaggaaagtcaaagagagagagagggagagagagagacagaaagtcaaagagagaaagaaaaatagagagaaatatccaagtagttaagaaaaaaatagtgtaccctattccctttaaaagccaaggtaaatttaaaacctaaaattgataattaaaggtattctccgtaaccctgtaacactctaataccactttgttgttagtgtaaayaagggcgtatcccgaaagcactgaggccttcctatcaaaaatccttaacccagtaacccacggatggcccagatgcattcaatctgtagcagcagctgctttgctaacaggaaaaaaaaaaaaaaagagctgtgggaaggcaaaatttatgtaaaaagagtgttatatggtaaattcttgtcttgaaataaattaactgttgtttaaagaaagaaatatttgtaataagtcagaaagttgagacatgtcaaagaattatctgcgaaagtcatagaaaacgatgttataaaaaatttatgc

SEQ ID NO: 178095 - DNA, 601 bp, Human
aggatttaagggagattacggtgttactatgacactagaaaaacttagaactttgtgtaaaatagactggccaacattagaggtgggttggccatcagaaggaagcctagacaggtcccttgtttcaaatgtatggcacaaggtaacctgtaagccaaggcacacagaccagtttctgtacgtagacaattacagctggttttagacccccttcgcccccacagtagttaagagaggcagaaagagaggaagaaacagaggcaaaaggaaagtcaaagagagagagagggagagagagagmcagaaagtcaaagagagaaagaaaaatagagagaaatatccaagtagttaagaaaaaaatagtgtaccctattccctttaaaagccaaggtaaatttaaaacctaaaattgataattaaaggtattctccgtaaccctgtaacactctaataccactttgttgttagtgtaaataagggcgtatcccgaaagcactgaggccttcctatcaaaaatccttaacccagtaacccacggatggcccagatgcattcaatctgtagcagcagctgctttgctaacaggaaaaaaaaaaaaaaa

SEQ ID NO: 178096 - DNA, 601 bp, Human
cttcactatctcggtgtctgaggggttttgtctgcggctcatcctgctacatttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtcyggacaactaaaacttggtaagactagtctttggaacttgcccactccatttgagtggaagcatggcctgatcacccacggcgtgcctttatcagcacttggttttggttttgacttggtttgaattacttgacaggactggtcttgggaacttgcccactccattcccactccatttgagtggaagcatggcctgatctgatcacccacggtgtgcctgttccggcactttggtttttgtttttgacttgacttagattgcttgatactttggttttggttttgacctggcttggatttc

SEQ ID NO: 178097 - DNA, 601 bp, Human
ggaagtagaatggattgtcccaaagatagccctcataatattccttatatgaaaataaataaacaacatgagacaagtatattagatctgtcttccagggaaaaatccaaagacctcttattctctatctccagtcttaggactaaatggtttgaactagtgattccctgttgagggaagagacagaccctctcatattgttttatactcagaaaaggaaagaaaagtgaaattaaaggcagatagcccggcgcctaggaaccagacccgaaaccaggcctgggcctgcctgacctaagcycggtagttaaaattcgacccctgacctagcaactgttgttatctatagattccagacattgtatggaagggcattgtatggaaggacattgtgaaatctctcgttctgttctgtttcactgtgaccaccggtgctcacagcccctgtcacgtaccccctggcttactcaatcgatcacgaccctctcatgcggacccccttagagttgtgagcccttaaaagggacagaagttgagcatcagacgagctcggattttgagacgctagcctgccgattctcccagctgattaaagccactc

SEQ ID NO: 178098 - DNA, 601 bp, Human
ttgccctcactatattcaacttttaatgctatctgatatggtttggctctgtgtcctcacccaaatctcatcccgtattgcaacccccgagtgtcaggggagagacctgttgggaagtgattggatcatgagggcggttccccccatgctgttctcatgatagtgagggagttctcatgagatttgatggtttaaaagtttggcacttcctcccttgctcgctctctcctgccaccatgtaagacatgccttgcttcccctttgccttctgtcatgattataattttcctgaggcctcccyagccatgtggaactgtgagtcaatgaaacctcttttctttataaattacccagtctcaggtagttctttatagcagcgtgaaaacgactaacacattatctctctcctcctcttctgtgagagctccttgagggcagagagcagactttattgatattcagggctttggcacttgttgacacatgtccccacaattcatatgttaaattcttagcctctagggcctcaaagtgtgaccttatttgaaaagagagtcgttgcagatacaattagttaagatgagatcatgctagagtaggg

SEQ ID NO: 178099 - DNA, 601 bp, Human
cgccaggagagccaggctcggtggctcacgcctgtaatcccagcactttgggaggccgaggagggcggagcatctgagctcaggatttcaagaccagcctgaccaatatggagaaacctcatctctactaaaaatacaaaattagctgggcgtagtggggcatgcctgcaatcccagctactcgggaggctgaggcagaagaatcgcttgaacccgggaggtggaggttgcggtgagccgagatcgtgccattgcactccagcctgggcaatgagagcgaaactaggtctaaaaaacaaacaacaaacaaacaaacaaacaaacaaaaaacaaagaaaaccccaggagaggaatcactgaaaagctcagagagcactcaccagtgagtcagctttccacatctgccatagacagagaacaccaataccagaccacaccattgccagccaggtaagaccttgcttagtggcaggtcatggtctttaacgcttaccagtttgcctttcctgtcacttgcccataacaatgctcttagtcactgcaggttaaagtgagtatacccataccccccatgatgaaagggaaatagagcttttcacta

SEQ ID NO: 178100 - DNA, 601 bp, Human
ggacgccaggagagccaggctcggtggctcacgcctgtaatcccagcactttgggaggccgaggagggcggagcatctgagctcaggatttcaagaccagcctgaccaatatggagaaacctcatctctactaaaaatacaaaattagctgggcgtagtggggcatgcctgcaatcccagctactcgggaggctgaggcagaagaatcgcttgaacccgggaggtggaggttgcggtgagccgagatcgtgccattgcactccagcctgggcaatgagagcgaaactaggtctaaaaaacaaaaaacaaacaaacaaacaaacaaacaaaaaacaaagaaaaccccaggagaggaatcactgaaaagctcagagagcactcaccagtgagtcagctttccacatctgccatagacagagaacaccaataccagaccacaccattgccagccaggtaagaccttgcttagtggcaggtcatggtctttaacgcttaccagtttgcctttcctgtcacttgcccataacaatgctcttagtcactgcaggttaaagtgagtatacccataccccccatgatgaaagggaaatagagcttttca

SEQ ID NO: 178101 - DNA, 601 bp, Human
agacatctttcttccagaagcagggcaacctcattgcagatactaagatgggctgtaaacagccagctaaagaaaaaacattctctatgttgttaaggtgactgctgtcaggacgccaggagagccaggctcggtggctcacgcctgtaatcccagcactttgggaggccgaggagggcggagcatctgagctcaggatttcaagaccagcctgaccaatatggagaaacctcatctctactaaaaatacaaaattagctgggcgtagtggggcatgcctgcaatcccagctactcgggargctgaggcagaagaatcgcttgaacccgggaggtggaggttgcggtgagccgagatcgtgccattgcactccagcctgggcaatgagagcgaaactaggtctaaaaaacaaaaaacaaacaaacaaacaaacaaacaaaaaacaaagaaaaccccaggagaggaatcactgaaaagctcagagagcactcaccagtgagtcagctttccacatctgccatagacagagaacaccaataccagaccacaccattgccagccaggtaagaccttgcttagtggcaggtcatggtctttaacg

SEQ ID NO: 178102 - DNA, 601 bp, Human
cattgctttgttttctttttatttcactcatgtgtgtacacaataagtgtgcacacacttgatttatagtttttaaaacagacattggaaggataagccaaaaactaaccaaaatggttacctataggataagggagggaagcaagactaaggatgtacctttttggctttggaaagatatacatgttctatataatttaaacagagagagggggagagagagagagagaccgacagaaagaatgagtgccaaattggtgcctggagttatcttaaatgagcctttgttcaagacatcttycttccagaagcagggcaacctcattgcagatactaagatgggctgtaaacagccagctaaagaaaaaacattctctatgttgttaaggtgactgctgtcaggacgccaggagagccaggctcggtggctcacgcctgtaatcccagcactttgggaggccgaggagggcggagcatctgagctcaggatttcaagaccagcctgaccaatatggagaaacctcatctctactaaaaatacaaaattagctgggcgtagtggggcatgcctgcaatcccagctactcgggaggctgaggca

SEQ ID NO: 178103 - DNA, 601 bp, Human
gatctgcctgcctcgggctccgaaagtgctgagatttaggcgtgagccaccgcgcccggccatagttagacaatctttagccgagtccagtgagtcccaggcaatgttaagttcgcttacaatctggaatatcggatccagtaattcctggctccccagaaccttctgactctacaggaagcagcctgtggaatagcccatttttgctaccttctctgaatgaagacttaagttaggcagaacagagtaagaaagaaccatcaccgcaggacttactgaacaggttattccaggtcctatctgtcttttcctcagactccgtttgttggaaaacgagtacctcatgatgttccaggtttttaagcaattcttcacagtaaaatggaatcccacagcttccctcccccaggtacctgtagtgaaaacaaggcaatctgtttacattgaagatacatcttttaggaaggaaaaatatgtaagtcttctcaatcacttgaaaataatttcttgtcattcttcatttgtttctgtttgttttcagttttgaggcattgctttgttttctttttatttcactcatgtgtgtacacaataagtgtgc

SEQ ID NO: 178104 - DNA, 601 bp, Human
gagaggcaacagatgcagcacagactgaaacatggatagggacatctgagcatcattcattcacccaggaggcaggggtttttaggaagcaagaggaatcttttttatgaaatttccctcattgtcacctttaggtggtgattttctatcctgctacatagagacagcagcaccataagtcctttattgcaccgtattcacctcatcatgacactgatctcacacctatattcttgtctttaaatttagtcgcagaggaatacgttttgaccctctaggtttagtaatattaatacacgtmgtgcttatagctgttaaatcatcgtattacttaatttgagtcacaaaaaaatgaagaggcttccaattccaggaagagagagttggtatgtttttccctattcctcctgctaaatatagttaaaacccctagacgttatgtgtaaaacaaacagaagatgacattgaaggtggaaagaagtcagaccagctagggaccttaggacccaaggaaaaacgtggcagtgggtcccatggcagggctttctttttgcctcacatgttcaagacttagagcttaagaatctagcaactcagaaac

SEQ ID NO: 178105 - DNA, 601 bp, Human
aatttggccagagaaagtcttctccattttttcatcacaatcatccagaaagaaaaaaaaaattgatctttccttaaaaagcaagctaatgtttcttgttccttaaaaaaaaaaaaggtagagctttgccctgttctctcagacaaccatctgtctcatttctcctacagatgtgcccttgggggccacatggtcctgtagtcatgctattgaacaagaagtgagaggcaacagatgcagcacagactgaaacatggatagggacatctgagcatcattcattcacccaggaggcaggggyttttaggaagcaagaggaatcttttttatgaaatttccctcattgtcacctttaggtggtgattttctatcctgctacatagagacagcagcaccataagtcctttattgcaccgtattcacctcatcatgacactgatctcacacctatattcttgtctttaaatttagtcgcagaggaatacgttttgaccctctaggtttagtaatattaatacacgtagtgcttatagctgttaaatcatcgtattacttaatttgagtcacaaaaaaatgaagaggcttccaattccaggaagag

SEQ ID NO: 178106 - DNA, 601 bp, Human
cttaatttcagttttttaaaattaagacacaaaagacactgaagggttttaaatagagaagacacctgattgtgttttaaaaagctcataacagggccaggtgcagtggctcacacctgtaaacccagcattttgggagcccgaggcgggcagatcacttgaggtcaggagttcaagaccagcctggccaacatggcaaaaccctgtctctactaaaaatatgaaaattagctgggcggtagtggtgcatgcctgtaatccttgctacatgggaggctgaggcaggagaactgcttgagcscaggagacggagattgcagtgagccgagatcgttccactgcaccccagcctgggcgacagagtgagactctgtctcaaaaaaaaaagctcataacggatactacataaacatttattgaacaagtaaacaaagtaaacaaatgtataaaatttagaaatagtatttactctgcagtatttatatttacatatcgctttcctttaatccattggcatcttaatattattataatggaattatttagtctaaaaataataatcatagcagtcattatctatttaatgatccactatcatctt

SEQ ID NO: 178107 - DNA, 601 bp, Human
tgggtgtggaattaagggtgaggttagggttcgacacacacgaaggctgagaaatagatgagtaaatgaaaacaactggggagagagttgtttccaattctggcaagctagcaagaggaaagggttaaggatagaacttgaagaatgtcccaggaggagtagacccaggtagagagccaaggattatctgaggactggtcagagaggggaacaggaggagtgtggggtcaggaaagccaagggaggatagcataccaaaaagggggccgtgtgtgtgtgtgtgtgtgtgtgtgtgtgtgtrtgtgtgtgtgttggggagtaggagagtggggctcaaggatatgacgtggtccatgctattttatgcttatttccccttccaggacctagcattgagacaaccattctttccatcactcaaccagtattaactgattgcctctaggtgctaggaattttcctaggattggggattcaggagagcacaaaactccatgcctcatgaagctcacattctagtgggaaacaaacattaaacaatagataaatacattaaaaggataatctcgtaattcaattatgtgaaagaaataaaagggtg

SEQ ID NO: 178108 - DNA, 601 bp, Human
cctgcctcagcctcccaagtagctgggattacagccgcccactaccatgcctggctaatttctgtagagatgaggtttcaccatgttggccaggctgttctcaaactcctgacctcaagtgatctgcctgcctcggcctcccaaagtgctgggattacaggtatgagccacactgcaccaggccgctggaaaccttattctaagtaaaactgattcatgaaaatctagatgtactcaaaaatgttttgtctccctctgccaaccctgcccaaccaaaagaattggcactattgatgtcttccataggatataaggctttacaaacgtttgattcacagtcagattatcagaatgtattatatatgtattatgtatatacataatgtatatcagaatgtattattatatatatacataaacatatatttgtatgtatacatttacatacccacactcagttacaaacacattctgtgaggcactgtactctaattaggacatagctactatcagagatattttaaatggtgaagtttgaatagtaaatgtgcctagtaatttggtttcctagtactccaaaatgcattatttttctatccct

SEQ ID NO: 178109 - DNA, 601 bp, Human
taaaagggaagaaaagttgagtcattatcctgtcttataaggtctgattttccaatgaactttgagatggatctcatatgaggaagactgggcagagatgtatattggctcaccaaatattctggaaaccttttttttgttttgttttgttttgttttttgtttttttgaggtggagtctctcactgtcgcccaggctggagtgcagtggcgtgatctttgctcactgcaacctccgcctcccaggttcaagcgattcctgcctcagcctcccaagtagctgggattacagccgcccactrccatgcctggctaatttctgtagagatgaggtttcaccatgttggccaggctgttctcaaactcctgacctcaagtgatctgcctgcctcggcctcccaaagtgctgggattacaggtatgagccacactgcaccaggccgctggaaaccttattctaagtaaaactgattcatgaaaatctagatgtactcaaaaatgttttgtctccctctgccaaccctgcccaaccaaaagaattggcactattgatgtcttccataggatataaggctttacaaacgtttgattcacagtcagat

SEQ ID NO: 178110 - DNA, 601 bp, Human
tctgtcacccaggctggagtgcagtggctcactgcaacctccgcctcccaggttcaagcaattctcctgcctcagcttcccgagtagctgggattacaggtgtgtgcctggctaatttttttgtatttttagtagatacggggtttcaccatattggccaggctggtctcaaactcctgaccttgtgatccgcccgcctcggcctcccaaagtgctgggattacaggcgtgagccactgcgcccggccagattttcttaccttttaatgacgttggaggtgacaggtttttcagtctgacrccacttgtgaggtgacagacttcttcactttccttatcactatggagagtaaccatgtttaacttctctgttagcttaatggaatactctacaggggtataaaagggaagaaaagttgagtcattatcctgtcttataaggtctgattttccaatgaactttgagatggatctcatatgaggaagactgggcagagatgtatattggctcaccaaatattctggaaaccttttttttgttttgttttgttttgttttttgtttttttgaggtggagtctctcactgtcgcccaggctgga

SEQ ID NO: 178111 - DNA, 601 bp, Human
gaatatacacagggggaaagatggctcttaggagcaaagccaagcctaccctgagccttctcactgcttcaggcagtacagagcaaacagacaaacaaccaatgttgctgtttttctttttccttttaaaaacagacatcctagagaaagccaaagtggagtttagggactagaaaataaataccaggtcagattttcttttctttttttttttgagatggagtctcactctgtcacccaggctggagtgcagtggctcactgcaacctccgcctcccaggttcaagcaattctcctgcckcagcttcccgagtagctgggattacaggtgtgtgcctggctaatttttttgtatttttagtagatacggggtttcaccatattggccaggctggtctcaaactcctgaccttgtgatccgcccgcctcggcctcccaaagtgctgggattacaggcgtgagccactgcgcccggccagattttcttaccttttaatgacgttggaggtgacaggtttttcagtctgacaccacttgtgaggtgacagacttcttcactttccttatcactatggagagtaaccatgtttaacttctctgt

SEQ ID NO: 178112 - DNA, 601 bp, Human
caatatttcattcttttatgcagatcccagaatatacacagggggaaagatggctcttaggagcaaagccaagcctaccctgagccttctcactgcttcaggcagtacagagcaaacagacaaacaaccaatgttgctgtttttctttttccttttaaaaacagacatcctagagaaagccaaagtggagtttagggactagaaaataaataccaggtcagattttcttttctttttttttttgagatggagtctcactctgtcacccaggctggagtgcagtggctcactgcaacctccrcctcccaggttcaagcaattctcctgcctcagcttcccgagtagctgggattacaggtgtgtgcctggctaatttttttgtatttttagtagatacggggtttcaccatattggccaggctggtctcaaactcctgaccttgtgatccgcccgcctcggcctcccaaagtgctgggattacaggcgtgagccactgcgcccggccagattttcttaccttttaatgacgttggaggtgacaggtttttcagtctgacaccacttgtgaggtgacagacttcttcactttccttatcacta

SEQ ID NO: 178113 - DNA, 601 bp, Human
aatttctcaacttgcccaaaaaacacagtagaaactaagctagtccatcctctttttttttttttgagatggagtctcactcttgttgcccaagctggagtgcaatggctgatctcggctcactgcaacctccgcctcctgggttcaagagattctcctgcctcagcctcttgagtagctgggattataggcacccaccaccatgcccggctaattttttgtgtttgtaggagagatgggatttcaccatgttgaccaggctggtctcgaactcctgacctcaggtgatccacctgcctcrgcctcccaaagtgctgggattacaggtgtgagctactgccttcttacattagtagacacagctaacgaaacataaatggcactcttttgaagactgaggaccttgagatgtccctaggccacctttctaaacattgaaagttgcttatggatggcatgaattggagctgagttcatactaaaacattccttgaaagtcatttttctttaaaagaataataatacatctttctttctttctttctttcttttttgagacagagtttttctcttgttgcccaggctggagtgcaatggcgtg

SEQ ID NO: 178114 - DNA, 601 bp, Human
gcaggccctgccattcctgtgctttgttgacttcctcagctggtccttttgtatcttcttctctgcctcccctttctcctagaaactcctggtttctctctatctgccctagaaatttatgtattctcatgacatacattatcatctctgtgtcatgaccaagtgtcagagagttcacagctcctatcccaacttttcatctaagcttgaatatcggtagctcatgtgactttctggacattttgaccaggatgtccttctgttagggacaaaattagaatttctcaacttgcccaaaaawcacagtagaaactaagctagtccatcctctttttttttttttgagatggagtctcactcttgttgcccaagctggagtgcaatggctgatctcggctcactgcaacctccgcctcctgggttcaagagattctcctgcctcagcctcttgagtagctgggattataggcacccaccaccatgcccggctaattttttgtgtttgtaggagagatgggatttcaccatgttgaccaggctggtctcgaactcctgacctcaggtgatccacctgcctcggcctcccaaagtgctgggatta

SEQ ID NO: 178115 - DNA, 601 bp, Human
tgccattccggaaacaataaaaaatgttagattccactagggttgccagggtcttgatcatcatcttcatattccaacaggggagaatctcaaacaacaactcagtggtgaaggtcaggccaatgatggcagcacatctcaccagcatttggtgggaaagtctcatgctatccagctggatcagagagatttctgcaggtagaaggccacacagtagaaaactagttatttatctttatctaatatgctgtatttaatatagagcaggtggacaaccatcctgctctacagttcttgttgmaagaaactcagccaagctaagtcaaaagaagtatttgtttagtacctaatttgtggatagcacttgtgctgggagtactaaagatgcaggcttatggcctagaaagacacacagcacaatgacctgacaaaattaagatctatttcatggtgttctgattttgtgctaaagtgtgacaagtgtgtgtgaggagaggagaggacattgtaatcactattgtcagaaggagcaggccctgccattcctgtgctttgttgacttcctcagctggtccttttgtatcttcttctctgcctcccc

SEQ ID NO: 178116 - DNA, 601 bp, Human
gctactcacccatcccttcactgggcttcagagacaaggaacgatagtgcacctcaaatgagggatcattctgtttcagggccttttgaagctccttgccattccggaaacaataaaaaatgttagattccactagggttgccagggtcttgatcatcatcttcatattccaacaggggagaatctcaaacaacaactcagtggtgaaggtcaggccaatgatggcagcacatctcaccagcatttggtgggaaagtctcatgctatccagctggatcagagagatttctgcaggtagaargccacacagtagaaaactagttatttatctttatctaatatgctgtatttaatatagagcaggtggacaaccatcctgctctacagttcttgttgcaagaaactcagccaagctaagtcaaaagaagtatttgtttagtacctaatttgtggatagcacttgtgctgggagtactaaagatgcaggcttatggcctagaaagacacacagcacaatgacctgacaaaattaagatctatttcatggtgttctgattttgtgctaaagtgtgacaagtgtgtgtgaggagaggagaggaca

SEQ ID NO: 178117 - DNA, 601 bp, Human
cactccttctagatcttagtctctagatttcccaagaacagttaggataattttaaaatgaagtaggttacttttaaatccatgagacatagccatctttttaatggcatccatgtctaaagcgttgagccgaatattcactgtgaagtgatgatagggaatgaagtccctgcctcggcagtggtcacatctgtgggcatcttcttctaaaaagcgggcacatttcaagtgcatggcttttctctggtccttgagccacagctcgtaggctgttttctgcatcatagggttacagaatcgratcctgtggcactcgatcacctcattctccagttcacgaagctgttcctcttcaccgtgatctggagagagcaaaaagggtttttcagccaggcagtgggcaacagatcagccccttctacctaacataggtcaattctttgatctagatgggtccttaagaggaaattgggtcactccaggtgctactcacccatcccttcactgggcttcagagacaaggaacgatagtgcacctcaaatgagggatcattctgtttcagggccttttgaagctccttgccattccggaaacaataaa

SEQ ID NO: 178118 - DNA, 601 bp, Human
tgtctgacacccatcatgcccatagtgactgagtctttgggtccttacaccccctgaatcctctgctatgttttctcagatcacatggctggttggtattattggcttgtaactttttaacttttgcttctccgatggtcttgaattcttgccctgaaaccaagccctgttttctggagccctgacctgcttagccctggctaattctctctcagtcatgttctttacccactggaacctgtttcaaactagaccaacaaagcaataatattcttatctgccaagaaacaccatgtcatcrtgtcagattgtacccccctttggattccatcctttggtgtgaattaagtgggatattttagtttgagttctggtcacatcccattttgccagagcccctatccccaaaccctccctgacagttatagtgagattggttcgctagactcaatacaggtacattcccttacttttctcttccccattggcctaggctgctgaagtctcatcattctttgtgcccaagccgcttatgagacttgaagccctcaagatccacacccactccttctagatcttagtctctagatttcccaagaac

SEQ ID NO: 178119 - DNA, 601 bp, Human
tcggccatgggattactgttttgtgatacgacatttagggaatttacaaagtctctaaagtttgtcgagtcgatagccttctgaacaggtgaaaaattctgataagagaaatagtagagctgtggcctcactcaggtggaggtgctgatggaagggataccagcagacattattcagagacatttggtcatatatgttccagagctgaactgccagttgattggaaaatctgcaaataactgaaattgtttgctttgatgacactagtcaacctgctcaaggccagctgctcaaactgacstatattctagctgtcagtgtattttagcttattttatcccccaaaataaaacatcaatctaccaaaaaatgcatctatgtatatgtatgtgtgtgtacatgtgtatgtgtgtgtgtatatgtatgactcactgaccccgcacagtcaaatattcttctttcccctttccctcatctctttccatcatttcatctcctactgatactttcattggttctttgaatagggccctgtgtgggatccttcactaaagcttccttaattcaggcagcgcatcttctcggtgctccagtctgtccc

SEQ ID NO: 178120 - DNA, 601 bp, Human
aatttgattttcttaaaaatcagtaaaagcaatgttaatataccatttagtatatggaggtaatgactagaaagaacagctaaattaaaaatgtttgcccctgactggaattactgaaggtgtgtgggacggtcggccatgggattactgttttgtgatacgacatttagggaatttacaaagtctctaaagtttgtcgagtcgatagccttctgaacaggtgaaaaattctgataagagaaatagtagagctgtggcctcactcaggtggaggtgctgatggaagggataccagcagacrttattcagagacatttggtcatatatgttccagagctgaactgccagttgattggaaaatctgcaaataactgaaattgtttgctttgatgacactagtcaacctgctcaaggccagctgctcaaactgacctatattctagctgtcagtgtattttagcttattttatcccccaaaataaaacatcaatctaccaaaaaatgcatctatgtatatgtatgtgtgtgtacatgtgtatgtgtgtgtgtatatgtatgactcactgaccccgcacagtcaaatattcttctttcccctttc

SEQ ID NO: 178121 - DNA, 601 bp, Human
ttggcttatctaatgccagttatatgacaatataggggagaggggccgaggagtggtgtaacagagttaaatcctcatctgccatagccagaaaacagatgtcagaatttgattttcttaaaaatcagtaaaagcaatgttaatataccatttagtatatggaggtaatgactagaaagaacagctaaattaaaaatgtttgcccctgactggaattactgaaggtgtgtgggacggtcggccatgggattactgttttgtgatacgacatttagggaatttacaaagtctctaaagtttrtcgagtcgatagccttctgaacaggtgaaaaattctgataagagaaatagtagagctgtggcctcactcaggtggaggtgctgatggaagggataccagcagacattattcagagacatttggtcatatatgttccagagctgaactgccagttgattggaaaatctgcaaataactgaaattgtttgctttgatgacactagtcaacctgctcaaggccagctgctcaaactgacctatattctagctgtcagtgtattttagcttattttatcccccaaaataaaacatcaatctacc

SEQ ID NO: 178122 - DNA, 601 bp, Human
aaaaaacgtttcctagtaaccctaggaaaaataaacatttgttaagaaatctattcacagtatattacttggtttgtaatggacaacatttacatagtcttaataatgtaaacacttcattggcttatctaatgccagttatatgacaatataggggagaggggccgaggagtggtgtaacagagttaaatcctcatctgccatagccagaaaacagatgtcagaatttgattttcttaaaaatcagtaaaagcaatgttaatataccatttagtatatggaggtaatgactagaaagaayagctaaattaaaaatgtttgcccctgactggaattactgaaggtgtgtgggacggtcggccatgggattactgttttgtgatacgacatttagggaatttacaaagtctctaaagtttgtcgagtcgatagccttctgaacaggtgaaaaattctgataagagaaatagtagagctgtggcctcactcaggtggaggtgctgatggaagggataccagcagacattattcagagacatttggtcatatatgttccagagctgaactgccagttgattggaaaatctgcaaataactgaaa

SEQ ID NO: 178123 - DNA, 601 bp, Human
ttttttgtagagacagagtctcagtttgttgtccaggctggtcttgaaccagccctggcttgaacctggcttcaagtgatccttccacctcagcttcccaaagtgctgggattacaagcgtgagccaccacacttggtcccaattatgtccttgaccagtattgcctaaaggttatactccacactttgggaggttcagggataaaggatagacagagtatctatctgtctaggatagattaaagcaggatattttaaggaagacactgcaaaaaaaaaacgtttcctagtaaccctaggraaaataaacatttgttaagaaatctattcacagtatattacttggtttgtaatggacaacatttacatagtcttaataatgtaaacacttcattggcttatctaatgccagttatatgacaatataggggagaggggccgaggagtggtgtaacagagttaaatcctcatctgccatagccagaaaacagatgtcagaatttgattttcttaaaaatcagtaaaagcaatgttaatataccatttagtatatggaggtaatgactagaaagaacagctaaattaaaaatgtttgcccctg

SEQ ID NO: 178124 - DNA, 601 bp, Human
atcatacctggctaattttcttatttttagttttttgtagagacagagtctcagtttgttgtccaggctggtcttgaaccagccctggcttgaacctggcttcaagtgatccttccacctcagcttcccaaagtgctgggattacaagcgtgagccaccacacttggtcccaattatgtccttgaccagtattgcctaaaggttatactccacactttgggaggttcagggataaaggatagacagagtatctatctgtctaggatagattaaagcaggatattttaaggaagacactgcaaaaaaaaaacgtttcctagtaaccctaggaaaaataaacatttgttaagaaatctattcacagtatattacttggtttgtaatggacaacatttacatagtcttaataatgtaaacacttcattggcttatctaatgccagttatatgacaatataggggagaggggccgaggagtggtgtaacagagttaaatcctcatctgccatagccagaaaacagatgtcagaatttgattttcttaaaaatcagtaaaagcaatgttaatataccatttagtatatggaggtaatgactagaaa

SEQ ID NO: 178125 - DNA, 601 bp, Human
aactaaaactaagactttaggttcaagatgtcagactacctcttgggtttatcttctgtctccccaggttcaggacattttacctaactaaatgagaataaaatgattttttttttttttttttgagacagggccttgttctgtcgctcaggctggagtgcagtggcgccatcatagctcactgcagcctcaacctccctggctcaaatgatcttcccacctcagcctcctgagtagctggggctacaggcacctgccaccacacccagctaatttttttgtattttttgtagagggagakttcatcatgcttctctggtttgtcttgaactcttgagctcaagcaatccacctgtctcagcctcccaaagtgctgggattacaggtgagccactgtgcctggcaagaataaaatgatctctaaaagtataaattcaacatgtatagaatggaagggccacgctcctgtcttagggtcactgcattctctacccctctgcctagaacagtcttccccagccactcacacagcaaaatccctcacttcctctgtctttacatgaatcttgctttgcagtgaagtcacccaaatggctctgcg

SEQ ID NO: 178126 - DNA, 601 bp, Human
atcatattatttttgattctcatttttttcatttacaaaggagatattatattaagagtttcctactacaaggagaatctgtaaaaatcaaaagaaaaaaacatacaaatgcctataggttctcaaatgaaaagagaaaagcaaagatatcacctgcccaccttatggtttcaaagaactaaaactaagactttaggttcaagatgtcagactacctcttgggtttatcttctgtctccccaggttcaggacattttacctaactaaatgagaataaaatgattttttttttttttttttkagacagggccttgttctgtcgctcaggctggagtgcagtggcgccatcatagctcactgcagcctcaacctccctggctcaaatgatcttcccacctcagcctcctgagtagctggggctacaggcacctgccaccacacccagctaatttttttgtattttttgtagagggagatttcatcatgcttctctggtttgtcttgaactcttgagctcaagcaatccacctgtctcagcctcccaaagtgctgggattacaggtgagccactgtgcctggcaagaataaaatgatctctaaa

SEQ ID NO: 178127 - DNA, 601 bp, Human
ttcaagcgattctcctgcctcagcctcccaagtagctgggactataggcgtgtcccaccatgcctggctaattttttgtatttttagtggagatggggtttcactgtgttagctaggatggtctcaatctcctgaccttgtgatctgcctgcctcggcctcccaaagtgctgcaattacaggcatgagcaaccgtgcccaaccagaatcatattatttttgattctcatttttttcatttacaaaggagatattatattaagagtttcctactacaaggagaatctgtaaaaatcaaaagaaaaaaacatacaaatgcctataggttctcaaatgaaaagagaaaagcaaagatatcacctgcccaccttatggtttcaaagaactaaaactaagactttaggttcaagatgtcagactacctcttgggtttatcttctgtctccccaggttcaggacattttacctaactaaatgagaataaaatgattttttttttttttttttgagacagggccttgttctgtcgctcaggctggagtgcagtggcgccatcatagctcactgcagcctcaacctccctggctcaaatgatcttccca

SEQ ID NO: 178128 - DNA, 601 bp, Human
tgtcattatgtcatttattgcttgggtgaatcatattattattactatttttttttttttttggatggagtttcactctgttgcctaggctggagcgcagtggtgcaatcttagctcactgcaacctctgcctcctggattcaagcgattctcctgcctcagcctcccaagtagctgggactataggcgtgtcccaccatgcctggctaattttttgtatttttagtggagatggggtttcactgtgttagctaggatggtctcaatctcctgaccttgtgatctgcctgcctcggcctcmcaaagtgctgcaattacaggcatgagcaaccgtgcccaaccagaatcatattatttttgattctcatttttttcatttacaaaggagatattatattaagagtttcctactacaaggagaatctgtaaaaatcaaaagaaaaaaacatacaaatgcctataggttctcaaatgaaaagagaaaagcaaagatatcacctgcccaccttatggtttcaaagaactaaaactaagactttaggttcaagatgtcagactacctcttgggtttatcttctgtctccccaggttcaggacattt

SEQ ID NO: 178129 - DNA, 601 bp, Human
ccatcttcactacagcaccacctcagtccattaccaaaattttacctggacaactgcaaaaaactaatctcccttctattcctatccttttcaatctctttctgtagagaaggcagtaccatttaaaaagcatgattcagatctctgtggcaggaactgccggtttcccaactcaatctccattgtcccttttctcattagtaatagacagcgacattcttcagcttcccttgcaactggatatagtcatgtgagtaggttctgatcaatgggatgtaagaggaaatactgggtaggactyttagaagatcctttaaaagggaggggatatcctttcatgttttggcttcttttctccttctggcattaaacatgctggctggagcctcagcagctgttttggaccaaggaccctgatgatcatgaagcctccatactagtcccagtgatgaggcaagccttttacatgagaaatacataaatacaatacatttaataataaataaatttaagccacactagctaggtccttattatatgcagccaatactcattctaattgatatatttccaatgtgttccaattcacttagactgaaat

SEQ ID NO: 178130 - DNA, 601 bp, Human
ttctcctttcacaatttctccctaggcagtttcatctgcccatgacttttaattacattcatatgctaatggatttccattttatatatctaagcctcgacatctactttaactacagacccatatattcaaataccaccttggcaactgccatttgaatgtgtaataggcatttcaaaattaacatgattcaaacagaaactctcgaatctctcctccagaaacttatacccacttacaacttttcctaacatagtaagcatcactgtcatatatccattttctcaagacaaaaacctgygcaagatccttgattattttctttttcttacccccttccctattcagtccatcagaaagtcccgttgaccatacccaaaaacatatctgaattcatcgtcttctgtccatcttcactacagcaccacctcagtccattaccaaaattttacctggacaactgcaaaaaactaatctcccttctattcctatccttttcaatctctttctgtagagaaggcagtaccatttaaaaagcatgattcagatctctgtggcaggaactgccggtttcccaactcaatctccattgtcccttttc

SEQ ID NO: 178131 - DNA, 601 bp, Human
cacctcttctcctagattactatttattgattccttagtgactagcagctgaatatattgaattatgaccctgtccccctacttctctaaaactgctgttgttaaagttacctgtggccaccatgttgccacatccaaaggctacatctttgtctgcacttgattacctctcagcagcatttaatacaagtgaccactctcccttttcactgattcttttagcacacattgttttgtgtgttataagggaattggttgcctacttaattggctactattcgtctaccaacattctaaatgktggtaaacctcagtttggtcctgggctccgttctcctttcacaatttctccctaggcagtttcatctgcccatgacttttaattacattcatatgctaatggatttccattttatatatctaagcctcgacatctactttaactacagacccatatattcaaataccaccttggcaactgccatttgaatgtgtaataggcatttcaaaattaacatgattcaaacagaaactctcgaatctctcctccagaaacttatacccacttacaacttttcctaacatagtaagcatcactgtc

SEQ ID NO: 178132 - DNA, 601 bp, Human
agactcttgttcccttttcggagttgttgctgcccagccagaaaccacattgcctagtccccattgcatcttaggtgaagccacgtgatgagttctcacaatagaattagatcagaagtaatatatgtcacctctaggctaagatggttatgtgtcttctctgccttctctttccacaagaaagcaagtaattctaagaacctgaaggatagcaaacccacaagttgggaggagcctgggtcccttgctaactgcatgcaaagccattggtcaacacttgcattggattatttcataaggkggaaataatcactctcttgtgttaatccacagaaatgctggggtttgtgatagctaataacattatcctaactcatttattctgcaataaaaactatgaattaaacctgaagaaagtgacatcaatttccagtggagaaatatagataattaaatgaaataccccaaaaggttaactgaagggcagagaatcttaaattaaaaacctcagtctaagcagacttgaacaggttagaaaattccataatgatcttaaaacagaaaacaaatgaggcttgtctagtccagccatttctccctt

SEQ ID NO: 178133 - DNA, 601 bp, Human
gattctaatagtgttctgaatttaatgacaattatttatgctctacttcctaaacaatgatatatgcctctacctgcgattttcaggaaaaaatgcagatgtctcaggaatctctgagttggacaagataagcttttcttcagctagaaaataaacaaatgagttgtatgggtcattgaaatgttctctgcagtggagatatctgctgtctacccaagactcttgttcccttttcggagttgttgctgcccagccagaaaccacattgcctagtccccattgcatcttaggtgaagccacrtgatgagttctcacaatagaattagatcagaagtaatatatgtcacctctaggctaagatggttatgtgtcttctctgccttctctttccacaagaaagcaagtaattctaagaacctgaaggatagcaaacccacaagttgggaggagcctgggtcccttgctaactgcatgcaaagccattggtcaacacttgcattggattatttcataagggggaaataatcactctcttgtgttaatccacagaaatgctggggtttgtgatagctaataacattatcctaactcatttattctg

SEQ ID NO: 178134 - DNA, 601 bp, Human
agtactggccagacaaatgattctaatagtgttctgaatttaatgacaattatttatgctctacttcctaaacaatgatatatgcctctacctgcgattttcaggaaaaaatgcagatgtctcaggaatctctgagttggacaagataagcttttcttcagctagaaaataaacaaatgagttgtatgggtcattgaaatgttctctgcagtggagatatctgctgtctacccaagactcttgttcccttttcggagttgttgctgcccagccagaaaccacattgcctagtccccattgyatcttaggtgaagccacgtgatgagttctcacaatagaattagatcagaagtaatatatgtcacctctaggctaagatggttatgtgtcttctctgccttctctttccacaagaaagcaagtaattctaagaacctgaaggatagcaaacccacaagttgggaggagcctgggtcccttgctaactgcatgcaaagccattggtcaacacttgcattggattatttcataagggggaaataatcactctcttgtgttaatccacagaaatgctggggtttgtgatagctaataacattat

SEQ ID NO: 178135 - DNA, 601 bp, Human
taaactcaccatgcataccccccaaagtttcccacttgcatctaagaggtcaaaagtactggccagacaaatgattctaatagtgttctgaatttaatgacaattatttatgctctacttcctaaacaatgatatatgcctctacctgcgattttcaggaaaaaatgcagatgtctcaggaatctctgagttggacaagataagcttttcttcagctagaaaataaacaaatgagttgtatgggtcattgaaatgttctctgcagtggagatatctgctgtctacccaagactcttgttcscttttcggagttgttgctgcccagccagaaaccacattgcctagtccccattgcatcttaggtgaagccacgtgatgagttctcacaatagaattagatcagaagtaatatatgtcacctctaggctaagatggttatgtgtcttctctgccttctctttccacaagaaagcaagtaattctaagaacctgaaggatagcaaacccacaagttgggaggagcctgggtcccttgctaactgcatgcaaagccattggtcaacacttgcattggattatttcataagggggaaataatcac

SEQ ID NO: 178136 - DNA, 601 bp, Human
gatgagataagcagatgcaatttctaagaagtaatataaggctttgtcattttctcccaaagccagaaaatggtgggccagaggcaagatgacaatctctaggatttcttcacactggcaagattccagagggataatgtcttcgtcagatgtcttcatttttgttaaaacgtggtcaaagaaattcaagatcttttctcttatttcttcaggactgtccatatgcagaaataaataatagtaacttatacagtatcacttttgatattaaaatatctttaggccagacgcggtggctcaygcctgtaattccagcagtttgggaggccgaagctggtggatcatctgagatcaggagttcaagaccagcctggccaacctggtgaaaccccatctctactaaaaatataaaaattaggccgggtgcggtggctcatgcctgtaatcccagcactttgggaggccaaggcaagtggatcacgaggtcaggagatcaagaccatcctggctaacacggtgaaatcccgtctctactaaaaatacaaaaaattagccgggtgtggtggcaggcgcctgtagtcccagttattcaggaggctga

SEQ ID NO: 178137 - DNA, 601 bp, Human
gggcagatcccttgagctcaggtgttcaagaccagcctgggcaacatagtgtaaccccatctctaccaagaacacaaaaaattagctgggcatggtggcatacgtctgcagtcccagctactcaggaggctgaagtgggaggatggcttgatcccgggaggcagacgttgcagtgagcagagatcgcgccactacactccagcctgggtgacaaagacttcatctcaaaaacaaaacaaaaaaccagaattgcacttatccaaagacctacaggtattttgtgctcacaggtattttaggsttaacagagggtaaatgccacttgaggaagactatgctgagagtcctctctgcatcattttgggaatgagatgtgcccccttacctcccatacaggtagacaattcatggcaagtttctaaaggtggcaatattttaaataatttacaatgctagttgcaatgtattccaattctcttttctcaatcttagatcatttcccttctaagcaatgtgattttcagtggaaaggggtgctgtcgggaatatacaacgtgaagtaatcagaaagcatgctggagcttccttctggctctatgtt

SEQ ID NO: 178138 - DNA, 601 bp, Human
tagcccagccagctgctccatgaaaagagatctaagggcaaataagtttgagaaacacagtatgcttcagcctagcctggcctttacccttctgtgtcctctgaacagatttatatatatatctcagcatatcaaaggccctgaagtatctaaaggcatctatttacctgtattcagctcagtgatttccaacttacttaacaatgaattctgtttatttcatcatgtgtatcaaatcccctcatttctatgggcatagtgccctggaaccttatttataattaccctagagaaacattcrctagtgctttggtggtctaatggtatgtgtaataatctagcacacattgcatgatgacaaaggcagggagagcctctttggggatcacaatattaaaaccagaattggctgggcacagtggctcacacttgtaatcctagcactttggaaggccaaggagggcagatcccttgagctcaggtgttcaagaccagcctgggcaacatagtgtaaccccatctctaccaagaacacaaaaaattagctgggcatggtggcatacgtctgcagtcccagctactcaggaggctgaagtgggag

SEQ ID NO: 178139 - DNA, 601 bp, Human
gagacatgatgagttggccaccagccccagtcccactggagtttgatgggagagggggtacaaatgtcacattctgggaccttgcactgaggctgtgcttctaatcattgtcttcttgtcaagtgaaacggggtatgcataggttttagaaagttggcccccagggctacctaagcctcctcctcctgggactcattggctacatccccatcatcacctcgaatatgtgcatgaaatatgcaggagactttcattcttaacataaatgtttcaaggacaggaacttagtgacatttttaayagtttaattttataattttatataaatctaaggtaggagggttgattaggctgctgtgaccagtagcaactgtaaattatggaaggtctatgaagctcttcctgaagctggctgaagtcagatgaagcaagggcccagaaagacatttcctcaagtgagttcatggaaggttagcccagccagctgctccatgaaaagagatctaagggcaaataagtttgagaaacacagtatgcttcagcctagcctggcctttacccttctgtgtcctctgaacagatttatatatatatctcagca

SEQ ID NO: 178140 - DNA, 601 bp, Human
tgccttacccgaagtttccctcaagccagtttcttcctctcaataattctatccccaacctccctattcccaacaacacatccacttcccttgaacagcatccccacatctgtgagaagttggtcttcagtttttaaatgaattatgaatcacccccacttcctttgccagggtcattttgggaggtggatgaggaagtaagtccctgcacaactctcatcacttcagcttcacctcccaacatcattaggcaaatcttagcacgtgtgcacaccaaggtaagatcagacttgaagaatawaataaggtgaggcagtatctcccagtctcatgcatcctgttgggtatgtgtgggaggcaaaaaaagagggagacatgatgagttggccaccagccccagtcccactggagtttgatgggagagggggtacaaatgtcacattctgggaccttgcactgaggctgtgcttctaatcattgtcttcttgtcaagtgaaacggggtatgcataggttttagaaagttggcccccagggctacctaagcctcctcctcctgggactcattggctacatccccatcatcacctcgaatatgtgca

SEQ ID NO: 178141 - DNA, 601 bp, Human
tctactgaagtaagagatgcaggagccatttcagttaccacctccacttccatccccagctccactgattaaaatgggcttccaaattccagacaggagctgatgggtaaagatctcaccttcatgcttacctttgtctgctggatcactccatcaagagaatgaatctggaaatctccacctttcttcacactatcatctaggttgccttacccgaagtttccctcaagccagtttcttcctctcaataattctatccccaacctccctattcccaacaacacatccacttcccttgaayagcatccccacatctgtgagaagttggtcttcagtttttaaatgaattatgaatcacccccacttcctttgccagggtcattttgggaggtggatgaggaagtaagtccctgcacaactctcatcacttcagcttcacctcccaacatcattaggcaaatcttagcacgtgtgcacaccaaggtaagatcagacttgaagaatataataaggtgaggcagtatctcccagtctcatgcatcctgttgggtatgtgtgggaggcaaaaaaagagggagacatgatgagttggccaccagcc

SEQ ID NO: 178142 - DNA, 601 bp, Human
tcataaaggtgtcaacctgggccgggcacggtggctaacgcctgtaatcccagcactttgggaggtcagggcgggcggatcacttgaggtcaggagtttgagaccagcctggccaacatggtgaaaccccatctctactaaaatacaaaaattagctgggcgtggtggcgcatgcctgtaatcccagctactttggaggctgaggcaggagaatcacttgaacccaggagacggaatttgcagagagccgatatcacgccactgtattccaggctgggcaacacagcaagactccctctcaaaaaaaaaaaaaaaaaaagatgtaaacctggaagacagggaagatcttgctggtaagccatggtgaggaggttggagcccagggatttgagtttctagagtcttggctagaagtctgtggcaagagatgggaggagggtgtagaaagtatagggatgacttctacttctatggaaaggcctaagatatataacagataaattcaagtctttaatggtttcttacctcacctttgaggctgtaaaaggtggcagactcaaatgtctggctccaagatttgtccttcttgagagtttttagc

SEQ ID NO: 178143 - DNA, 601 bp, Human
ccctcccaacttcctgcctttgcttcaagttgtcccacctttccagaccaatgtacttcttacatatgttgattgatgtctcctgtctccccaaatgtataaaattaagctgtgccccgaccaccttgggcacatgtcgttaggacttactgaggctgtgttacaggcgtgtcctcaaccttggcaaaataaactttctaaattatgatgtggaaatgattttttttaaaggttcttaggaaacatggacagggtaaaatctctctctcttttttttttgagacggagtctcgctttatcrcccaggctagagtgcagtggcgcgatcttggctcactttaacctccacctccctggttcaagcaattcccctgcctcaaccttccgagtagctgggattacaggtgcacgccaccacgcctggctaaattttttctgtatttttagtagagacgggatttcaccatgttggccagactggtctcgaactcccaacttcaggcaatccgcccccctcagcctccctaagcgttggtattacaggcgtgagccacaacacccagccctgggtaaaatctcttatagggcattcgtgagggtc

SEQ ID NO: 178144 - DNA, 601 bp, Human
gtttttggtagagatggggtttcgccatgttggccaggctggtcctgaacccctgacctcaggtgatccgcctgcctcagcctcccgaagtgctgggattgcaagcgtgagccactgcgcctggccaaaaaatgagcatttttaactattgcattttgaaaggaaaatatcttgggcccccaaaatcactaaggaaaactcaagctggaaactgcttagggcaaacctgcctcccattctattcaaagtcactcctctgccctttgacatagatgcatatctgatttgcctcctttggaarggcgaatcagaaactcaaaagaatgcaacttttgtctcacctatctgtgacctggaagctccctcccaacttcctgcctttgcttcaagttgtcccacctttccagaccaatgtacttcttacatatgttgattgatgtctcctgtctccccaaatgtataaaattaagctgtgccccgaccaccttgggcacatgtcgttaggacttactgaggctgtgttacaggcgtgtcctcaaccttggcaaaataaactttctaaattatgatgtggaaatgattttttttaaaggttcttagg

SEQ ID NO: 178145 - DNA, 601 bp, Human
ttcactatgccaaaaggaaaaaattaagctgaaagctgagtcatgcaagaagttgcctttccttttgttccttagcagacagctacagataaaaagttaagtatctgcacgggtagctactctatgtctgccttatcctaccttaagtgcctatttactgagtgtgagacaatacataattgactattcccctagctgctcctattctcttgcaacatgtggattattatcacgccctccctcattttcctccagcccacttttcccctttaaatactgcagtctcaaacagggactgttyctgtggttttgtgtttttttttcttctgggcatgtccttaaccttggcaaaataaacttacagattgattgatacctgtcttgggtactttttagtttacaaaaaaaaaaaaaaagaggattttttgttttttgagcctcgctctgttgtccaggttggagtgcagtggcatgatctcagctcactgcaacctctgcttcccaggttcaagcgattctctttcctcagcctccccagtagctgggattacaggcacacaccaccatgtctggctaattattttgtgtttttggtagagat

SEQ ID NO: 178146 - DNA, 601 bp, Human
aaagacacacagctggaatgtggtggtgccaggattcaaactccatctacctccagcccaaaagcccaatgtattattttctccattgcacactgctttcaggaactacttctcagctcaacaaaggtgtgaaaggaaaataaaaactcaggatcccaattcactatgccaaaaggaaaaaattaagctgaaagctgagtcatgcaagaagttgcctttccttttgttccttagcagacagctacagataaaaagttaagtatctgcacgggtagctactctatgtctgccttatcctacsttaagtgcctatttactgagtgtgagacaatacataattgactattcccctagctgctcctattctcttgcaacatgtggattattatcacgccctccctcattttcctccagcccacttttcccctttaaatactgcagtctcaaacagggactgtttctgtggttttgtgtttttttttcttctgggcatgtccttaaccttggcaaaataaacttacagattgattgatacctgtcttgggtactttttagtttacaaaaaaaaaaaaaaagaggattttttgttttttgagcctcg

SEQ ID NO: 178147 - DNA, 601 bp, Human
atctttttaaaaaagaattatcctttaacatttttctctttcaccctcattctctcatgaatatacactggagtcttccagaggcaacatatgtgatactgcaacagtgaaagcagaagcagatgtgagaatctagttgtcttctaagaagccagatgttaaaatattggcaaaaatttaatacaatgccacatttcccattttttgtttgcggaacagagttttaaaaaatgaaaatggtaattatgttaatatgtaataggcttgttatctttattttaaaataatattttaggccagrtgcagtgcctcacgcctgtaatcccagcactttggaaggccagtgtgggcagatcacttgaggtcaggagttcaagaccagcctggccaacatggtgaaaccccgtctctactaaaaatacaaaaattagctgggtgtggtggcgcatgcctgtagtcccagctactcaggaggatgaggcaagagaatctcttgaacccgggaagtggaggttgcagtgagccgatattgtgccactgcactccagcctgggtgacagagcaagactccatctcaaaaaaaaccagcaaaaataataat

SEQ ID NO: 178148 - DNA, 601 bp, Human
cgcccacctcggcctcccaaagtgctgggattacaggcataagccaccatgcccggcctgctgatttaatgtacttttataaaggagcaaggtcactctcattagatgagtttgatttagcttaataatttcttgatcatgtctcctgatatcttcttcatccagtcaaaggcttctttggttatgacctagactagtggttctcccaattcatcctgggagccctagggatccgtggcaccttttcagagaccacatgaggtcaaagctagttccataatatctaggcattttaaatttaaaaaaaaaatttttttttttgagttggagtctcgctcttgtcatccaggctggagtgcaatggtgtgatctcatctcactgcaacctctgcctcctgggttcaaacaattctcctgcctcggcctcctgagtagctgggattacaggcacccaccaccacactcagctaatttttgtatttttagtaaagataggttttccccatgttggccaggctagtctcgaactcctgacctcacgtgatccgcccacctcagcctcccaaagtgctgggattacaggcgtgagccaccatgcccc

SEQ ID NO: 178149 - DNA, 601 bp, Human
aggaaccaaaagaggaccaatatggctgggcttgtggctacttcatggcctacagagctagaagaggatgggaaataggcaggggtcaatcttgatgggctttataaatacttctgtattctaggagagccagcctaaattcaccaaaaggaactaatgtagaggacagactccaggttaggaatctaagctcctccaacagtagctccttggtgctacttgaccccttcccttaattcttgacaactaatgactccaggaggaagaaacccagacttaatgtactttttttttttttccygagatggagtcttgctctgtcgcccaggctggagtgcagtggagtgatctctgctcactgcaagctccacctcctgggttcacaccattctcctgcctcagcctcccgagtagctgggactacaggcgcccgccaccacgcccggctaatttttttttttttttttttgtattttcagtagagacagggtttcaccgtggtcttgatctccttaccttgtgatccgcccacctcggcctcccaaagtgctgggattacaggcataagccaccatgcccggcctgctgatttaatgtactt

SEQ ID NO: 178150 - DNA, 601 bp, Human
gaccctgtttcaacaacaacaaaaactagccaggcatggtggcatatgcctgtagtcctacctactcaggaggctgagacgagaggtcacttgagcacaggagtttgagcccagcctgggcaatatagtgagacctgatctctacaaaagattttaaaaaaaagtagccagcatgatgacacaagcctgtaatcctagctactcaggaagctgaggtgtttgggaggatcacttgagcaggggaggttgaggctgcagtgagccatgatcacgccactgcactccagcctgggtgactgastgagacccttctcaaaaacgaacaaacaaataaatctaatttgcagatttaagagaaactggttactctaaacaactctttaaaaagataaagttgcttcagagtatacatgcttagagaatagtgaggagaaaagggttccttctaaagaagcagttttattatatatacaaaaacaaaataatacatgtaaactactttgaaaaatacaaacaggaaaaataaagtatctctagtggtgggagtattggggtcggggaagtgttttagagtagaggcttttttcttggaattcctcag

SEQ ID NO: 178151 - DNA, 601 bp, Human
ttttttttttaaataaggactagttttaaacctaatttggaggtcaggtgcagtggctcacatctataatcccagcacttctggaggccgaggcaggaggattgcttgagctcaggagttccagatgagcctgggcacaatagtgagaccctgtttcaacaacaacaaaaactagccaggcatggtggcatatgcctgtagtcctacctactcaggaggctgagacgagaggtcacttgagcacaggagtttgagcccagcctgggcaatatagtgagacctgatctctacaaaagatttwaaaaaaaagtagccagcatgatgacacaagcctgtaatcctagctactcaggaagctgaggtgtttgggaggatcacttgagcaggggaggttgaggctgcagtgagccatgatcacgccactgcactccagcctgggtgactgagtgagacccttctcaaaaacgaacaaacaaataaatctaatttgcagatttaagagaaactggttactctaaacaactctttaaaaagataaagttgcttcagagtatacatgcttagagaatagtgaggagaaaagggttccttctaaagaagc

SEQ ID NO: 178152 - DNA, 601 bp, Human
ttggccgaagccatgggcttagaaatagaaatcaaattgggtttctgctacctgtttactgagtcattcaggataagcttgatggccccttgcccatgtagtccttaaatgaaatataaaaattttaatttctgtgaaaaataaaagcaatagcttacatattagatgtataattgcagagcaaaaaggctgcaaagatacactccaaagtgtaaacagtagttatatatttgttgggggtgggaggagagattttactttatgcacctctgtgatgtttgttataacaagcatgtataayttttgtaatttaacaaaaaagaaagaaaggttggttttgtttgtttggctttttttttttttttaaataaggactagttttaaacctaatttggaggtcaggtgcagtggctcacatctataatcccagcacttctggaggccgaggcaggaggattgcttgagctcaggagttccagatgagcctgggcacaatagtgagaccctgtttcaacaacaacaaaaactagccaggcatggtggcatatgcctgtagtcctacctactcaggaggctgagacgagaggtcacttgagcacag

SEQ ID NO: 178153 - DNA, 601 bp, Human
agtggaggaagagtgaggcagaacgcaaagcagaaagctcaggaacatcactcaatgtctgccagtaaatgtttgtttattaagtttgggaatagagctggacatttggccgaagccatgggcttagaaatagaaatcaaattgggtttctgctacctgtttactgagtcattcaggataagcttgatggccccttgcccatgtagtccttaaatgaaatataaaaattttaatttctgtgaaaaataaaagcaatagcttacatattagatgtataattgcagagcaaaaaggctgcaargatacactccaaagtgtaaacagtagttatatatttgttgggggtgggaggagagattttactttatgcacctctgtgatgtttgttataacaagcatgtataatttttgtaatttaacaaaaaagaaagaaaggttggttttgtttgtttggctttttttttttttttaaataaggactagttttaaacctaatttggaggtcaggtgcagtggctcacatctataatcccagcacttctggaggccgaggcaggaggattgcttgagctcaggagttccagatgagcctgggcacaat

SEQ ID NO: 178154 - DNA, 601 bp, Human
cagctgggatgactgtctgactaccctctgatcactggccagagcaaccagattagagatgatgcatggcaaagaattctgtttaaaataaaaaagacaaggcctggcgcagtggctcatgcctgtaatcccaacactttgggaggctgaggtgggtgggtcacttgaggtcaggagttcaagaccagcctggccaacagggtgaaaccccctctcttctaaaaaatacaaaaattagctgggtgtggtggcacgttgcctgtaatcccagctacgtgggaggttgaggcaggagaattgyctaaacccggaaggcagaggttgcagtgagccaagattgcactactgcactccagcctgggagacagagcaagactctgtctgaaaaaagaaaaaagggtgactactatcagttacattttcttactgcaaactctactcccttccccaccctaggactaggctaaagttgaacccagaatactcaataatacggcctcctccccctaattttggaaaatgctttaagataaatacctgctgttcagaaggagacatctgctaagtctgcagagggactgataatgtcggttgggattct

SEQ ID NO: 178155 - DNA, 601 bp, Human
ccaaatatacctcttaaacagatttcaaacacacccctatccaggactaaaacctcaatctcaaattggctcttttttcaaattgttctttcctgggtcctctatatcagggtgaccagagtcagagcaaattggccttgacctctagtcctggttgctattctctggccatttgcctccctggaagacttttccctttgtctccacctgacagaagtggaggcctgattcccacagctgggatgactgtctgactaccctctgatcactggccagagcaaccagattagagatgatgcawggcaaagaattctgtttaaaataaaaaagacaaggcctggcgcagtggctcatgcctgtaatcccaacactttgggaggctgaggtgggtgggtcacttgaggtcaggagttcaagaccagcctggccaacagggtgaaaccccctctcttctaaaaaatacaaaaattagctgggtgtggtggcacgttgcctgtaatcccagctacgtgggaggttgaggcaggagaattgtctaaacccggaaggcagaggttgcagtgagccaagattgcactactgcactccagcctgggagaca

SEQ ID NO: 178156 - DNA, 601 bp, Human
tgcaccactgcactccagcctgggcaaaagagcgaaactccatctcaaaaaaaaaaaaaaaaaaaagcagtggatataatggactttggggcctcggaggggaggggaggagggaagtgaggaataaaagactacatgttgggtatgtgtacactgctcgggtgacaggtgcactaaaatctcagaattcacctctataaaattcatctatgtgaccgaaaaccatttatacccccaaagctattgaataaaaaaagcagtggataggatgaggttcagtaaagtcccttcctggtctagycttggtccttctcagtaattcggaaccaaatatacctcttaaacagatttcaaacacacccctatccaggactaaaacctcaatctcaaattggctcttttttcaaattgttctttcctgggtcctctatatcagggtgaccagagtcagagcaaattggccttgacctctagtcctggttgctattctctggccatttgcctccctggaagacttttccctttgtctccacctgacagaagtggaggcctgattcccacagctgggatgactgtctgactaccctctgatcactggcca

SEQ ID NO: 178157 - DNA, 601 bp, Human
taatcccagcactttgggaggctgaggtgggtggatcacgaggtcaggagttcgagaccagcctggccaacatggtgaaaccccatctccactaaaaatacaaaaattagctgggcatggtggcgggcgcctgtaatcccagctacttgggaggctgaggcaggagaatcgcttgaaaccagaaggcggaggttgtggtgagccaataatgcaccactgcactccagcctgggcaaaagagcgaaactccatctcaaaaaaaaaaaaaaaaaaaagcagtggatataatggactttggggsctcggaggggaggggaggagggaagtgaggaataaaagactacatgttgggtatgtgtacactgctcgggtgacaggtgcactaaaatctcagaattcacctctataaaattcatctatgtgaccgaaaaccatttatacccccaaagctattgaataaaaaaagcagtggataggatgaggttcagtaaagtcccttcctggtctagccttggtccttctcagtaattcggaaccaaatatacctcttaaacagatttcaaacacacccctatccaggactaaaacctcaatctcaaat

SEQ ID NO: 178158 - DNA, 601 bp, Human
tatggaaaagaaaaggtagtggccattaaaaagtggtggatattgtaatcccagcactttgggaggctgaggtgggtggatcacgaggtcaggagttcgagaccagcctggccaacatggtgaaaccccatctccactaaaaatacaaaaattagctgggcatggtggcgggcgcctgtaatcccagctacttgggaggctgaggcaggagaatcgcttgaaaccagaaggcggaggttgtggtgagccaataatgcaccactgcactccagcctgggcaaaagagcgaaactccatctcaaaaaaaaaaaaaaaaaaaagcagtggatataatggactttggggcctcggaggggaggggaggagggaagtgaggaataaaagactacatgttgggtatgtgtacactgctcgggtgacaggtgcactaaaatctcagaattcacctctataaaattcatctatgtgaccgaaaaccatttatacccccaaagctattgaataaaaaaagcagtggataggatgaggttcagtaaagtcccttcctggtctagccttggtccttctcagtaattcggaaccaaatatacctcttaaacag

SEQ ID NO: 178159 - DNA, 601 bp, Human
gaaagctcccacagccgccccagcacctggatcaattgcgggtatctatggaaaagaaaaggtagtggccattaaaaagtggtggatattgtaatcccagcactttgggaggctgaggtgggtggatcacgaggtcaggagttcgagaccagcctggccaacatggtgaaaccccatctccactaaaaatacaaaaattagctgggcatggtggcgggcgcctgtaatcccagctacttgggaggctgaggcaggagaatcgcttgaaaccagaaggcggaggttgtggtgagccaataaygcaccactgcactccagcctgggcaaaagagcgaaactccatctcaaaaaaaaaaaaaaaaaaaagcagtggatataatggactttggggcctcggaggggaggggaggagggaagtgaggaataaaagactacatgttgggtatgtgtacactgctcgggtgacaggtgcactaaaatctcagaattcacctctataaaattcatctatgtgaccgaaaaccatttatacccccaaagctattgaataaaaaaagcagtggataggatgaggttcagtaaagtcccttcctggtctagc

SEQ ID NO: 178160 - DNA, 601 bp, Human
gttggttcctgtggtttagtgtgtacacttcaagtgacctacttggtgtcacttgaaggttatcaggaagtaacttattttccaaatcaccaatagctaccagcctggaactctcacctcaagcaatctagtccttcattctaaagcgtgaagtctctaagtacatcctgctaaaagttaaaaacccctggtaaaaggcacatagtaagacagtcagccactatcacttaggtgcaaattgatctgacagtttaactggcagctcatatccatcaggttccttcagacttaattctccttyttgccgtgcctttacaatctcggcaccttctagacagtgcttcagctcacacaaccagcctctctccatccctgccctgtaagtccaccagccagaaacctagtggtcccaaagccccaacctgagagctgccacaccacaccagcacaggtatcaacacccccaagttcttttacatcccaaacccacacttaccagaataaagcaggatgtccaagcagacaaaatagaaaaatgccttgctgaagatgtgttcctgtgttacagaaagctcccacagccgccccagcacctggatca

SEQ ID NO: 178161 - DNA, 601 bp, Human
aataaaataatagggggcgattttcagtcttggggatagtcatggaaataatttaatgaatgttctgttctgacccattttagaaccttagcattcatctccttccttaagggtatgaccataatagctacatgcttaactgagttaaaaacgtagtaggttaaaggaattgagccttaggcttaatgagttaatggggtgcggggagaatgctgcttcctcactcctgaaatttccttccatgtaaggggcctctatttggtgcaaagcaccagaactctttccccgctttacttgcccyttcaatgataaggagagatcttgctggtgatttgggagatgaattgggcaagtataactcagtccgtgtctctctctatcttgagagccagtgaagccaacagggagtgtgatactgatctctctgctacaagaggcctgcctccatgtgagtagacctacagttttccagaactgcctgctgctgaatgggttaagtctaattccagtgctcaatattacgaagcccgctttcgtgaagatataagccatgtcttccaacattggctttgtcaatccatgtgattagatatgggcaggt

SEQ ID NO: 178162 - DNA, 601 bp, Human
tagacaagaaaaataaatttggatgatttctggactttagattccttaacctttaactcacattggtaagttatttgattttgaactttaattggcaagagtaatcaatttttggattttaatttctcctcattaattttaataataagaggggatttcttgccaggtgcagtggctcatgcctgtaatcccagcatttgggaaggctgaggtagacgggacctgagcccaggagttggagaccagcctgggcaacatcacgacatcccatctctacaaaagattaaaattagccaggcgwggtggtatgtgcctgcaactccagctactcaggaagctgaggtgtttgggaggatcacttgagcctgggaaggcgaggctgcagtgatccgcgatcgcaccacgggactccaacctgggtgacacagcaagactgtctcagaaagaaggaaggggtggatttctattccaatttggagctgttctaacttgtagcattttatataggaatgtcttcatattgtcatttagtctcatcacaaacctctgatagaccatacggttgcatataattaagataggaaataaaataatagggggc

SEQ ID NO: 178163 - DNA, 601 bp, Human
ttgccactaacaaagtggatgactctccttgggactttcttcttttttcctatgactcccagttctacgtttcaaagcctctttcgttactcatccttgagataaaatttggctatggttgtcctgacatcaacgtttccttttggaccatgactcagctttttggatcccttaatttcctgccccgcagattccccgaatgccgcggcggccgcagctcccgaggctgcgacggcttctcctcgttccacagggcccactggctcctggtccatcgtcgtcgccaccacagggctgctgrcgccgcagcgccggccgcctagccaagtctctgggaaggggactagccggccttgaggggcggggccggccagaggggcggggccagcccgcgcctcgcctagcccgcctggctcagcaccccgagagctggccgactgccctccaggtgatttttatgcccactaaagtctgagcagcattggcctaggacacagctgtttaaaaaattctcctgctgagatagacaagaaaaataaatttggatgatttctggactttagattccttaacctttaactcacattggtaagttatttga

SEQ ID NO: 178164 - DNA, 601 bp, Human
tgctcaaaatgtagtccacagactggcatcatcagtatcacctggattctcattaatgcaggttctctggttcagtccaggtctactgaatcagacaggctctgggggtgtggcatctctgagttaacaagctctccaggtgattttttttttaacccttcaaagtaattaaaaataagacatttattccaacaattcttacattgcatgaaatacctctttaatagtctacctgcatttggaactaccttcagagtatatggtacaatcctttgaatattttctgtgtagaaaatccgatttttttttttttttttttttagatggagtttcacccttgttgaccaggctggagtacaatggcacgatctcagcccactgcaacctctgcttccctggttgaagcaattctcctgcctcgctgggattacaggcgcctgccatcacgcctgcctaattttttatatttttagtagagacacggtttcaccatattggccaggctggtctcgaactcctgacctcaggtgatccacccacctcagcctcccaaagtgctgcgattacaggcgtgagccactgctcctggcctgcttatgat

SEQ ID NO: 178165 - DNA, 601 bp, Human
ggattctggggcttgaagaaattgttccaataccaaagagagatgatttaggccagtactgctcaaaatgtagtccacagactggcatcatcagtatcacctggattctcattaatgcaggttctctggttcagtccaggtctactgaatcagacaggctctgggggtgtggcatctctgagttaacaagctctccaggtgattttttttttaacccttcaaagtaattaaaaataagacatttattccaacaattcttacattgcatgaaatacctctttaatagtctacctgcatttgraactaccttcagagtatatggtacaatcctttgaatattttctgtgtagaaaatccgatttttttttttttttttttttagatggagtttcacccttgttgaccaggctggagtacaatggcacgatctcagcccactgcaacctctgcttccctggttgaagcaattctcctgcctcgctgggattacaggcgcctgccatcacgcctgcctaattttttatatttttagtagagacacggtttcaccatattggccaggctggtctcgaactcctgacctcaggtgatccacccacct

SEQ ID NO: 178166 - DNA, 601 bp, Human
gacacttggagctgtggattctggggcttgaagaaattgttccaataccaaagagagatgatttaggccagtactgctcaaaatgtagtccacagactggcatcatcagtatcacctggattctcattaatgcaggttctctggttcagtccaggtctactgaatcagacaggctctgggggtgtggcatctctgagttaacaagctctccaggtgattttttttttaacccttcaaagtaattaaaaataagacatttattccaacaattcttacattgcatgaaatacctctttaataktctacctgcatttggaactaccttcagagtatatggtacaatcctttgaatattttctgtgtagaaaatccgatttttttttttttttttttttagatggagtttcacccttgttgaccaggctggagtacaatggcacgatctcagcccactgcaacctctgcttccctggttgaagcaattctcctgcctcgctgggattacaggcgcctgccatcacgcctgcctaattttttatatttttagtagagacacggtttcaccatattggccaggctggtctcgaactcctgacctcag

SEQ ID NO: 178167 - DNA, 601 bp, Human
cctgggtctctggaagtgtgtagtctcctgcctacccctgcttcacactccctaaaaaagcaggaaattatgtgatacagagcaaggaaataataaatttttttgatgacttgagatgaatagaatccttggaaacactcaggtaatattagccaccattgaactctttggctttggctttttttctttttttgagacgaagtcttgctcttgtcccccagtctggagtgcaatggcacaatcttggcttactgcaacctctgcctcctgggttcaagtgattctcctgcctcagcctccygagtagctgggactacaggtgtgtaccaccacgcccagctaattttttgtattttaagtagatacggggtttcaccatgttggctaggctggtctcgaactcctgacctcaggtgatccacccgccttggcctcccaaagtgctgggattacaggctgtgccaccatgcccggccactttggctttttaaattaaaaagtgagggagatcagacacttggagctgtggattctggggcttgaagaaattgttccaataccaaagagagatgatttaggccagtactgctcaaaatgtagt

SEQ ID NO: 178168 - DNA, 601 bp, Human
tgaaatgttttccaaattaaggtcaaacaccaaaccacagatccaggaagctcgcagaacaccatgtaggatatatgccccaaaaccccaacacataggcatataatttgtaaactacagaaaatcaaagataaaaaattttaggtcaggcacggtggttcacacctgtaatcccagcactttgggaggcagaggtgggcaggtcacttgaggtcaggagttcaagaccagactggccaacatggtgaaaccctgtctttactaaaaatacaaaaattagtcaggcatgttggcgggcacytgtaatcccagctactcaggagtctgtggcaggagaattgcttgaacccaggaggtggaggttgcagtgagtcaagatcacgccactgcactccagcctgggtgacagagtgagactccatttcaaaaaaaagagaaaaacaaaaagttttaaagaagcccaagggacttctataaaggaacaacaacaaaaaaagaattgcctttcacttttcctcagaaaccatgcaagcaagaagacagtgccatgacctgttgacaggaaaaaaatccctagaattctttacccagtgaaattatc

SEQ ID NO: 178169 - DNA, 601 bp, Human
tcatgcctgtaatcccagcactttgggaggccgaggtggtcggatcacctgaggtcaggagttcaggaccagcctggccaacatggtgaaaccccatctctacaaaaatacaaaaattagccaggcatgatggcgggtgcctgtaatcccagctactcgggaggctgaggcacgagaatcacttgaacctaggagacggaggttgcagtgagccgagatcacgccattgcactccagcctgggcgacagagtgagactctgtctccaacaacaacaacaacaaaaattagacaaaaaaaamccccaaacaccttcaggtgagcccccacagttttgtgtgttttacctccagaagctcaaccaggatctctcagtaaatattggaggaaaaaaaatctctcattctttcagcagaggaagaggaaaaggaaccattttgaaatatgccagagtactccgtttttctaaacaaggtgtgccctcaggagaaactatgtaaccagagcctaacctccaggggttttactagagtctaactgatcttggggaagaggaatacccaactaaacccagttctagccattatgtcccacctaaggaa

SEQ ID NO: 178170 - DNA, 601 bp, Human
aaaggtagaaatagacagttctataatagtagttggagacttcactaacagtcaataatggatagaacaattatacaaaagataagacacagaggacttagacaacacaataaaccaactaaatataacaaacatacacttaatgggtatagagttgttgtttgacaagatgaagagagttatggagatggagggcagacatggatacacaacattagaaatgtatttcataccactgaactgcatacttaaacatgattaaaatgttaagttttatgctatgtgtatttggatcacaataaaaaaaaattaggccacacgtgggctcatgcctgtaatcccagcactttgggaggccgaggtggtcggatcacctgaggtcaggagttcaggaccagcctggccaacatggtgaaaccccatctctacaaaaatacaaaaattagccaggcatgatggcgggtgcctgtaatcccagctactcgggaggctgaggcacgagaatcacttgaacctaggagacggaggttgcagtgagccgagatcacgccattgcactccagcctgggcgacagagtgagactctgtctccaacaacaac

SEQ ID NO: 178171 - DNA, 601 bp, Human
aaccaagagtcttctattcagcaaaagcgtccttcgaagataagggagaaattaagacattcccagacaatcaaaaacaaagttaattaccaccaggactttcttccaaaaaatgcccacgccttaaaaaaaagaaagaaaagaaaagaaagaaagacaagaaatacctaaaggagccctgtagggtaaaatgaaaggacagtcaaagctctaagaagaaataaagatctcaacaaaggtaaatacatggacaattaagtgttattgtaataacagtttgtaacttgttttgttttctacrtttttaagagattaatacgtttttaaaatttagtagcccaaaagctagtagtattgtaactttgggttgtaactccacagtttgttttctacataattgaagagactgatcatttaaaataattattcatttatgttttggggcatataatgtacaaaaatgtaattctgtgacatcaacaactgaaaggggtgggaagctattaaaggagtggagttctttgtgcattactgaagttaactttaggatgctaaatgtaatcctcatggtaaccataaggaaaatagctatagaatatat

SEQ ID NO: 178172 - DNA, 601 bp, Human
aaataatggaaataacagtaaagtgacagaaaacctaaaaatataccaaaaagaaattctggaggtgaaaactgcaataactaaaatttaaaaaaatcactagagggattcaaaggcagaattaaacagggagcagacttgaagataagacaatggaaattattgagtctgatgaacagaaagaaaaaagattgaagaaaagttaacagagcctaagggacttgtggaacaccaagaagtgaaccaataaatgcattgtggaagtccctgaagaagaagagagagagaaaggactagaaakaatatttgaagaaataatggttaaaaactttccaaatttgataaaagacatgaatataaacatccaagaagctcaacaaactccaagtaagataaacttaaagagatacacactgagacaaatataatcacttttgaaaagtgaaagacacaaaacttgaaagcagtgagagaagcaactaatcacatacaagacatcttcaataagatcatgagcagatttctcatctgaaaatttagaggtcagaaggcagtgggccaatacattcaaaatattaaaaaaacaaaaaaaaacccgtca

SEQ ID NO: 178173 - DNA, 601 bp, Human
aacctgcgtacaacttgtgggaacaagggtgggcaaaaaggaccctgtctgagatatcagggatctgtgctctgatcaccaattgctgcttctgatggaagaggtaggcagtcattgttgcacctctccccgtcattgcaagcccctcccactccagttgaagtgacttccagtggatttaaagggctattgccctttcctcccccaactttatttttttctccacccaccctccaccaccttgacagccagacattaaatactaggacattcaaaagcaactgcctataaaaggaaaatyagaaagtgactgtgcatgcctagggaaaggcacaggctcagaaaagatctgggaagaccttaagtttgcacctcaggctgatccttggcatagagacagcctacaacaataaaaaacaaaaacaacaacaaaacccagaaaaccctggggaagagggagaatttgatatccagagctgtgatattattagattcaaaggtctagtttccaataataacaacaaaaaggcataccaagaaacaggaaagcatggctcatcccaagggggaaaaaatatcaagagaaactgtccctgaaaaa

SEQ ID NO: 178174 - DNA, 601 bp, Human
catgctcctgaagaacctgcgtacaacttgtgggaacaagggtgggcaaaaaggaccctgtctgagatatcagggatctgtgctctgatcaccaattgctgcttctgatggaagaggtaggcagtcattgttgcacctctccccgtcattgcaagcccctcccactccagttgaagtgacttccagtggatttaaagggctattgccctttcctcccccaactttatttttttctccacccaccctccaccaccttgacagccagacattaaatactaggacattcaaaagcaactgcctmtaaaaggaaaattagaaagtgactgtgcatgcctagggaaaggcacaggctcagaaaagatctgggaagaccttaagtttgcacctcaggctgatccttggcatagagacagcctacaacaataaaaaacaaaaacaacaacaaaacccagaaaaccctggggaagagggagaatttgatatccagagctgtgatattattagattcaaaggtctagtttccaataataacaacaaaaaggcataccaagaaacaggaaagcatggctcatcccaagggggaaaaaatatcaagagaaac

SEQ ID NO: 178175 - DNA, 601 bp, Human
agcaatcaagtgagaaaatacattatagagacatacacagtaggtattggagataagacaataaatgtcaggcagagtagccaccatggtccactgagatcaggaattgacctgagagatcccatcattacttctctgcaataactttttttaaaaaattattttgattattatgattattaaggcagtacaagttaattgttgaaaaattaggaaaaaaaattggccatttctgcatgtaaggagcttggaaataaccacttggtcctagaaacaagtaaaaagctgaacaggctgggcrcagtggctcatgcctataatcccagcactttgggaggccgaggtgggtggatcacaaggtcaagagatcaagaccatcctggccaacatggtgaaactccgtctctactaaaaatacaaaaattagccaggcatggtcgtgcacgcctgtagtcccagctactcaggaggctgaggcaggagaatcgcttgaaccagggaggcagaggttgcagtgagccgagatcgtgccactgcactccagccttgtgacagagtgagactccatctcaaaaataaataaataaataaagctgaacag

SEQ ID NO: 178176 - DNA, 601 bp, Human
tgacttgataggcagaccgcagcccacctgactgcctccagacccgctgggtgcctgatccctggaagtgctggggctcttccaagcccaggcctttaggagagcttcctcccaagacaggacagcttgagacctgggatctggggatcacaccagtctcacacctccctccttaggcagggcagggcggcatcagacccctggaaggactgtatgtcctttctttttcctctgcttcagtcacctagcttgggcagtgctgagcagtgtaccctgccagggggcagtcagagtcacactrtaaggacctgtattcctgccctgggaggaaggtgggggtcactgggtatttcttgtagtcacatcaaccagtccctgacctgtggagaactgtgaaaagagctgccccaggcccagtttggagcagacctgaccgtcctgttgctttggcttcagggatgccctttaatttcaagctcctggcttgctgtttggaataacccccatactgtgcagcacacaatgcctgctagaaggaacatctagaagagtgctgtgtgacagaaatagtgtatgaactatggatagatataaaacaacg

SEQ ID NO: 178177 - DNA, 601 bp, Human
ccccatactgtgcagcacacaatgcctgctagaaggaacatctagaagagtgctgtgtgacagaaatagtgtatgaactatggatagatataaaacaacgttttctagtagtcgtgttaataaaaggaagaagaaacagctgtgtcttagctggggctgccataacaaaatactgtagactggtggcttaaacagcagaaatttatattgtcaaagttctggaagctctaagtctgagcccagggtgcagggtgctggcatggttgggttctggtgaggaccctcttcctggcttgcagayatctgccttcttactgcattctcaaatgacaggggtggggtggggcaagggggtgttttcctctttttgtaagactgtgaatcctgtcctcattacctgatggccccaccctcatgacttaatctaaccctcactacctcccaaaggtcccgtctccaaataccattacactgggggtcagaacttcattgtatgaattttggggggacacattctttccatgagatggaatgaacttcaatagtatattttactggcctggcacagtggctcatgccagtaatcccagcactttgggag

SEQ ID NO: 178178 - DNA, 601 bp, Human
tataaaacaacgttttctagtagtcgtgttaataaaaggaagaagaaacagctgtgtcttagctggggctgccataacaaaatactgtagactggtggcttaaacagcagaaatttatattgtcaaagttctggaagctctaagtctgagcccagggtgcagggtgctggcatggttgggttctggtgaggaccctcttcctggcttgcagacatctgccttcttactgcattctcaaatgacaggggtggggtggggcaagggggtgttttcctctttttgtaagactgtgaatcctgtyctcattacctgatggccccaccctcatgacttaatctaaccctcactacctcccaaaggtcccgtctccaaataccattacactgggggtcagaacttcattgtatgaattttggggggacacattctttccatgagatggaatgaacttcaatagtatattttactggcctggcacagtggctcatgccagtaatcccagcactttgggaggctgaggtgggaggatcacgaggtcaagagatcgagaccatcctggccaacgtggtgaaatgcgtctctactaaaaatacaaaaatta

SEQ ID NO: 178179 - DNA, 601 bp, Human
agatactgggaacctactgccccctgattagactccttgaagtcctggctgccctgcacatatccactgtagtagtcttaaggggcagcttgttctgcgggggaggggtgctttttccaccttggtacctcacttactttgccttttgtgatcctgccggatgttcagattctagccctggtctctctttccagaaagctgtcctcttgagtgccagcctatgcattcagcccctctgcttgggagctcagggtagtgcaaatgagaaccaaggagtatcggttcaggagtttagatccaytcacggatactgacctgtcaccatggattgggatctggagggttgaggactgggtctggataatatttttgctagtgactgtagatagactctagatagtcctgaggcagggtcctggttgcatgggcctcactgtagaacagggtttctcaaccttgacactattacattttgggcctgatgatactctgttgtgtatgggtagtggtgggttgagctgttctgtgcattgtaggatatttagcagtatccccgcctctacccacaaattccagtagatcctctttaatcatgtcaacc

SEQ ID NO: 178180 - DNA, 601 bp, Human
ttccaaaacagacacccacccccttgttctgggctttcttttttggtctctcattctctaccagacttacgggtccatcccagccctagaggtgcctattccttgtggtcctgggggtactgctactgaatgcccaggttttctggtggtggaaatgctgctgccttcttctgactctattacattgctcagtgatgtctctgactaagacagtggtaggtactggaaatcaatggataaagcaggctgggattgttcaagggtcagccatgtctcttcccggcccaggaccaataatggyttcccgccttcggacagccccatgctttcccctggttattctaggcttgctgtacacatgcatgtgcctttttcagattctttctgggactggcagctccaactgggtgttttcattcatggacgcatgacctctggaagcgggtgtggaaaggaagcctgtcccactgggcaaatgtgaggccctcttcccaggggaatgttgtctggatgggtctgacctgctggacaatgggccttctccctggccagtttctgggctggagctgaggtgttttgtgaggcgagctcatgctctttg

SEQ ID NO: 178181 - DNA, 601 bp, Human
tagagagatgaattctggtttcttttcccacctggctggctccttctgtgaaccttctggctgagggtgagacctacagggctgtgtgggagtagaaggagggccagggcaatgtagtcctatctcccctgccctgaaacctcgcatccaaacctcccatcactgagaggttagccaccctggggtatagttgggggagtagaagtcacttcccccataactaattttcccatttaaaaaaaatttattactttttaaacaagtaatatacctacattatattgcagaaatttagatgttrcagataatactagggtctccttttatcacttctgttccccatccgaggccccctccaaaggtaatccttttaagattgagatgtattcttccagacatttttacttgtgcatctatagaaatacttatagaaatagagaggcttttggccgggcgtggtggctcatgcctgtaatcccagcactttgggaggccaaggtgggcggatcacctgaggtcaggagttcaagaccagcctgaccaacatggagaaaccccgtctctactaaaaatacaaaaaattagcccggcgtggtggtgg

SEQ ID NO: 178182 - DNA, 601 bp, Human
atacagaagaatgtacaagtaattaccataagtaacagctaagaagcattttcacaaattgaatacactggtttagtcagcatccaagtcaagaatcagaaattttccagccccccatccccagcaagccctgttttgttccatttcagtctctgcccacacccactaaggttaactactattctaacttctaacagcataaaatagtttcatctgtttctgtgcttcatatgaatagaaccttacagaataaactgctttgtgtccatcttttcctcaccatgtttgtgactttaagctrtgttggatgtcatggctttttaaactcggagatttgctttggcaaactttctgatacatatggatctactttgatctttttaataactacgtaatattctaaagtttaaatatagactacattttacctagtttcttactgatggactttgtgattgtatagaatgtatgcagactgtttctcaagagtagatgagaaaataacatctggatcataagcacgtatgttatcggttttaatagatactgaaaaatggttataccattttatttatttattttttgaggctacccaagtgat

SEQ ID NO: 178183 - DNA, 601 bp, Human
tgaatagaaccttacagaataaactgctttgtgtccatcttttcctcaccatgtttgtgactttaagctatgttggatgtcatggctttttaaactcggagatttgctttggcaaactttctgatacatatggatctactttgatctttttaataactacgtaatattctaaagtttaaatatagactacattttacctagtttcttactgatggactttgtgattgtatagaatgtatgcagactgtttctcaagagtagatgagaaaataacatctggatcataagcacgtatgttatyggttttaatagatactgaaaaatggttataccattttatttatttattttttgaggctacccaagtgatggcagtgagggtagaagctgggtgatatggcagttggctctctgcagtaatctgtgaacatccttcctacctccacaccccaacccctgctgaaatgctaggttacagagtttagaaatagcctggtttcatgaagggtgcgcggacatgggaagggctcacttccactggcttaatgtatgaggagacctggagataacctctcgtgcctgtgtctcctaccttgtgcct

SEQ ID NO: 178184 - DNA, 601 bp, Human
actttctgatacatatggatctactttgatctttttaataactacgtaatattctaaagtttaaatatagactacattttacctagtttcttactgatggactttgtgattgtatagaatgtatgcagactgtttctcaagagtagatgagaaaataacatctggatcataagcacgtatgttatcggttttaatagatactgaaaaatggttataccattttatttatttattttttgaggctacccaagtgatggcagtgagggtagaagctgggtgatatggcagttggctctctgcrgtaatctgtgaacatccttcctacctccacaccccaacccctgctgaaatgctaggttacagagtttagaaatagcctggtttcatgaagggtgcgcggacatgggaagggctcacttccactggcttaatgtatgaggagacctggagataacctctcgtgcctgtgtctcctaccttgtgcctgagtctcctgggtactgtgctgatgagggaggtagcactggactagccaggatgtgctggtctgggtttgggatggaagtgcatatgtatgttcacttaccaggctctatgctgc

SEQ ID NO: 178185 - DNA, 601 bp, Human
tggcaaaacctgcaattacttttgcaccaacccaatagtcacattggaggttagggcctcaacctatgaattttggtgggactcagttcagtctatgactgtctgaaacaataaagtttggttgaaagtgaattctgttttcctcttgagtgacattttggaatggaagttaattttttcagggctttgccctggtgtctctgttgttcttgcttaatactgcccatggacaatcttgtctacactggtgggcttaatttccgtgtatgtgtgcaggttcccttgcctttgggcatgttaygatcctgaaaatatgtctaaaagctgggtgaaaagtagatatggagatgtacttttctgataatcaggaccaaatatctttctaaaggtaactggagaaactagaaaaaataaaacttctctggttgaaggcattgtatatctaagaagatactgaagaactaccaggccagtatctgcatgagaacaaaggcctagggtgatgattttggtattttgagtctgtttttagtcataggggcaactgagaggctgcatttgatagctttgtggggctaggaagacaggaattggagttcta

SEQ ID NO: 178186 - DNA, 601 bp, Human
tactgcccatggacaatcttgtctacactggtgggcttaatttccgtgtatgtgtgcaggttcccttgcctttgggcatgttatgatcctgaaaatatgtctaaaagctgggtgaaaagtagatatggagatgtacttttctgataatcaggaccaaatatctttctaaaggtaactggagaaactagaaaaaataaaacttctctggttgaaggcattgtatatctaagaagatactgaagaactaccaggccagtatctgcatgagaacaaaggcctagggtgatgattttggtattttgagtctgtttttagtcataggggcaactgagaggctgcatttgatagctttgtggggctaggaagacaggaattggagttctaagcaaagggtgggcagagtcaatcacttatttgggattgagatcccaaagatatagaagttagggggaccaaaatgtagacaaaccctaaagttagattgaaatattctgggctgctgggtttggtggtgcacacctgtaatcccagctacttaggagactgaggcggggaggatcagttgagcccaggagttcaagaccagcctggacaatatagg

SEQ ID NO: 178187 - DNA, 601 bp, Human
aattaaagacatcaagccacagattcaagaagtcctgtgaatcccaggtaagacaataaatttgaaaaatccacatctatttccatcacagtaaaaattccagaaaacaaagacagaatgttgaaagcagctagagaaaaaaggcattactatcaaaagagctgtagttatactgacagctaacttctcaatagaaacagtggaagccagaagataatagaatgatagctttaagtgctgaaagaaatagttgtcagcctaaaattctgtatcaagtgaagctgttgttccagaatgaagkcatcatcatgttaagtgaaataagccagacatggaaggacaaataaccacattatctcacttatatgtggaatctaaaaaggttgatctcatagaaatagagcgtagaatagtggttaccagaggctaaggaggtaggtaggaggtcagatggggagagggtggtcaaagggtacaaaattacatttaaaggaaaaaattctggtctgttgcaccgtagggtgcttgtagttagcaagaatgtatggtatatttcaaaatagccagaagagaggattttgaatgttcctaccacaaagaa

SEQ ID NO: 178188 - DNA, 601 bp, Human
aaaattagccaggcatggtggcgcatgcctgtaatcccaggagggaggctgaggcaggagaatcactcgaacatgggaggcggaagtttcggtgagctgagattgccccattgcactcccgcctgggcaacaagagcgaaactctgtctcaaaaaaaaaaaaaaggcagacaaatgggttgagtgcagtggctcatgcctgtaatcccagcactttggtggttcaagtggggaggatcactggagcccagagtttgagaccatcttaggcaacgtagtgagaccccatctctacaaaaaataaaaaaaattagccgagtgtggtggcattgcacctgtaagtccgagctacttgggaggctgaagtgggaggattgtttgagctcaggagtttgaggctgcagtgagctgtgattgagtcactgtactccagcctaggtcacagagcaagaccctgtgtccaaaaaaaaaaaggagacatggaataatagagaattcttcagttgagaagaaagcaatgagagacaaggggacatagaccaaatgagataaatatagctaatatttctaataaatatatgatgttaaaattattattattt

SEQ ID NO: 178189 - DNA, 601 bp, Human
ccaggcatggtggcgcatgcctgtaatcccaggagggaggctgaggcaggagaatcactcgaacatgggaggcggaagtttcggtgagctgagattgccccattgcactcccgcctgggcaacaagagcgaaactctgtctcaaaaaaaaaaaaaaggcagacaaatgggttgagtgcagtggctcatgcctgtaatcccagcactttggtggttcaagtggggaggatcactggagcccagagtttgagaccatcttaggcaacgtagtgagaccccatctctacaaaaaataaaaaaaattagccgagtgtggtggcattgcacctgtaagtccgagctacttgggaggctgaagtgggaggattgtttgagctcaggagtttgaggctgcagtgagctgtgattgagtcactgtactccagcctaggtcacagagcaagaccctgtgtccaaaaaaaaaaaggagacatggaataatagagaattcttcagttgagaagaaagcaatgagagacaaggggacatagaccaaatgagataaatatagctaatatttctaataaatatatgatgttaaaattattattatttttaagaca

SEQ ID NO: 178190 - DNA, 601 bp, Human
cttctgtctttagactcatttttaccccattctttcaaagacatctggtgccacaaattcctgagttttgaagggttctgtgggggaagtcacattgcttttctactttatccagagccaacttaggagtctgtgtgatcagttaccatgtgtgtaagtgctttccagccttgaaatgtcatttctgtagttctctcctgttctctttgttcttacaggtttatgcattaaactactttattgcagttttagtgggactacaagagggagcaaaaaggaaatgtttgtgtataatccttgrcctttacctggaagctctccttccagtgttttccaggaatgatggggcctggaaaaaggcatgtatttcagagctgtgggaggatggtgccagggccttgtttacaaagtccaagttggaagtgacttgaggtcacctggcttggttccttgtttctaggcgggacttctgaaggcagatggagctcctcctgtcaccttggaaggtgctcctgtatttacatttctggcatttgtagtgaacaaaacagtggaaaatcctcatgcaaaatacatagaaatgctggaaaaagtataataa

SEQ ID NO: 178191 - DNA, 601 bp, Human
aagagtcattagagtttaaaatatttaagttccaatgagggatggtagagatgttgatttaggcttttagtataagtgtacccattaaagtttataggcctagcttacaacggaataggaatgagatgtataactttaaaagtggctaaaataggaaattttaaaagataatccaaatagaggtaacggtagaaaagaaacaaatttaaacatacccagtaatcatatatataaacatacccagaaatcataaatgtaatgagaccgaactctaattaaaagatggtgttagattgaattrgggggagggaagagagaaagattttttgtttaagttagaaaaggtaattttctctaatactaacacacgaaatgtcatatagctatgttaacatcagataaaatggactttttggcaaagagcattcattacaaatgaagagggttactatatagtaagaaaaattttattaccaagaatatataaaataatttctgtaactcaaaggaaaagtaatccagtagaaaaatgagaaaagatacaaacaaacagttctcagaaggaaatgttaataatcacaagaagatgatcagtctcaca

SEQ ID NO: 178192 - DNA, 601 bp, Human
gaataggaatgagatgtataactttaaaagtggctaaaataggaaattttaaaagataatccaaatagaggtaacggtagaaaagaaacaaatttaaacatacccagtaatcatatatataaacatacccagaaatcataaatgtaatgagaccgaactctaattaaaagatggtgttagattgaattagggggagggaagagagaaagattttttgtttaagttagaaaaggtaattttctctaatactaacacacgaaatgtcatatagctatgttaacatcagataaaatggactttytggcaaagagcattcattacaaatgaagagggttactatatagtaagaaaaattttattaccaagaatatataaaataatttctgtaactcaaaggaaaagtaatccagtagaaaaatgagaaaagatacaaacaaacagttctcagaaggaaatgttaataatcacaagaagatgatcagtctcacaagtaatcagggaaatgcagatccaaattgtgtaccatttcacactcaccaggtgaaccccaggtgggggctgtcatctgttgggaacttggattggcacatccactttggag

SEQ ID NO: 178193 - DNA, 601 bp, Human
taattaaaagatggtgttagattgaattagggggagggaagagagaaagattttttgtttaagttagaaaaggtaattttctctaatactaacacacgaaatgtcatatagctatgttaacatcagataaaatggactttttggcaaagagcattcattacaaatgaagagggttactatatagtaagaaaaattttattaccaagaatatataaaataatttctgtaactcaaaggaaaagtaatccagtagaaaaatgagaaaagatacaaacaaacagttctcagaaggaaatgttartaatcacaagaagatgatcagtctcacaagtaatcagggaaatgcagatccaaattgtgtaccatttcacactcaccaggtgaaccccaggtgggggctgtcatctgttgggaacttggattggcacatccactttggagaacagtttaacagtatttagtcagttgatgatctttagactctatgacctagccaagaaacgcccacacatgagtgcacacacacacgcacacacacaaatgtaaaaaagaagtcatgatggcattgctgagatcaacaaacataaataacctgagtcca

SEQ ID NO: 178194 - DNA, 601 bp, Human
agtcactgctcttggccctccttcgctcttatggagggacctgctagggctataaaggcagctgagcagactcagggctgcctttcgaggggtgctgtctgtggggagagctgcctttcctctctgggcagatgtgaaggctggacaccagagggagaacactggccctcctgagatgttcttgcttgtcttcctcttgggcatggaggcttctggcagggtgtgcctcagtgtgctggcagaagcagacctagatagatgtagtggtgagtggcactccttctcacctggtgagtggcaytccttctcaccactacagtgcccacaagggtggggctgggcacctgctccctggggtaggtggctgccaaggggcctccaggagccaactgagcagtggttctgctggctgctggggtcacagttcctctaggagacactggctggactggggacacccaagtgcagagctcagggactccaggggaggtgggcatggacactccacctctgaaccatctcctcttctttctctccccattgcactttgagcccctcacagatgggaccttggtgagatttctcccttttctcctcaggg

SEQ ID NO: 178195 - DNA, 601 bp, Human
tcagtggcctggagagaggaggttactctgttggcctcccttgtttgggctcctgcctcagcacagaggcttgttgcttgtctgaatggagatggaaactctttgaggacctagggcttgggctgcaggctgaggccatccttgttgtcccctcctttcgacatgttgctctagccatgatacctatacccttctgtccttctgtctgtccacccatccatctatgatgtgtttggaatgattctgccacttaggacggcaagggtcctgcctttgtcggctttccagtcttgtggggaargcctgacatttagaaagtagttgtcgagtacatgtgtaatgttttatttctcatacaagtgttcattgtgttatttcctcttgagattatttttggttatattattggtacactttttggatgtctgaaataatcctttaagcaacaacaggccattagtcaagggtggttaagttaggtggcaggggaagcacaagggccagtggaaatagagagtttgcctggtctcaggggagagggaagagccgaaatcagaggaaggtgggtaaccttacggccagaggtggtaacttacgactt

SEQ ID NO: 178196 - DNA, 601 bp, Human
ggggaaggcctgacatttagaaagtagttgtcgagtacatgtgtaatgttttatttctcatacaagtgttcattgtgttatttcctcttgagattatttttggttatattattggtacactttttggatgtctgaaataatcctttaagcaacaacaggccattagtcaagggtggttaagttaggtggcaggggaagcacaagggccagtggaaatagagagtttgcctggtctcaggggagagggaagagccgaaatcagaggaaggtgggtaaccttacggccagaggtggtaacttmcgacttacgctaagcctagaagccaaacacattcaagggtgtgacattatggtgtggctgcagtgaggggaggaaggtaggggagtgcccagcttccctgtctgcagtgcagcttcatggctggccccacaagtctcaggtctccacggacccccactagaactgctgccgtggatgcagtggggcccagcctggggagaggaggccctgtggcctctgggcagggtgcttcgaataacccagtaattgggtgctgctgcaggcagacagggacaatgtaggtgcaagcctcagtcctgg

SEQ ID NO: 178197 - DNA, 601 bp, Human
acccagtaattgggtgctgctgcaggcagacagggacaatgtaggtgcaagcctcagtcctggccccggtgtgcttgttcagcctttggtctactacccccaccccaccctctcaggttctccctctaaaccttaaagccacatgcttgatgaagggcctggctggggaagccagtgtgtacccttgtaagcctctctgtggaccctgaggcccttcctttagaagaggctgagtcccagctgactgactggtcaggaggccatgcattttcctttcacaggtgtcagagcctaggccacmtggtgcaggatgaccagagctgtggctgggcactgccattctgattgggtgacatttcggacccttaggtgctacctggatccttgagattcgttgcttgctcctgcccctggaagaagcatcctgtcacttcagggagttgcagaaaggggttgggtttgacaggagaatggccgctccagtggtggggggcttctttcacctgacagccagtcagtatccttctctctggggtataccctgggaaatcaagctctttcctcatgaaggccaacagtaggggtggagatgagcgtgagg

SEQ ID NO: 178198 - DNA, 601 bp, Human
caagacttgccctcctttcctcttggacccacctgcgcttatactgcccactgggccatttgggtctcaggatgtctgagtgggagataaaggaccaagaaggggctcttgagatggtagccatggccccacgcccttccacaccctatttgtcctaccttagccctgaggaggggtctcagtgtcaacccctggctgttcttccttggctttgggtctcctgtaggggaggtgagttcacaccgtccccctggtgttgcccatgaggtgctctgtctgtgaggaggggttggcagggcargcctgggggagtcttgcatcccccaggtgaggggtatatggaaaattctgtgcctccaggcaggagtgtgtggccactgaggagaacccccaggtgtacttctgctgctgtgaaggcaacttctgcaacgagcgcttcactcatttgccagaggctgggggcccggaaggtaagggggcagtgtggaagtggggccttgagtcagccgacctgggcttctttggcttggagcgcttggctcctcagttgggtggggtgtggctacagggccctgtagtctggctctggaagtgtgagggt

SEQ ID NO: 178199 - DNA, 601 bp, Human
tccaccatgaagtactctgccccggtagcactatccactatggggttactcctgccataggtgtggacattggttcccctatgataggaacctctcaccctgggataagtttttatgataagagtagtgactccatgattcccacccctagccctccctgcctcctggcctcatccatcttccatatcgattgtagtagccttccaggagagcagcctagccattggcccactgagacttctctgccagggctgggctgggtcctgtcctgtacccagaatctgtgctcaagttctgtgcygtcttctctcagggctccctcacggattacctcaaggggaacatcatcacatggaacgaactgtgtcatgtagcagagacgatgtcacgaggcctctcatacctgcatgaggatgtgccctggtgccgtggcgagggccacaagccgtctattgcccacaggtacctgggtcagcaggtgcctttcctgcacttgacctggagctgtgggaagggttggtgggcgagagcagtgtctggagatgtctcaacttcctaaacatacttactctgcttgctgtgtgtccgaggcagctgggca

SEQ ID NO: 178200 - DNA, 601 bp, Human
tgtacccagaatctgtgctcaagttctgtgccgtcttctctcagggctccctcacggattacctcaaggggaacatcatcacatggaacgaactgtgtcatgtagcagagacgatgtcacgaggcctctcatacctgcatgaggatgtgccctggtgccgtggcgagggccacaagccgtctattgcccacaggtacctgggtcagcaggtgcctttcctgcacttgacctggagctgtgggaagggttggtgggcgagagcagtgtctggagatgtctcaacttcctaaacatacttacyctgcttgctgtgtgtccgaggcagctgggcacaaaacctggccttcccactgtgtcctggggatggcatggcctcccaagctggtttttggtgccctctaatggccacatgaagtgctgactccattactttggttggagagttggctcagtagttctcaaattttctagtttaggatccctttatactcttaaaatgacttttgtgtaagtggattatgactattgatatttgctgtatttgagcacacccacacatcccattcgctgtcagagtgaggacatcacatctcatgtagcc

SEQ ID NO: 178201 - DNA, 601 bp, Human
cccttgcagaggaataaagggctgggcgggttctaaggcccagaatttgcttcctcctggttccgggggaatgggcaggcaactttctgaaggaagtggtatgtgtgaactggggcaccaagatactagaaaaatgttgctagagaagaggggaaggcctctgcaggtggagaataagaatagcacaggaaaggcctggcagcaggaagcaggcaggatgtctggggagcagtgggtgtgcctgcaatggggtcagggtggaggggtaggggtataggaattagatggatgttttcaaggrtttgggacctctgttctttggtgtttgtttgacacatctgaaaagaatgcatacacaaagaattatcatgtgagaaagcattggttaacgctaaggtaataattaggatttgtggaaggtggaaaaaattacctaaacatttttagcaattgggaactgcaaaataagccgataacatccctgttaacacttaggaagagtcttcattcatgacatctgttaaactagagagcctccattggctgttggaaggttcctcaaacacaaaacagaaacaaggggagtcccttgactggttcc

SEQ ID NO: 178202 - DNA, 601 bp, Human
aagccaggcagctgctgagccctttatatgcattgtctcatttcctcctgatgcagctgtcttcagcaggcactattctattactccttcagctgaggaggactctttagcctcagagaagttaaccaacttgcacagggccacacggcaactaagtgaaaaagctgggacttcaacccaggcctatgagacactaaagcacccagtgcagccttatagctgcagctgcctagttgctcggggtttcctggcaggagaacctcttctcattgggagccttaggcctaggtggccaaagcaygaatacactcagagcaaagacaaggacaatgattccttgcctgaccatgtgtcaggccgcgtgtctggtattgcgtcttttctataagaggcacgtggtcagacaggggatgtgcagagggagcagccaggtggagcgggatggaagctgtgtatatgattaggagataagggtgtgccctggcgggaacagaggcactctaccgggctctgaggggctgtctctggacccagtgcagagacgagcagaagaagctttgcctgatctcaactgtccagagcaggtggggacacccagcaa

SEQ ID NO: 178203 - DNA, 601 bp, Human
gggaggagcgcttgaggctaggagtttgggaccagcctgggcaacatagcaagaccctgcctctacacaaaattttaaagttagccaggcatggtggcacacacttgtagtcccagctacttgggaggctgaggtgggaggatcacttgagcccaggagatcatggctgcagtgagttatgattgtattactgcactccagcctgggcaaaagagtgagatcctgtttaaaaaaaatttcagtccagttcaattaaaaactttaatcttacatcagatccacagctttttcctggcccctygctcaggatagtggccaagggggatgaggtctgttctgacctattgttcttcctcctgtctccttgttctgattttccaggttctaggcatgggatagggacatcagataaaatagaccaaagactgacatggcaggggctattatagtctctcagggtcctctgtagggtagatattcaaataccatcactctcgggtccattcgtgggtcttctgagcattggaatttcctaatgctcccagtgctctgtttgtgacctccctcagctcctgtccctggcagttcaccccataacctc

SEQ ID NO: 178204 - DNA, 601 bp, Human
gtcttctgagcattggaatttcctaatgctcccagtgctctgtttgtgacctccctcagctcctgtccctggcagttcaccccataacctctttctgtaggggtctcctcatcctagcacatggggtgcctttaagacagcagggtccacttggccaaaaaaccccactgttccccagcctccaccctgttgtggtgggctgctccaatcaacctcctgccttcattatacccagatgagagatgggcatcattctccgggtttatgtaggccctcaaactccaggtggcacatattaacyctcctataatctctctcactgtctggaataccaggacaagcccccatgtttctgaattagcaagttccagccagagtgggatggcagatgtcctttttcaaaggcagtccccgcatctatctaaggagttctcttgaactcccctttgcctagctcgagtagatgagagttgtatggggagtgaggaggagagattcaagaccctgtcacttccatgaactggattcccagcctctattggtaggctgttagcagtgagcaccaatgtactatgggtgctgaaggtccctcttttgacct

SEQ ID NO: 178205 - DNA, 601 bp, Human
tccttttcctccctgaaggtacagctcatccttcccctgtggcctgcccacagccttcctgcttcccaaaacccctccccagtgccgcctgccatggccggccacctagacaccctgggaatcagccttctgcacctatagcccacccaccccacagaggccccagcacctccaatccctggagcactgctcttcctgggcggggtcccccagacagggcacccacactctctcagaggcctgaaagaggagggtgtactttccagaggacagcaggcagccttcttccaccagattccartccaccttagaagtaggtctaatggttacatgtgaataaatgatggcaaaaatattccttcaactgctgcccaggcccacctgtcatctgtagcccctttgactgggaaatgcctgttgttccctgtagcttcaccaggaataacctgaccactgaaaaattgagtgtaatatggggctcagcactcaggaacagctcttgcatggaggcccctcctttccagaggggctcagtgccccattcctgctggcttagcactagaaaaggaaacaggaagggctggtgttatcttcagaatct

SEQ ID NO: 178206 - DNA, 601 bp, Human
gagaacatcctggaatgtttgggagccatcccagccattcaggccccaggaaccaaacacccccttgctctgaccaccttgcagagccccggtggtacagccctgagcaggggtcccaacccacaggacacaggcctggccctgagtggatccccagtggggtgaggaagctgcaattgggtgaggaggtggaacgaagacacagccttggaggcagagaagggggtgttgggtgtagcatgggagacagtggcctgagaggccatgggtgtcccaggggacctccccacccctgctgacyaactctgcactgcaaatgtcctgccttccagcctggctgggcctctgacaacctgccactcctctgacagaatgcctgagcctgctggccagctgggcaggtggtggggaaggctgttcagatgccttctgggaggggtcaagggagggctgatgagtggaactccttcacccaccccaggggaggatggcctcagactcaagtggccacgttgtccggccacagagctgaaatccatgacgatcttggtgctcatgctcagagagttcagcctggccgccactgtcactgtgttcttcc

SEQ ID NO: 178207 - DNA, 601 bp, Human
ctgacccggactgggccatgtcgtctcctttccttgcccctgcctgcctgtctggatgggtgcattgcctttgggcataccctccaggggcactcctcccagaggctccctctcctcccagggacaggggactggcttggaactgactctgagtacatctcttttcctgtctgaactcctagttcagtcctggttttcataaaaaacccagtcttgatgaaggactctggcctcttggccccagcagcccaggaccccatttgggaactgggttccacccaacacctccatgggcacttcyggcctctgatctcccaggtgtcccctggagaagacttgtcatgattggcaggaccattccttctgggttttcggccaatgaacacgctctccctggacctgaggggacctgagcgccagtgaggagcagaggttgcccgaggccctagagtgtcctctgctctgtgccacagcagtcactgcctctggcctttctctgccctcctccctaccatcttccccctgccctccctccctgctctcactggaaccacacatgctaggcactgtgccagggcttgactgtcaaaggtcagaggtc

SEQ ID NO: 178208 - DNA, 601 bp, Human
gctacttgggaggctgaggcaggagaatcacctgaacctgggaggcagaggttgcagtgagctgagattgtgccactgcattccagcctgggtgacaaagtgagactccatataaaaaaaaaaaaaaaaaaagaagtccatctttacctccatgatttgagatgtgagccttatcatgtgctactttctgtgttcacttaggtccatttttgggcttttgtttttgttccatggtttggtagatctggtcataagccagtaacacattgtttcaattatcccagctctgtaatatgtttgyttgtttgtttatttacttttgagttggagtctcgctctgtcgcccaggctggagtgcagtggcatgatctcggctcactgcaacctctgcctcctgggttcaagtgattcttctgcctcagcctcctgagtaattgggattacaggcgcccgccactggctaatttttgtatttttagtagagatgggtttttgccatgttggccaggttggtctctaactcctgacctcaggtgatccgcctgccttggcctcctgaagtgctgggattacaggtgtgagccattgcacccggcctgta

SEQ ID NO: 178209 - DNA, 601 bp, Human
ttgcttttctatttcctgaaagtaaaagcaaagtcaaaaatgatcctaataatgatagtagtttcagtagaaggaagagtattaataatgatatcagaggacattgacttagtgcatgcgcttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggkgcccccgtattctcatctgtcatagggtcattgtgagtgtaagtacatagcacagtgcctcctattaatacgcagtaaacattattaaagcttgggcttctgttattatcgttgatatttacatgaggcacggagaggtgatgtcacttacccaagatcacacagtgctgggagtgggagtcaggacctgagtctatctcatccagtcccttggctgtgctgggatcacttttctccatgctggattactatattttcaaatcctcactaggatgtaactaatttttctgaagatgcttc

SEQ ID NO: 178210 - DNA, 601 bp, Human
ctgcaggacctaagacagacacggtcctttccctcagggaggaatgcagaaaacctgagagttctcttcctatttaacaaatgctaacactatcattgtgtatcacagaacttatttccttggcgagttttatcctatacccatcaagaacccatggatcttgagatcatgaatttcctcctggttgaaagagctgctgagcccaggaggtactaacgtttattgagcccatttggtgccaggcattgtgctcatggttttctataccttcctcatttacttttcttttttttttttttttaattttttgagatggagtctcactctgttgcccaggcttgagtgcagcgggacgatctcggctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaag

SEQ ID NO: 178211 - DNA, 601 bp, Human
agctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagttggcgttggattcagtggcagatgatggcactacatgttggattatgaatggaaagctttgtataaagtaggaagttcatctcaat

SEQ ID NO: 178212 - DNA, 601 bp, Human
gaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagytggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctagg

SEQ ID NO: 178213 - DNA, 601 bp, Human
acatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcaygtacatgaatgcagcaggtgctaaggctaggtggcagaagaacagagtgccgcaaaggaaagcagctggtgggcgggttggagacttaccctgggtggggtgatcaagcctgggcgtctctgagaaggtggcctttaggttgagacctgaaagtactcaggatctcaccatggaaagagtaggatagactttcaggcagagggagcagcttgggaactagaagaaggtcagtaaggttagagtgtagctgtttatgagggggatggcggcaggttctagcattggtctcaggtgccagag

SEQ ID NO: 178214 - DNA, 601 bp, Human
agaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgtgcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgtaagacttsggaatggtctttctgaaaccctaagctccaagctgcagatgagctgtcctgagctctggactgcaaagacataggcagtgcaaggtctggggacatgaatggatcttggccttctagcctggccaggtcccattgcctgtgggacacagtctgggtctttcagcttggacagggaagagggggatgtagtaccactgtcaaaactcggaagactgatgtcttagttcattttctgttgcctataacagaatacctgttcctgggtaatttataaggaaaagaaatttatttcttacagtt

SEQ ID NO: 178215 - DNA, 601 bp, Human
catcacatggtgagggagctgagtgtgctggctcaggtctcccttcctcttctcagaaagccaccagtcccgttcccacgataacccgttaatccattaacctgttactttgttaacccatgaatggattaatccactcataaagccctcatgacccaatctccttaaaggtcccatctttcaatatgtcatgttggagataaagcttcaacatgagttttggaggggacacatattcaaaccatagcaactggcatggagagggcagacccagggccgggggaggcaaaaggaggagaargggatttctgacaacttgagctgtagaataatcagcattaggatgtcagtgagttccccttacaggtggcgttggaatggtctaagggtctgtaaggaggttggactggccgcctatagagtccaggtttctaagatgtatttgtctctctgggctatagctgttgtcattagagaagatagtgaagctgctttgcttgagggccttcctatgatactctatggacaatccaagttctatgtaatatatattttatacctttgaatcaactgagtaaaaggatactataaaaatacctat

SEQ ID NO: 178216 - DNA, 601 bp, Human
tggctgaagccatggcagaagaatgtggattgtgaagatttcatggacatttattagttccccaaattaatacttttataatttcttacacctgtctttactgcaatctctaaacataaattgtaaagatttcatggacacttatcacttccccaatcaatacccttgtgatttcctatgcctgtctttactttaatctcttgatcctgtcagctgaggaggatatatcgcctcaggaccctgtaataattgcattaactgcacaaattgtacagcatgtgtgtttgagcaatgtgaagtrtgggcaccttgaaaaaagaacaggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattagga

SEQ ID NO: 178217 - DNA, 601 bp, Human
aggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattaggaagaggaaattcccacctaatamattttggtcagactggttgatcccaaaaccctgtctcctgataagatgttaccaatgacaatggtgcccgaaacttcattagcaattttaatttcacctcggtcctgtggtcctgtgatctcaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacc

SEQ ID NO: 178218 - DNA, 601 bp, Human
ggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccgrctgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcacgtgaggactcattctccaggctgctgtgtggactggccagctc

SEQ ID NO: 178219 - DNA, 601 bp, Human
ggcagggttggtgctggagttggtggagtgcctggcaggggtcctccgactgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcrcgcacgtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcag

SEQ ID NO: 178220 - DNA, 601 bp, Human
ggttggtgctggagttggtggagtgcctggcaggggtcctccgactgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcaygtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctg

SEQ ID NO: 178221 - DNA, 601 bp, Human
tgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctggcagagctgggatctgaaccaagcsagtctggctccagatgctggattctcaaccactggctgaacctgctttttttaaggaacaatcgccctcttgatgtttatagacaccatcagacatgatagaaaccagctgggcagggctaataagccatagttttcagtttatatttcagtgtgtttcatgttgtttaggttgattgtaaaaacagtcaaatcttgtaataacaagtttgaaaaataaagaaaatgggcctggtgctcacacctgtaatcccagcactttgggaggtggaggcgggaggatcacttgagcccaggagtt

SEQ ID NO: 178222 - DNA, 601 bp, Human
caaagtgctgggattgcaagtgtgagccaccgtgcctggccattgttcttggttttccaacgtggaatcacactagagcatcttccatagcttgaattatttccccaggaggatggcagtccttctctcttcccagacactgtcttcacggccagcgatgaagatgggagaagctgagaggtgggggctgaatgtcttcttctggacagagccaaggggctggatggaaagcagcaggtcttaaaaacaactatttgttttaaaatacataacgaatggatgtctttttatcacaaaagaktcatgcaaaacagaaatatggaataagaagcaaatgcccccttcatatgcctcccagactcctttccagactgtgacttccttcctgtgagtttctgtgttagattgaatcatacggaattgccaatattgaagaagttttgatttacaaaaatggcaatttcatatggttcgacctgacacgtgtgtgtgtgtatatatttaacagaaatgctattacattctatgtgttattctgagacttgctttccataacagtatgtacaggtctacctttttgttttctaatgactggcatgag

SEQ ID NO: 178223 - DNA, 601 bp, Human
tatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgcagaaaaggcttgcccttctatcaggaagtgcgggtgaggtggtggtttttttttgttttgttttttttttttttttttacttttatcatttaatttttatttttaaaaatgtatatagtaaaaaagctgggttgcggagatgtcggtcagtggattaaaaattttggttagggtacaggaacatattcaagagatttattgtacaacatggtgatgatagtttataacagtgtattgtattcgtcaaaattgccaagagattttaggtgttctcaccacaaaagataagtatgtgaagtaatgcataagttaattagctcaatttagtcattccacaatatatacatatttcaaaacatgttg

SEQ ID NO: 178224 - DNA, 601 bp, Human
gtttttactttcttcattttgtcttttctaattttttgtatagtaacttttatcactgggcttaacaggaatctaaaaaatgtatttttagcaattgttatgttatatccacaacatgatctatatattttgtcagggaggtttattttttgactcagaactagtttgttcttgaaatatgtactttattcttttaattagggcttaaaatgttaaaatatttctaaagaggactattttgggactctacagtgtacctctttaatgagaacacccacagtttaggcctattaaggcatamttcctttattttactaaagaattaaaataataaagatttgataattttctttcttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcacc

SEQ ID NO: 178225 - DNA, 601 bp, Human
caacctctgcctcctgggtttaagcaattctcctacctcagcctcctgagtagctgggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacrgctcattgcagccttgaattcctgggctcaagcaatcctcccacttcaacctcccgagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataagccactatgctcagtcagtttattgtgaaaaatatcatgtatacagtagagtatatgtatcttacagcaagttataaaacatatta

SEQ ID NO: 178226 - DNA, 601 bp, Human
gggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacggctcattgcagccttgaattcctgggctcaagcaatcctcccacttcaacctccygagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataagccactatgctcagtcagtttattgtgaaaaatatcatgtatacagtagagtatatgtatcttacagcaagttataaaacatattaatcaaacatctgatgatcagcactcgggttaagaaatagaacatcagccaggcac

SEQ ID NO: 178227 - DNA, 601 bp, Human
cctccacctcctgggttcctcccacctcagcatcccgagtagctaggactacagacaacgtgctaccatgcctggctaatttttaaatagtttttatagaaacagggtcttgccatttttcccaggctggtctcaaagtcctgggctcaagcaatctacctgccttggcctcccaaagtgctgggattacaggcatgaaccatggcacctgacctgcactcctgtttctacttcatgggtttattggtcttgttcttggggcagaaaaactgttgtattattgtggctttgtagtatgtcwgtattagttggctagggctgccataagaatgtgccacagaatgggtggcttaagcaacagaaatttattttctcacagttctggaggctaaaagtctgcgatcaaggtgtcggcagggttaatttcttcttaggcctctttccttagcttgtagatggtcaccttcttcctgtgtctccacatggtctcctcctgtgtgtccctgtgtcttcattttctcttctcataaggacatcagtcatactggattagggcccacccctaatgactttatttttaacttaattacctctttaaaga

SEQ ID NO: 178228 - DNA, 601 bp, Human
atctggcaaacttattaaactcttgttagttttattagtttgtttattctttattttttccaaatagatggactattgtctgcaaatgacagttttcttttcctttatttcaatacttatatattttagttgtttttgttatcttatggcattgactggtagatctaatactgtgttaaacagtggactggatactgtgaatctttgttttgtttgtagttgtattagttatctattgccatgtaacaaattatctcaaaatttagcagcttaaaacagtaataaatgtttattctcttayacagtttctttgggtcaagaatttggtttcagcatggttgggtgattctgattgaggatatctcctgaggttgcagtcacaatgtcatctggggctgcagtcatctgaaggcttgactgacgctggaggatctgcctccaggctggctcactcatgtggctgttggcaagaggcctcagtctcctgccatgtagacctctccctagggctgcttgagtgtcttcaggatgtggcacttagctttccccaaagtgagtgatccaagagagcatgatctgtgtcagagcgagatggaagcct

SEQ ID NO: 178229 - DNA, 601 bp, Human
tggggctgtcagagcctgttatggagacattgtgcatttttgggtgtagcctggggctgccttaactgttagagtaactgtattagctgtttgcttgtgactacctatcttaggtaagatttttctagaaacagagcctgaaatgggaattcttctataagcagtttgttgagagagtactcccaggaagaaggaagtgagggactcagggcagtgcagaggaagaaggataagtgaggatatggtcttgtctggagtctacttcagctccatcctggtggggaggtggggctctggaacrtgaattataccacagagctgattttaccttgggacaagggggccaacaggccaccctggggaggttaaatctcctgtgagcggtggcctatgctcagccaaggtcagctttcttgaggaggtagtgctgcaagccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaa

SEQ ID NO: 178230 - DNA, 601 bp, Human
caggccaccctggggaggttaaatctcctgtgagcggtggcctatgctcagccaaggtcagctttcttgaggaggtagtgctgcaagccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaatgtatgcaatttatttgtgaacctaaatgggaaacttcaccattatscccatgaaacatgctcttgttagcttgggtttgtttgggcttgttaatgttagtctaatacccagctgtctccagccctaggtcagtgccatttgctaaacatacttcctaaatcttctgccttgtctttggtgaaatggctaaaaagtacagggacagcctggggagctgtggctctccactacggacctcccccagctcatcctgactctattatcaccagggtagcatgaccaagcatactcctcttaaggcagtcgaggtggaatggaagaggtcagaagacatatgagggagaga

SEQ ID NO: 178231 - DNA, 601 bp, Human
tgatgccccggtgtatgttatagacactgccaactcggcctgtgtgggttctgcataccgagcttttcatggtaggttgatggagggagacagctatctctggaagtggccaggacatggggtgggctgaggagggtggaaaggggagagtgaggtgtacccagtctttggggacattggagtcttggggacttcagcttcatttttctagctcccagcaggtgagaaccaacccatactctctgttcctttattctttgcttaaagtggagaaaaagaggctgggtcctaactgaatgakgtctggtcagagttaaggtcagcacagggacatgggaaaagaacacagggcatggttgagagcacgtgggcatgagtctggacagctagagggcaggagaggtggacaaagtccagagccgtcttttcagcaagaacagaagttgaaacaaaggggaaggcttcaggcccaagcagtccaggaccctggacagcaccatggagccctgttgccctgttggaggcctcgctaaaactctgggtattaagggaagctccccgatctaggcgagttctggcaggagcagcacctacctgcaag

SEQ ID NO: 178232 - DNA, 601 bp, Human
tcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgc

SEQ ID NO: 178233 - DNA, 601 bp, Human
tcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctytgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagag

SEQ ID NO: 178234 - DNA, 601 bp, Human
tctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcrgaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaag

SEQ ID NO: 178235 - DNA, 601 bp, Human
cgctgactattctgcgctgggcagttaaggctgcacggcccgaccacggttaaccttgcacacctcctctccccacccgcttagcccctgctccgccacacccgcgcggcctgacgcggtccaggcacgcccaggctttggggagcctctggggcggcccggatggggcaaggagaattttggtcgttcttggatgctgtttccttccttcgccgcccctccgtgcgagcgggatcgtggagcccagactttcatgaccaggacaagggggtccgcgaggcggagggaagtctttagacccgtaccgcccgcccacccaccccccgggctagatctcggacaagcctggaaacgcccagggtcgtgcccggcagtcccacccagggagccgcgggctgagattttcccagtccggagaaggggcagagaggcgggcccggggtggtgtggaggcggccgaaggagctgggggctccctgtccagggcccggaacagctttccaggggtccacccctgcagggtctcccgctcgcgcgggccaggcactcaccgtgcagggtcaggaagtcccggcccgagtccatgcccgacgggcggcgc

SEQ ID NO: 178236 - DNA, 601 bp, Human
gagcatcgctgactattctgcgctgggcagttaaggctgcacggcccgaccacggttaaccttgcacacctcctctccccacccgcttagcccctgctccgccacacccgcgcggcctgacgcggtccaggcacgcccaggctttggggagcctctggggcggcccggatggggcaaggagaattttggtcgttcttggatgctgtttccttccttcgccgcccctccgtgcgagcgggatcgtggagcccagactttcatgaccaggacaagggggtccgcgaggcggagggaagtcttwagacccgtaccgcccgcccacccaccccccgggctagatctcggacaagcctggaaacgcccagggtcgtgcccggcagtcccacccagggagccgcgggctgagattttcccagtccggagaaggggcagagaggcgggcccggggtggtgtggaggcggccgaaggagctgggggctccctgtccagggcccggaacagctttccaggggtccacccctgcagggtctcccgctcgcgcgggccaggcactcaccgtgcagggtcaggaagtcccggcccgagtccatgcccgacggg

SEQ ID NO: 178237 - DNA, 601 bp, Human
tgcaggaacatagtactcactgggtaccaggcactgttctaactgctgtgtagatattatctcattcaatcttcgtagcaaccctatgaggtagatggtattatcccccattttacagatgaggaaactgacacacagggaagtcaagggattcatctgagatgagaaagccaagacttgaactcaggtactttgctttcagaatctatgccagtaaactacattacttctgcatgcatctggggtgaggacagaagggacatgtcacatctaggtgagccgcatagctccccaggccaayagaaggagtccctctgggctccttccagagagtgtggagccctaggccagagagtgtggtcctgcagcacatccagtgctggggcacccacactgtgaaacggatgcagactctccaatgcaagtgtagacaacctggaacagcacagggcacagtgatcaccccctcccaccaacaattctccttgacaggttcttatttccccatctggtttgcagtgtggacagaaggcagttgaggtaattttgggtgatgagctagaagtggcagggccttcagggaaaacagcttggggtcaca

SEQ ID NO: 178238 - DNA, 601 bp, Human
gggattgggtgtaggaaaagttagtgtgtatgtggggggtgttcagtgaggggagggccctgggaggtaatgtcctttggggcacatcgggggacctgctagagaagccagtccaggcatagccagaataaagagtggaagaagtaaggtgaaggaaggaggatggatgctgtcgcatcagtctgagggcttcagaggcactagaaagagctggctggctcgctcttgaatctagttctggccctattttccatgactaggaactaccttatgatgcccccatcatctcccaaagaactayagatggcaactcatagggcatagaaatttggggagggggcctcctgcaggaacatagtactcactgggtaccaggcactgttctaactgctgtgtagatattatctcattcaatcttcgtagcaaccctatgaggtagatggtattatcccccattttacagatgaggaaactgacacacagggaagtcaagggattcatctgagatgagaaagccaagacttgaactcaggtactttgctttcagaatctatgccagtaaactacattacttctgcatgcatctggggtgaggacagaa

SEQ ID NO: 178239 - DNA, 601 bp, Human
tggaggactggtttttggggcaacctagaatttctatgcccattggcgtttatgttcacaacacccactgtgaaatatgtactgctatcccatggatgattctcagacccacagtaagtagaaccaaagctaggactggagcccaggtctactggggccaagatgaggcccctctattttctgtttttacaaacggcacctcttgcaggggtgggggcaaaagggattgggtgtaggaaaagttagtgtgtatgtggggggtgttcagtgaggggagggccctgggaggtaatgtcctttkgggcacatcgggggacctgctagagaagccagtccaggcatagccagaataaagagtggaagaagtaaggtgaaggaaggaggatggatgctgtcgcatcagtctgagggcttcagaggcactagaaagagctggctggctcgctcttgaatctagttctggccctattttccatgactaggaactaccttatgatgcccccatcatctcccaaagaactacagatggcaactcatagggcatagaaatttggggagggggcctcctgcaggaacatagtactcactgggtaccaggcac

SEQ ID NO: 178240 - DNA, 601 bp, Human
gcctgtgtagcatgggcctggaagcccaggggcagactgctttggaacacaggtgagtgaggagctggccaccccaacttgctaagagctctggaatcatcatctcttggaggactggtttttggggcaacctagaatttctatgcccattggcgtttatgttcacaacacccactgtgaaatatgtactgctatcccatggatgattctcagacccacagtaagtagaaccaaagctaggactggagcccaggtctactggggccaagatgaggcccctctattttctgtttttacaaayggcacctcttgcaggggtgggggcaaaagggattgggtgtaggaaaagttagtgtgtatgtggggggtgttcagtgaggggagggccctgggaggtaatgtcctttggggcacatcgggggacctgctagagaagccagtccaggcatagccagaataaagagtggaagaagtaaggtgaaggaaggaggatggatgctgtcgcatcagtctgagggcttcagaggcactagaaagagctggctggctcgctcttgaatctagttctggccctattttccatgactaggaactaccttat

SEQ ID NO: 178241 - DNA, 601 bp, Human
atgaacacggaaaagctattctttggagaggggaagcagagtgcaaagggagcctgtgttatggagaaactgcgcaggggttcttaaccagaccaaagacccctcaagaacctgtagatagaataacatctcaaaataattggcttcctttgaattcttatgtattttattttctgtatttaaaaacatgatcctggccgggcgcagtggctcacacctgtaatcccagcactttgggaggccaaggtaggaggatcacttaaggtcaggagttcgagaccagcctggccaacatggagamaccccgtctctgctaaaaatacaaaaattagccgggcgtggcggccggcacctgtaatcccagctacttgggaggctgaggcaagacaatcccttgaacccgggaggtggaggtttcggtaagccgagatggcgcaaactgcactccagcctgggtgacagtgagattctgtctcataaataaataaacaaataaataaataaaaacataatcctgagaaggggtctacaggcttcacctgactgccaaagtggtctgtggcacaaaaagttaagattggtgtggatcagtgtgtgcctg

SEQ ID NO: 178242 - DNA, 601 bp, Human
ggagtcctgttcctataccaagggtgatgcataataaagacacactgggcctgggacccacagcgatacacagctacacagatatggccacacaaatacacagtcacacactagaccaccactcacacaacctcaaagagacaatgagccacacacaatgacacactgccccccaaaattacacactgtcacagggagttgcacagtgtcacacttagtcatgcatagccacacaacatatagtgccagagcatcatgatgatgatgatagaggctcccataataatagttaatatttaartaagatactgttcttagcacatgcacttaattctctcaataaccctctgaggaaggcactgtcattattcctgttttacacaagaggaaactgaggctcaaggaagttgcatggtggagtcaggactcagaagcaggtagcttacccacagggtcagcggtatgaaactttacgcagccactgtgaagggacatactgccacagagtaagaacatcagaaaatccatataacacacacaccataatggaatgacagaaccactcagtcaccctaggtcacccactgtcacattggttata

SEQ ID NO: 178243 - DNA, 594 bp, Human
ctgtgattacttttgcatcaatctaagagcttctcctcctgtgggagggtcgtggcgaggagactttgagctgaccctgggttgaccttgcagcctgcccaggctagctgtgcacagtgaggtggccatgtggtggggcatacagggtgttgcaggtgccagtgggaagctgagggaggtgccaggagtcctgttcctataccaagggtgatgcataataaagacacactgggcctgggacccacagcgatacacagctacacagatatggccacacaaatacacagtcacacmctagaccaccactcacacaacctcaaagagacaatgagccacacacaatgacacactgccccccaaaattacacactgtcacagggagttgcacagtgtcacacttagtcatgcatagccacacaacatatagtgccagagcatcatgatgatgatgatagaggctcccataataatagttaatatttaaataagatactgttcttagcacatgcacttaattctctcaataaccctctgaggaaggcactgtcattattcctgttttacacaagaggaaactgaggctcaaggaagttg

SEQ ID NO: 178244 - DNA, 601 bp, Human
cttttgttcccccatcagcactgggctaagaacagtgtaggggaggcatccctgggcctcctcaggggtgacagtctgatgtgaccttcctccacctttctcccaggtctgtccacccacttgatgagctgttgtgccttagcgtgagcagctccctcttagcccaaggggagtcccagtggaaaagaagggggctctgatagaatattcccaactactggctgtgtctgaggagcctgagacaagaggaggcagaagggagttcccaggctgccagaggacagggccacctccggcctcyggcggggaattccactatcccttctaaggctgatgtccctctaaagctgagagggacatctccttaccctctgccagcaccccaccccacaagctgggcatacatcagggcaagccactgccaacagcatgtatgggaatggagctgggagccaggaagtagaagttgagcaccaccctcctgttctggaaaacaccatgaagagatgacatgctcatcctgtcctggagccaggctgtggccctatctacagtcaggcagagataaacccccagctgccaacaatggtttctaaaaggt

SEQ ID NO: 178245 - DNA, 601 bp, Human
tctgtcctgctgctccagcacagtggcagcctcagggacttcaagggtctagtctgagggtcttgagcctaagcctatgtggggaagccctcatgaagccacaggccttttcttttctgagcccagatccccaacaacagatggcctctcccattttatccataccccctcccccagccagcctgtcccacatatcttcagggctcacagaaccctctggaccacttccccaggcttcagttgctcacacactctttatccttccccagtctcctgcttccaatcaggatagaggtcagtrctaacatccaccccctatagctttaggcaactcccttccctctctctgcttttgttcccccatcagcactgggctaagaacagtgtaggggaggcatccctgggcctcctcaggggtgacagtctgatgtgaccttcctccacctttctcccaggtctgtccacccacttgatgagctgttgtgccttagcgtgagcagctccctcttagcccaaggggagtcccagtggaaaagaagggggctctgatagaatattcccaactactggctgtgtctgaggagcctgagacaagaggagg

SEQ ID NO: 178246 - DNA, 601 bp, Human
taatacagaaacatctataagggcgtatgtgtgcgtgtatcaccctagccacgtacatagtccagcagccagctctattgagagccaatcggccacttcacttctctccctagaactatgtggcccatcagcaatctctgtcctgctgctccagcacagtggcagcctcagggacttcaagggtctagtctgagggtcttgagcctaagcctatgtggggaagccctcatgaagccacaggccttttcttttctgagcccagatccccaacaacagatggcctctcccattttatccataycccctcccccagccagcctgtcccacatatcttcagggctcacagaaccctctggaccacttccccaggcttcagttgctcacacactctttatccttccccagtctcctgcttccaatcaggatagaggtcagtgctaacatccaccccctatagctttaggcaactcccttccctctctctgcttttgttcccccatcagcactgggctaagaacagtgtaggggaggcatccctgggcctcctcaggggtgacagtctgatgtgaccttcctccacctttctcccaggtctgtccac

SEQ ID NO: 178247 - DNA, 601 bp, Human
ccagggtctgggacccctcaggatacagcagctttaaggcacagtgcatccctttccgaagctgagcaggtcctgtcccagagcccagagagaggaacctggctgcttgccccagtcctgccccactcttttgctgctctcagaggtgtgggctcccaaagatgcgatgccctcagtcctaccaggcccagacaggaggcaccaaaaggacgccagagccttcaccacccagcaggttctgtaccaactgataaagttgataaaagtgaccccaacccttagtaacccactggtgtaatayagaaacatctataagggcgtatgtgtgcgtgtatcaccctagccacgtacatagtccagcagccagctctattgagagccaatcggccacttcacttctctccctagaactatgtggcccatcagcaatctctgtcctgctgctccagcacagtggcagcctcagggacttcaagggtctagtctgagggtcttgagcctaagcctatgtggggaagccctcatgaagccacaggccttttcttttctgagcccagatccccaacaacagatggcctctcccattttatccataccccct

SEQ ID NO: 178248 - DNA, 601 bp, Human
gtcagagtgaactgaaggaagctgggatcaaaaggttaggcaaagcagggagataaaagggggacagacacagatggaccccagagcgtcatggagccaacaacgtcccaactccaatagctccagaatcatttgtgcctaggttcaggtgcccttcccaacaagctgtgtgacctgggcaagggacttcatgctgctgggcctctgctttcctgtctatgaaatggagataataacagcaaccacctcaaagggaagttctaggttcaatgagatgatgcctgaatctgtgcaggccccragataatggcagttggggttcttggtgtcaacattgtggttgctgtgggacccctatgcccatctctgccacccttacccttgctgtcccccccacctctgacttgagcccacatgagtgatctctgatctttgccccaagaagagacagatgagtgcactgtagcctgtgtttggtctgctgggatggccctgtccttcgctgccccagccccatctcagagtgcccagggtctgggacccctcaggatacagcagctttaaggcacagtgcatccctttccgaagctgagcaggtcct

SEQ ID NO: 178249 - DNA, 601 bp, Human
gtgccacccacagctgaatgaacaaaagaaaggcagctaattcaagaacccctggttcctagaggaccagccccctaagaaatgttctgaaagatggttttgaaagattaggtgagcccctcctggtcacacttaggagtcagagtgaactgaaggaagctgggatcaaaaggttaggcaaagcagggagataaaagggggacagacacagatggaccccagagcgtcatggagccaacaacgtcccaactccaatagctccagaatcatttgtgcctaggttcaggtgcccttcccaacragctgtgtgacctgggcaagggacttcatgctgctgggcctctgctttcctgtctatgaaatggagataataacagcaaccacctcaaagggaagttctaggttcaatgagatgatgcctgaatctgtgcaggccccaagataatggcagttggggttcttggtgtcaacattgtggttgctgtgggacccctatgcccatctctgccacccttacccttgctgtcccccccacctctgacttgagcccacatgagtgatctctgatctttgccccaagaagagacagatgagtgcactg

SEQ ID NO: 178250 - DNA, 601 bp, Human
gggaggagctgcctcctgcagccctagctcccacctggccactcaaccccggaagtaccttatctgcctggaccttgggccaccgtccaactccctccctgcttctgagcctggctgtccccatctgtggtcatggttaagtatccccatccctcaaaagctttgccatctccatctgcggtcctcgttccatgactgccctctccagtccagactaggcttcaatttcccgatggcaatttaactggccctgctccccaaccccagccagcctcagtttccccactgccagcccaggttrtataaatgacctatgccccaccaggccaggcctcagtttccccatctgtggttttgatccatgactgacctttgtatttacccagccctgagcagattccacactctatcccctcccctgtgaccccagggcactcacacagctgggactccggggtccgcatgaccttgcgggactcctgccagatggtcttgcagtcctcctgcaacttgtagaagcgctctctcctccatgagctggacttcaccttcaggagctggctgcccttcagcagcgcctgtagatcctcatcatcctgta

SEQ ID NO: 178251 - DNA, 601 bp, Human
gctctctcggtgatggggggtgcagggccccagggagaggactggagcagggcaaggctcttagagatgcggacagaccactctggagtgtggggcccatgacagagaagggccatgcacccttctgactgtattggactttgggtctgtcctgacccgataaagccacaagagccaccaggcccctctcctgaacattcaagagactggaaccaccctcagttagccccagccctggggtctatgggcagagggccgaagacagagggagaagccctgcatgggagaggagacagggtcrtgccctgtgtgcagctgtgtgtgtcctgacttcagggagccccttggcagggggtacaggaagactctgccttccccagtcccaagaggcaaactggagggtctcctgcagggttctgagagattacatcattctgcccttaggggagccaaggggagggccctcccctcacacccagccttccaagcttcagggagatgccaggccctgtctacccccgcttccaatgtgccctccatggcctggccaggagccagttcttccagtcaggctcatgctgtgcctcccagcagcaggatc

SEQ ID NO: 178252 - DNA, 601 bp, Human
ccctaatgcccaacgtgatgatatttggagataaggcctttggaagataacttggttgagatgaggtcatgagggtggggcacccgcgctgggattagtgcccttacaagaagagatggcagagaacctagtctctctctccccaccatgtgaggacacagcaagaagacagtcatctgccagcaaaggagagagccctcaccaggctctgaccatactggctccctgaccttggacttccagcctccacactgtgagaaaataaattatgctgtttaagccacctatgatattttgttayggcagcccaaagtacctaaaccagcttccatacccaagttgccctggggataaccacagccagtgtccacaagccaggcctggacccactgccaccaaaaggatactgctgtagcttctgacgctggtccatggagcctgagtggtggatgatcttgtgcagccccagcacccagtgctgggcatcagctggcgatggggcgatgaggtctagtgtattgcgctggtccttgaagacaatggagaagcagcggtcctcgggcacatcacgggcgaacttctccagaccctccgtgcggtg

SEQ ID NO: 178253 - DNA, 601 bp, Human
atggccctgagcacatcgcagaagaggatcttggaagtgaaagtatagccgtggtagatgattggttcctggttgggcccgtcccagcagtcaagctccaggcatcggcagcctttgcacagtgccctgcggggagggtggtggctaggaccctccaggtcctgtcccgggtcccacccagactcccgacccaaggctccctgagcagcaccggatgtaggcttcagtgctgctgggcccggctagctggtcctccagcaggtaggtgttgtgtgaagaggacaccaggtagtggctaagyggctggcccatgtcctggtagacacggcggtgtgccaggctgaaggcgctgccgtcagccgacagtaagtacatgaggaagccgtccttggtcatctgccgctgcgccttggctgggagggaggaggccactgcccgtcagagccagcctccagcaggcgctcctggctgcccacccatctggacagaggagccctctgaacccgcttgcctgcctgtcctgagccagtcttccagagctcttggaattaggataagtctgaggctctcgaccagactgtggctactccagagtggggcc

SEQ ID NO: 178254 - DNA, 601 bp, Human
gtctataggcatgagccaccatacccggcctcatgttaaatttttaatgtttgtagcacattagtattagaaatgtgttggcacacttgaaaggatttttaaataacagctttattttattttcttttacttttgagatggagtctctctctgtcattcaggctggagtgcagtggtgtgatcatggcccactgcagcctcagactcccaggctcaagtgatcctccccgcctcaggctctatactaggtgggactacagacgtgcaccaccacacctggcttttttttttttttttttttgagacagggtcctgctttgtcatccaggatggagtgcagtggcatgaccacagctcactgcagcctcaacctcccaggctcaagcgatcctcctacctcacgctccctagtagctgggactacacatgtgtgccataacgcctgggtaaattttgtatttttgtagggacggagtcccactatattgcccaggctgatcttgaactcttgggctcaagcgatccatccaccttggcctcccgaagtgctgggattacagacatgagctcccgccctggcctggctaatttttttattttt

SEQ ID NO: 178255 - DNA, 601 bp, Human
gtaacctccaccttccgggttcaagtgattctcctgcttcaccctcccaagtagcagggactacaggcgtgtgcccccatgcccggctaatttttgtatttttagtagagacagggtttcactatgttggccagatggtgttgatctcctgaccccctgtgatctgcccaccttggcttcccaaagtgttgggattacaggcgtgagccactgtgcccagcctgatttttgtatttttagtagaggcagggtttctccatgttggccagcctggtctcgaactctggtttcaagtgatccsccagcctcagccgcctaaagtgctgggattacaggcgtgaaacactgttcctggcggaaaaaatctttaagtggactcgtgcagttcaagttcacattgttcatgggtcaactgtactcattagctgtactccccatttctccctcttcagaccctggtaaccactaatctactttctgcttcaatggatttttataatcttggtatttcatataactggaatcatactatatacagacttttgtgcctggcatcccttagtatgttttcataatgcaaacagtgtttttaggcatgtgt

SEQ ID NO: 178256 - DNA, 601 bp, Human
cgggttcaagtgattctcctgcttcaccctcccaagtagcagggactacaggcgtgtgcccccatgcccggctaatttttgtatttttagtagagacagggtttcactatgttggccagatggtgttgatctcctgaccccctgtgatctgcccaccttggcttcccaaagtgttgggattacaggcgtgagccactgtgcccagcctgatttttgtatttttagtagaggcagggtttctccatgttggccagcctggtctcgaactctggtttcaagtgatccaccagcctcagccgcytaaagtgctgggattacaggcgtgaaacactgttcctggcggaaaaaatctttaagtggactcgtgcagttcaagttcacattgttcatgggtcaactgtactcattagctgtactccccatttctccctcttcagaccctggtaaccactaatctactttctgcttcaatggatttttataatcttggtatttcatataactggaatcatactatatacagacttttgtgcctggcatcccttagtatgttttcataatgcaaacagtgtttttaggcatgtgtccgtatttgctccct

SEQ ID NO: 178257 - DNA, 601 bp, Human
atctttaagtggactcgtgcagttcaagttcacattgttcatgggtcaactgtactcattagctgtactccccatttctccctcttcagaccctggtaaccactaatctactttctgcttcaatggatttttataatcttggtatttcatataactggaatcatactatatacagacttttgtgcctggcatcccttagtatgttttcataatgcaaacagtgtttttaggcatgtgtccgtatttgctccctggctcatgtctgtatagctccaacttttttttttttttttttttttttgagacagagtatcactgtgtctcccaggctggagtgcagtggcgtgttcttggctcactgcaacctctgcctcccaggctcaaatgatctcccacctcagcctcccaagtagctaggactataagtgcacaccaccacgcccagctaattatttttgtattttttgtagagacagggttttgccatgtcgcccaggctggtcttgaacttctggactcaggcgatctgctcaccttggcctcccaaagtgctgggattataggcatgagccactgtgcctggctataactctgactactt

SEQ ID NO: 178258 - DNA, 601 bp, Human; identical to SEQ ID NO: 31882

SEQ ID NO: 178259 - DNA, 601 bp, Human; identical to SEQ ID NO: 31883

SEQ ID NO: 178260 - DNA, 601 bp, Human
cctccagacatttgtcaactacaatttaagtttttataccccagtactgactccagcaatagtcttctgctgctgggcatctgctccattaaactgtaattctatcttcctgtctacatttttggaggcaggtgtttgccctgtgacctcagtctctgatggatctaagaagagttgttgattttcagacttttttcctgttgtgaagacagaagtgacaagctcattacatattgaactggataagattaaatcttaaaattcttttaccttctgatgtccaaagcttttcctgtatagrtgatctcttgatgtcctgtttattaacaagatagtggccctgatttgcactattattacatctttgccagcaggggtagttgatagatgcaacaaaattcaaaggcctgcttgccaaataaactttcatgggactatttgggcagattcacaatgtttagtccctttgacagttgaggaaaaactgctgtctctttgaccctctgctaccctcaccacaccaccaaaaaggaggcctagcactatttgggctcgttgggcattagacagtatgtacctcacttgggcattctgtctggtc

SEQ ID NO: 178261 - DNA, 601 bp, Human
ccctgtaaattgtgagagttcctctaggttatcaagaaatggttttgctactcttaggatttggggattttaaattttgccaaaaacttgtttttgctaaaaaaaaactaagttgtagatttgaatggatagtataatattgtttacattgggagaaaagcccagatatgtcatcggtatatagtctgttaaccagactgataatagttgaaaactttggagagagtacttagacttgagaatgatggtcaaagggattttggcttttttagttgtgtttaggtttttaaaacaagaatakttttctatattacgtgttataaatagttaaaactatagagatgcctgagtaatttccatctttttgttacaggcaaagaatgttccctgttttcagttgcatactgatgattttaaaaatttgataattcattggggtatagaaaaaaatatatttcaaaatgtagaattaggtgagggtcacattctttggccacttttatcccgatcaagaatatttgatcacttgtgttttctagatattatagtaagaacctttctagctttctttttaatgtgtgggtttctagtaccagtgaca

SEQ ID NO: 178262 - DNA, 601 bp, Human; identical to SEQ ID NO: 31884

SEQ ID NO: 178263 - DNA, 601 bp, Human; identical to SEQ ID NO: 31885

SEQ ID NO: 178264 - DNA, 601 bp, Human; identical to SEQ ID NO: 31886

SEQ ID NO: 178265 - DNA, 601 bp, Human; identical to SEQ ID NO: 31887

SEQ ID NO: 178266 - DNA, 601 bp, Human; identical to SEQ ID NO: 31888

SEQ ID NO: 178267 - DNA, 601 bp, Human; identical to SEQ ID NO: 31889

SEQ ID NO: 178268 - DNA, 601 bp, Human; identical to SEQ ID NO: 31890

SEQ ID NO: 178269 - DNA, 601 bp, Human; identical to SEQ ID NO: 31891

SEQ ID NO: 178270 - DNA, 601 bp, Human; identical to SEQ ID NO: 25330

SEQ ID NO: 178271 - DNA, 601 bp, Human; identical to SEQ ID NO: 25331

SEQ ID NO: 178272 - DNA, 601 bp, Human; identical to SEQ ID NO: 112724

SEQ ID NO: 178273 - DNA, 601 bp, Human; identical to SEQ ID NO: 112725

SEQ ID NO: 178274 - DNA, 601 bp, Human; identical to SEQ ID NO: 112726

SEQ ID NO: 178275 - DNA, 601 bp, Human; identical to SEQ ID NO: 112727

SEQ ID NO: 178276 - DNA, 601 bp, Human; identical to SEQ ID NO: 112728

SEQ ID NO: 178277 - DNA, 601 bp, Human; identical to SEQ ID NO: 112729

SEQ ID NO: 178278 - DNA, 601 bp, Human; identical to SEQ ID NO: 112730

SEQ ID NO: 178279 - DNA, 601 bp, Human; identical to SEQ ID NO: 112731

SEQ ID NO: 178280 - DNA, 601 bp, Human; identical to SEQ ID NO: 112732

SEQ ID NO: 178281 - DNA, 601 bp, Human; identical to SEQ ID NO: 112733

SEQ ID NO: 178282 - DNA, 601 bp, Human; identical to SEQ ID NO: 112734

SEQ ID NO: 178283 - DNA, 601 bp, Human; identical to SEQ ID NO: 112735

SEQ ID NO: 178284 - DNA, 601 bp, Human; identical to SEQ ID NO: 112736

SEQ ID NO: 178285 - DNA, 601 bp, Human; identical to SEQ ID NO: 112737

SEQ ID NO: 178286 - DNA, 601 bp, Human; identical to SEQ ID NO: 112738

SEQ ID NO: 178287 - DNA, 601 bp, Human; identical to SEQ ID NO: 112739

SEQ ID NO: 178288 - DNA, 601 bp, Human; identical to SEQ ID NO: 112740

SEQ ID NO: 178289 - DNA, 601 bp, Human; identical to SEQ ID NO: 112741

SEQ ID NO: 178290 - DNA, 601 bp, Human; identical to SEQ ID NO: 112742

SEQ ID NO: 178291 - DNA, 601 bp, Human; identical to SEQ ID NO: 112743

SEQ ID NO: 178292 - DNA, 601 bp, Human; identical to SEQ ID NO: 112744

SEQ ID NO: 178293 - DNA, 601 bp, Human; identical to SEQ ID NO: 112745

SEQ ID NO: 178294 - DNA, 601 bp, Human; identical to SEQ ID NO: 112746

SEQ ID NO: 178295 - DNA, 601 bp, Human; identical to SEQ ID NO: 112747

SEQ ID NO: 178296 - DNA, 601 bp, Human; identical to SEQ ID NO: 112748

SEQ ID NO: 178297 - DNA, 601 bp, Human; identical to SEQ ID NO: 112749

SEQ ID NO: 178298 - DNA, 601 bp, Human; identical to SEQ ID NO: 25332

SEQ ID NO: 178299 - DNA, 601 bp, Human; identical to SEQ ID NO: 25333

SEQ ID NO: 178300 - DNA, 601 bp, Human; identical to SEQ ID NO: 25334

SEQ ID NO: 178301 - DNA, 601 bp, Human; identical to SEQ ID NO: 25335

SEQ ID NO: 178302 - DNA, 601 bp, Human; identical to SEQ ID NO: 25330

SEQ ID NO: 178303 - DNA, 601 bp, Human; identical to SEQ ID NO: 25331

SEQ ID NO: 178304 - DNA, 601 bp, Human; identical to SEQ ID NO: 112724

SEQ ID NO: 178305 - DNA, 601 bp, Human; identical to SEQ ID NO: 112725

SEQ ID NO: 178306 - DNA, 601 bp, Human; identical to SEQ ID NO: 112726

SEQ ID NO: 178307 - DNA, 601 bp, Human; identical to SEQ ID NO: 112727

SEQ ID NO: 178308 - DNA, 601 bp, Human; identical to SEQ ID NO: 112728

SEQ ID NO: 178309 - DNA, 601 bp, Human; identical to SEQ ID NO: 112729

SEQ ID NO: 178310 - DNA, 601 bp, Human; identical to SEQ ID NO: 112730

SEQ ID NO: 178311 - DNA, 601 bp, Human; identical to SEQ ID NO: 112731

SEQ ID NO: 178312 - DNA, 601 bp, Human; identical to SEQ ID NO: 112732

SEQ ID NO: 178313 - DNA, 601 bp, Human; identical to SEQ ID NO: 112733

SEQ ID NO: 178314 - DNA, 601 bp, Human; identical to SEQ ID NO: 112734

SEQ ID NO: 178315 - DNA, 601 bp, Human; identical to SEQ ID NO: 112735

SEQ ID NO: 178316 - DNA, 601 bp, Human; identical to SEQ ID NO: 112736

SEQ ID NO: 178317 - DNA, 601 bp, Human; identical to SEQ ID NO: 112737

SEQ ID NO: 178318 - DNA, 601 bp, Human; identical to SEQ ID NO: 112738

SEQ ID NO: 178319 - DNA, 601 bp, Human; identical to SEQ ID NO: 112739

SEQ ID NO: 178320 - DNA, 601 bp, Human; identical to SEQ ID NO: 112740

SEQ ID NO: 178321 - DNA, 601 bp, Human; identical to SEQ ID NO: 112741

SEQ ID NO: 178322 - DNA, 601 bp, Human; identical to SEQ ID NO: 112742

SEQ ID NO: 178323 - DNA, 601 bp, Human; identical to SEQ ID NO: 112743

SEQ ID NO: 178324 - DNA, 601 bp, Human; identical to SEQ ID NO: 112744

SEQ ID NO: 178325 - DNA, 601 bp, Human; identical to SEQ ID NO: 112745

SEQ ID NO: 178326 - DNA, 601 bp, Human; identical to SEQ ID NO: 112746

SEQ ID NO: 178327 - DNA, 601 bp, Human; identical to SEQ ID NO: 112747

SEQ ID NO: 178328 - DNA, 601 bp, Human; identical to SEQ ID NO: 112748

SEQ ID NO: 178329 - DNA, 601 bp, Human; identical to SEQ ID NO: 112749

SEQ ID NO: 178330 - DNA, 601 bp, Human; identical to SEQ ID NO: 25332

SEQ ID NO: 178331 - DNA, 601 bp, Human; identical to SEQ ID NO: 25333

SEQ ID NO: 178332 - DNA, 601 bp, Human; identical to SEQ ID NO: 25334

SEQ ID NO: 178333 - DNA, 601 bp, Human; identical to SEQ ID NO: 25335

SEQ ID NO: 178334 - DNA, 601 bp, Human; identical to SEQ ID NO: 25330

SEQ ID NO: 178335 - DNA, 601 bp, Human; identical to SEQ ID NO: 25331

SEQ ID NO: 178336 - DNA, 601 bp, Human; identical to SEQ ID NO: 112724

SEQ ID NO: 178337 - DNA, 601 bp, Human; identical to SEQ ID NO: 112725

SEQ ID NO: 178338 - DNA, 601 bp, Human; identical to SEQ ID NO: 112726

SEQ ID NO: 178339 - DNA, 601 bp, Human; identical to SEQ ID NO: 112727

SEQ ID NO: 178340 - DNA, 601 bp, Human; identical to SEQ ID NO: 112728

SEQ ID NO: 178341 - DNA, 601 bp, Human; identical to SEQ ID NO: 112729

SEQ ID NO: 178342 - DNA, 601 bp, Human; identical to SEQ ID NO: 112730

SEQ ID NO: 178343 - DNA, 601 bp, Human; identical to SEQ ID NO: 112731

SEQ ID NO: 178344 - DNA, 601 bp, Human; identical to SEQ ID NO: 112732

SEQ ID NO: 178345 - DNA, 601 bp, Human; identical to SEQ ID NO: 112733

SEQ ID NO: 178346 - DNA, 601 bp, Human; identical to SEQ ID NO: 112734

SEQ ID NO: 178347 - DNA, 601 bp, Human; identical to SEQ ID NO: 112735

SEQ ID NO: 178348 - DNA, 601 bp, Human; identical to SEQ ID NO: 112736

SEQ ID NO: 178349 - DNA, 601 bp, Human; identical to SEQ ID NO: 112737

SEQ ID NO: 178350 - DNA, 601 bp, Human; identical to SEQ ID NO: 112738

SEQ ID NO: 178351 - DNA, 601 bp, Human; identical to SEQ ID NO: 112739

SEQ ID NO: 178352 - DNA, 601 bp, Human; identical to SEQ ID NO: 112740

SEQ ID NO: 178353 - DNA, 601 bp, Human; identical to SEQ ID NO: 112741

SEQ ID NO: 178354 - DNA, 601 bp, Human; identical to SEQ ID NO: 112742

SEQ ID NO: 178355 - DNA, 601 bp, Human; identical to SEQ ID NO: 112743

SEQ ID NO: 178356 - DNA, 601 bp, Human; identical to SEQ ID NO: 112744

SEQ ID NO: 178357 - DNA, 601 bp, Human; identical to SEQ ID NO: 112745

SEQ ID NO: 178358 - DNA, 601 bp, Human; identical to SEQ ID NO: 112746

SEQ ID NO: 178359 - DNA, 601 bp, Human; identical to SEQ ID NO: 112747

SEQ ID NO: 178360 - DNA, 601 bp, Human; identical to SEQ ID NO: 112748

SEQ ID NO: 178361 - DNA, 601 bp, Human; identical to SEQ ID NO: 112749

SEQ ID NO: 178362 - DNA, 601 bp, Human; identical to SEQ ID NO: 25332

SEQ ID NO: 178363 - DNA, 601 bp, Human; identical to SEQ ID NO: 25333

SEQ ID NO: 178364 - DNA, 601 bp, Human; identical to SEQ ID NO: 25334

SEQ ID NO: 178365 - DNA, 601 bp, Human; identical to SEQ ID NO: 25335

SEQ ID NO: 178366 - DNA, 601 bp, Human; identical to SEQ ID NO: 153265

SEQ ID NO: 178367 - DNA, 601 bp, Human
ccccaacccccggccgaggcggcggaactcacgatcatcttcttatagagaccgtaatgcaggaccaggctatgggtcaatgccaggcgatggggcttcatagggtgtccagctcctgggggtggggagaagagagttcgtcagctctcacccctggagttgcaaccccgcctcaaaacctccgtgtcccaacccctcatgcatatccctgtttcctcaccgtagtggaagttgcccacgtcggggtcgtagaaataggccacggtcttggccatggtgccggcgggagcaggccccgcamctccgccgcccgccgcccgcggccgccgccagcccctccccggccgtgcgtgctgcgcaagcacgtagccggcctctgcggaactgggcgttgcggccccgcctccatccacacccaggccacgcccccaggggagctccgcccctcgcccggctcagctctcccggtatctggggctttgagcgtcccgggttgggcagggaactggcagcatagctcctaggatgcgagggccatttgtctccggccgggggtcagatcctcgggaagccgagccatcccatccagccgcttgcccca

SEQ ID NO: 178368 - DNA, 601 bp, Human
cagcatgggcaggaacggtcctctggatggtagtcttgggcttgcattggtgtccccatcttttctggtccctgaaatgctgaggtccagcatgatagcaagtaggtaaaagggtatgtcctaagcaataaatgatgggagccaccaggtaatattcccccaaagctgactcattcctgcttccttgccaatctctttcatccttcagctgaggacgatgacatgaatgaggacacagtagagaggattgttcgctgcatcatccagaatgaaggtgggtctagcatagccccttgctccstcttctccaaccttctcttgccctgacctccacctccactgactccctcttttccttcttccctcagccaatgctgaggccttgaaggagatgctgggggacagtgaaggagaagggacagtgcagctgtccaggtgagctggaaacaagggccagcatgacttagcttgccttggagagtatcctctcctccagcacaatcctctcccagcctccttgcatgtatggggttgggggaagggcaaagctggctaacttataggaagaaagttgttttgtagaaatcgcgattccttcaaa

SEQ ID NO: 178369 - DNA, 601 bp, Human
tttgggttaagcagtgttctttttagcaaacagccctgggaggaagaacatatggtcactaacatcttaatattgagtttattagataaagacaagaaaaaatggggcttggggaaattggggcttctggggttttaaggagcatgctgaaagaacgtaagaaacaaaacatgaagggaaatggaaatgttaccctcactcccctcctccctgctgtccagtgtggatgccacctccagcctgcaggacggagccccctcccatcatcacacagtgcacctgggctctgcagccccttgcmtccattgcagccgcagcaagaggcctccacttgtccgtcagggacgctccaaggaaggaaaaagccgcccccggacaggggagaccactgtgttctctgtgggcaggtggggcaggtgctccagggaaaggggggctgaggtagggggcccagtgatcaggcacctgatcccaaaagtgggccttggctctttcctcctggactgggagctccggcagaagtcaggctacacaatgtgccccacaatctgagaaggcctcccctaccttaggccagagggaagtagccaccaaactcagg

SEQ ID NO: 178370 - DNA, 601 bp, Human
gacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtaggaaaacacagccggsactgcactgggctgggctcttattgctctctactctggggggcactgataggacctactcctggtctctcattgttgacccctcccctttctctcaggtgtctctaccacagggagcagggagtatgtgaggtgagtctgcctgagccctaaatgaggtaatctcatcttcccatcacctacttaaactatttaagcctttcggctccctgaaccccccgagtaaactgcaggcttagcctttgctataaatcccttggtttggtggtggaggtagggaaggtcctggagccccagggga

SEQ ID NO: 178371 - DNA, 601 bp, Human
ccagggctgcccactcaagaggcaaatgggcagccaagcaaaccagacacttctgatcaccaggtaggaaaacacagccgggactgcactgggctgggctcttattgctctctactctggggggcactgataggacctactcctggtctctcattgttgacccctcccctttctctcaggtgtctctaccacagggagcagggagtatgtgaggtgagtctgcctgagccctaaatgaggtaatctcatcttcccatcacctacttaaactatttaagcctttcggctccctgaacccccmgagtaaactgcaggcttagcctttgctataaatcccttggtttggtggtggaggtagggaaggtcctggagccccaggggaaaagctggacacagcttgaacaggaagcaacagtgttattcttcctcttctccaagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcac

SEQ ID NO: 178372 - DNA, 601 bp, Human
ctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccattacagctgcttcgcatcctggctccagctcctgattcccaaggcctgttcctctccccagcccaaccccagtgaccctggcatccagagtggggtgggtcatggagccagggtggggaaagaggtgggccagaacyactagagaccttgatggatggtttccagccccagagatttcaggcatttcaccaccctagatagggtcatgacagaagagaaggtagttccggtcctagagatgatagaacaatgggaaaaaaaggagtgggttccagctctagaaatgggaaggggcaagtttccacccttggaggtgagggtggaaataagggcgattccagcttttggctgtgttgctctggatcattgatggtgtggtctgacagcttgaagatagggacagcagcatcactgggggtcaaggcttccctggcctt

SEQ ID NO: 178373 - DNA, 601 bp, Human
ccgtatttagaacctgcataagccaggaaaggtatgtagcagctaaaggaattataaaccctcaaatgcaaacaaccttcgggcacacttagtccaaaccagtgcagttttatacagtacattcttaatggagttccagaggacacatactctagaaaaggtggaggcggcgaaagacctttgagttcagttttagcctatagttcaagaaaactaagccacgggtatcaaaagcacaccagcaatctcgcccactccacccacccacgtatacatacacagacacaaagagaagtggatkgcaatgctcctcctcatctctcatttccacagagttctcataaaaggagcaagaggaagaaagaatattctgatgccttgagataggttacatttggcaataaaagggttaagcagcactactttcctagaaaccttccaattccgtagctactaatgcaattttcctcattacctgagctatttagttttaaaaattcagcagattaagggttaagactaacaccgcagaaagaaaagagaacttggttcagctccatcctctctaaagcaaatacctacaaccctgagccaaatccat

SEQ ID NO: 178374 - DNA, 601 bp, Human
acaaaaactgcactcccaaaactgggaacaccccaaatgtccatcaatagggtaaatgaataaacaaattgtgtaaatccatacaatgtaatagtactcagcaatataaaggattaagctattgatatatgaaagaccacacatcacaataaaagaagccccagcaaaagggttcatactgtatgattccatttatataaaattctagaaaacacaaactaatctatagttacagaaagaaaattagtggtaatctggagatgggaggacgaggatgggtgagagggagggataacaaagrgagaaggaggaaacttgaaggtgactgctatattcattatcttgactatagaaatggtttcatgaataaatatgcagtttattgtattttaattatatatcaataatgctgtaaaaatagagatgaagggtatcttttctacttgatcttaaagttctgacactgaaaataaaacacagacagatctgagatgtaaggccaactaccaacgtatgctctttggttttctgtgaccttcagtatcaaaaatggtttataaatcatcctgtcttgggtccttacagtattttaaatcttaaa

SEQ ID NO: 178375 - DNA, 601 bp, Human
gaataataacagtacctattttataaggtcaatgtagagattaatgagataataaatctaaggctctttagcactgcactagggatacagttaagtatgcaacaaacaactgcttttattactgctactgttgttattccctatcctagtctggaatgaattaattttccttatctataaagatgctaaacattcattaatatttagaaacaggaagactggcattacacaatctgtagtatactgaatacaggaaaacaaaaggttgctaacaccaccacctaacaagaaaaaaatgctyccacgataaatggaatgaaagtcccgaaatcctcagagtatcagaaatgttctctgttgaccacaggtgacaatttatatcccaaagtgaacatgtggaactcacatatgcatgatagaaaagagggaaatttaaaagctaaatctatacaagttctagaagaaaagagagaagccgagcacagtggctcacacttgtaatcacagggctttgggaggccaaggcaggaggatcacttgacgctaggagttcgagaccagcctgggcaacatagtgagaccccatttctttctttctttc

SEQ ID NO: 178376 - DNA, 601 bp, Human
aggcacaaaaactggacacacataaactgtcagtacaatgtagtgagtaagtccatgagttttgaatcagctaggcctaggtttgaatcctagctctgtcactaactagttctatgtcttcaagcaggctgcttgatctgagttccagtttcattacctataaaatgggaataataacagtacctattttataaggtcaatgtagagattaatgagataataaatctaaggctctttagcactgcactagggatacagttaagtatgcaacaaacaactgcttttattactgctactgttrttattccctatcctagtctggaatgaattaattttccttatctataaagatgctaaacattcattaatatttagaaacaggaagactggcattacacaatctgtagtatactgaatacaggaaaacaaaaggttgctaacaccaccacctaacaagaaaaaaatgcttccacgataaatggaatgaaagtcccgaaatcctcagagtatcagaaatgttctctgttgaccacaggtgacaatttatatcccaaagtgaacatgtggaactcacatatgcatgatagaaaagagggaaatt

SEQ ID NO: 178377 - DNA, 601 bp, Human
agtctagtaacagcttcccccttcctgtaacattgttaccactacttgtggctctcagcaatttaaacaactaaaactcctgacaggtgatgatgttagagctgttctacttacaaaggagacacagttacattaaaaaataataatttaagcatcatcctaataacgcatgagccaagcgaaagataggttttgcaagcactgtaatagctattttttcatgcctaaaaaaggtttaattaagattcttccaatggcttcaaagtctaaattactaaatgcaaaaaaaaaaaaaaaaaaacaggcatttagccactacgctttttacatctaagcctagtacttttttcctgccaactgaactctaggagaatccagttcattttaatagactgtagatgaccaaagaactctaagggaataccaccaaaattttctaagaaattcctagcagtgaatagttacactgcagtccagttttacactgcaggcacaaaaactggacacacataaactgtcagtacaatgtagtgagtaagtccatgagttttgaatcagctaggcctaggtttgaatcctagctctgtcactaactagttct

SEQ ID NO: 178378 - DNA, 601 bp, Human
ctaggttcaagtgatctcctgcctcagcctcccgagtagctgggattacagttgcacaccactatatctggctaacttttctatttttttagtagagaaagggtttcgccatattggtcaggctgattttgaattcctgacctcaagcgatccatctgcctcagcctcccaaagtgctgggatgacaggcgtgagccaccgcaccgggactatattagaaccttcttaacagatcatttgttgtaactttttctgtgaaccagactaaattgcatgagggcaaaatcatgtcttattcaamtgatgtggcccacattttaataaataaattttaaaattagcatcactacaggtttaggagcatcatccgaaacagtatatttattctttcattactctattcaaattgagaaaagtaaggaaaagtttcaattcaaggtatatgacagtacactatgattgttacgaatagctcagtaaatcaaaccttcaagagtaatgtctttccttatgaatgagaccaaggaaccttgactggagcccacaggacaataagccctcaataatgacaaagtctacctatgggtaaaatgggaaataa

SEQ ID NO: 178379 - DNA, 601 bp, Human
ctagaaaatctaaacttacaatgtgattcacattagatttctattggatggtgctgtcctacagcaaagcaaccagctttcaaatcctacccacgcacctagagtttccaatctgctttgtaatccctcattcttaaacatgagtagacaacccaggattatcagacatctgaggaaagatcctaacatgagagaaagcggggctgggggaagcaacttgccaaataaacagtatgcaacaagaagaaagatgttctaaaaatcattaatatccacaacaaacattcagaggaaaaagagstcattagaagtttaaaatacaagaacagaaatgaaaactcaataaaaggactggaagaattaaggaaattccccaaaaagtacagcaaaaagataagaaaattagaagaccagtttgggaggaccaatatccaaataataggagaaaacataaaatagagagcaagttatcaaggaaataaagaaaatttcccagtattgaaggataagtctctagcacaaaggacaaaaatagattattcaaaggcatataatggtgaaatttcaaaacaccggaatacaaagaaaatcctacaaaatt

SEQ ID NO: 178380 - DNA, 601 bp, Human
aggatcagctgagcccccagaggttgcagcaagctgagatcacattgctgacaacagagcaagacaatctcaaaataaataaataaataaataaataaaaatttagcgtctcagttgagatgtctgtaaatgtaaaataaacactgcaattcataacaatataaaaaagtaaaatatttcattaataatttttatatttcattcatattgaagtaatattttagatatattaatttcacgtttctaaaactagaaaatctaaacttacaatgtgattcacattagatttctattggatggygctgtcctacagcaaagcaaccagctttcaaatcctacccacgcacctagagtttccaatctgctttgtaatccctcattcttaaacatgagtagacaacccaggattatcagacatctgaggaaagatcctaacatgagagaaagcggggctgggggaagcaacttgccaaataaacagtatgcaacaagaagaaagatgttctaaaaatcattaatatccacaacaaacattcagaggaaaaagaggtcattagaagtttaaaatacaagaacagaaatgaaaactcaataaaaggac

SEQ ID NO: 178381 - DNA, 601 bp, Human
tacgaaagaagctcaacatcatatgtcatcaggtaagtgtaaattaaaataagataccactacatacctactagaatagccaaaatccacaacacggatgatgccaaatgcttgcaaagatgtggagcaagaactttcttttctttttttctttttgagatggagtcttgctctgtcaccaaggctggagtgcagtggcatgatctcagctcactgcaaccttcttccaggttcaagcctcccgagtagctgggattacaggcgcatgccaccacacgtggctaatttttgtatttttagyatggggtttcaccatgttggccaggctggtctggaactcctgacctcaagcgatctgcccacctcggcctcccaaagtgctgggatttataggcgtgagccaccgcacccagccgagcaagaactttcaattcatggctggtgggaatgtaaaatggtacaaccactttcgaagagtttcacagtttcttataaaactaaacatacactaacataagatccagcaatcatgctccttggtatttatttatccaaaggaagtgaaaacgtatgtccacaccaaaaacctgcagagaaatgt

SEQ ID NO: 178382 - DNA, 601 bp, Human
gacaaccaacaacatagttccttttgtcaccaccctaagtcccttggcatatagaaggtgaaacaagcacaaaagggatgagtgcatacaatttgggttaccgtagccaaggttaaacttatttgctcccagagtcattgcttccaaaatcttgtcccccaaactcaaagagttccctcagaaccaagcaacaagcaaacaactctaagatagatgtaatgtagataacagaacctgcgtctaaagaattaatggcagctgaattgttcacagctgaagcttaagtttaaaaaaaaaaaaagggtggggggtaaccagcaacctgttctttctgcctacagactcttgattcgtctctcttccatccatgtctactagcactacctaagttcacaccattattgtctcctgtttgatttactccaacagcctcctaactgatctccctgccttcagtcccatctgccccataccacatccattctccatactatatccaagaggaaatctttctaaaatgccaagctgtccatgttatttctccattgaaaagccttcaataactctccgctgccctatgttaaaatcaaaattcctgtgc

SEQ ID NO: 178383 - DNA, 601 bp, Human
gactagcctggccaacatgatgaaaccctatctctactcaagctacaaaaattagccgggcatggtggtgtccacctgtaatcccagctactcaggaggctgaggcaggagaactgctcgaacccagaagacggaggttgcaagtcttgctctgcttgcgacagagcaatactccatctcaaaaaaaagaggaagggaaacctatagtttaaatgaaaattgagaataccagtacagtggactatatttggaattgtgatttgaacaaactggtttttaaaaaaatgacctaattggggawattcaaatagtgactaggatattttatgttattcaagatttattatttttttaaaattacggattgctgacttcttttgaaaaatagaaatatctggcactactaggcaagtattcccaactggaatgcaaccacctactagaactgagttgtggctggcttttctaacaaaaatgccaaaagcctctcttcaatttgccacattccccacttcttttgccatcttctatctagcctgcttaccttatttatactacctgcctggcccaagagacatttaaacttgcaatccaaggccaa

SEQ ID NO: 178384 - DNA, 601 bp, Human
ccttaaaaatctcttcagactgaagcactggatgaatggcataatctaaacacaagcaaaatcaacagcaacaaactctgcaccaactctagggcctacaaacccattacccctggttaactcagtccctgtacaaactcctttcccacgaagaaagaactggaaactctatgataaagcagaggccccctgacagacataatctgatgtatgtttggggaaaggctctgcttgatctttctacatatataacaaccatgtgtccaagcctagtaccttggtgtgcacaaatttagccctrataattccagaatgttatttgaattgagaaaaatatggatggggggatgtattctgtttcttctgcaagcagcaaaattaatctgaagtttctgtgacttaattcctggtgggttttttttttttgagacggagtctcactctgtcacccaggctggagtgcaatggcacaatcttggctcactgcaacctccacctcccagattcaagtgattctcctgcctcagcctcctggcagtagctgggattacaggcgcccgccaccacactcagctaatttttgtatttttagtagagacgg

SEQ ID NO: 178385 - DNA, 601 bp, Human
atctccctcttgatgatgatgtccttctccctcaaaggttgctgtttctcctcattcaggttcatatccagctaggagagggagaaaaaagagaaaaaacaaaattgcctcaaattctttacaaatttttagtgtttaatattagtatgcttagtgaagagttgagcatgtaaaatgcttaagtaaataaatctttttgatccctagaaatttaagctattacagctgatgaaaattcctcaaagataagtatagttaacattttagtataaatctctatagacatatacacactttttttctctaagaaaaatggactcaatataaatgaaagatttattttgtattattgaaagaaaaccacacacaatgctttctgcatcaaggatggaccttaaaaatctcttcagactgaagcactggatgaatggcataatctaaacacaagcaaaatcaacagcaacaaactctgcaccaactctagggcctacaaacccattacccctggttaactcagtccctgtacaaactcctttcccacgaagaaagaactggaaactctatgataaagcagaggccccctgacagacataatctgatg

SEQ ID NO: 178386 - DNA, 601 bp, Human
tccctcttcaataataaaaatctatcctatatatgcagttagttttataggcataagtgtcattcctcagctcttaagatactatcttttgcggtggcagatgtctagaatcaagggaacgcaatatgtttgtctatgcttaggaaacgttctatgagactataccatgccattaacagtcattctctttgcagaataggatttggcaaagggatgaggcagttaaattttactttatatacttctatatcgtttgagttttaaaaataacattgtgccacttctgaattaaaaaaaaaaagaatagtaaaaagaaaccctcatcctagacaatacagatattaatggagatataggagacattttgctatacctctgatgaccagtggaacattcaggatagcacccatcacttaggaattgttcttaaattttaagatgcttagtgttcacttctgggaagaaacacaatcttacctagtatttatgaccgagaggacacccaaccaactcaattgtcctctgaactaagagaaaatgataaaattgaaaatggagaagaaaaattattccagtcacatacatgtcctctggctgcggt

SEQ ID NO: 178387 - DNA, 601 bp, Human
agggaaataggctaaggaaagcaaatatgcagaaattatgtttgacaggtggcttatttaactcttgaaaaagctagggaaaagtagcaagacaccacttccattctactggctgttcttcctgtaaacatcaccagaaactttaagctttctaaaacgtcctttaagggaccagtgaattgggtggtactatacacacagaggattcctagtaagtacttggcttgaagatcaggcagtagacagaaaataagaggtaactgcctcaaagtcacttactgaaaatattaacaggtaactmaattactccctctgtcagtccaaacatctctaaaagccagttctacatcttagtaagctaagctatcacattctaggaagtttacactgattttgatggcttccatgctcaacaaccctcagatcacctttactgacttccctgatctatgataagctaagtaaagccagcgcaataaaaatacacctgccttatttaatgagaagacacataagcctgatgctctgttctgagtcatcatctcccaaaccattccacacagggatcagggaactaaatacaatgaatgtctcatctgcc

SEQ ID NO: 178388 - DNA, 601 bp, Human
ctattgttctaggggtaagaggcctaaaatgccaagcaaacctgagagtgccattactattacatgagtatcatctgtctttcttttcctgcccagtagcccaagaactgaaagtccaccactagagctccctatgaagacatccatatcactttctccaatgactaccctatactggaaaggtttcccctgggaactacactattgggtgctaaacgcttccaaaataccacagaggaaaactgtctcatagatcaggaaaataataattctcaaagaaagatatactcaaacacatgtytttggtctctcatatgcaccttcttttccagctctgcagctttggcttcagatttctccacctttgtcttatcaatcatttgatctgaaaagaagaagagtcagtaagtaaagctcctaattctcttgttctatttctttcacactacacccttccaaagaacagtctttttgatcatttttattatctttcttaatgttctgcactagacaaagaaatggaactttcagttaagttcaacatgtaatctgagtgtgcggtaaggccaccatgctgggtggcaagaagaatgcctatgag

SEQ ID NO: 178389 - DNA, 601 bp, Human
actttccatctttttcatttccacctgtagctcatgtcgggctgttaactctgagtccaactagagaaaaaacgaatcaggctcccagcaagctctccatctcagtaagaagcacaagtattattacccataattctccctacctcctcttttgcctgggggtgctggaatccccccactgcctcctgttctgggccagtacttgatttacagagctcataaatccaggccatgctcgggggaaaaaagcaccatgattctgaccttaaaatcaaggtttggctgggcggagtggctcacrcctgtaatcccagcacttcgggaggccgaggcaggtggatcacctgaggtcagaagttcgagaccaacctgtccaacatggtgaaacctagcctctaccaaaaatacaaaaattagccgggcatggtggtgggcacctgtaatcccagctacttgggaggctgaggcaggagaactgcttgaacccaggagacagaggttgcagtgagccgagatcgcgccactgcactccagcctggatgacagagtgagactccgtctcaaaaaaaaaacaaataaaaataaaaatgaaaataaaaca

SEQ ID NO: 178390 - DNA, 601 bp, Human
gggaacaatactgtgcatgcaaatatggcctatgtaggccaggtgtggtggctcacgtctgtaatcccagcactctgggaggccaaggtgggcggatcacaaggtcaggagttcgagagcagccagaccaacatggtgaaaccccatctctactaaaaatacaaaaattagccaggcatggtggcacacgcctgtaatcctagctactcaggaggctgaggttgcagtgagcagagattatgccactgcactccagcctgggcaacagagcaagactccaactcaaaaaaaaaaaaaaaaatggcctgtgtaactcacatcctgcggaattgggataggagagtggattcataaatccatgactttgggatcagcacaattatcagtagtttgcagactggtgaatgactattatcaaactgtgtgttaccatggtattcacagcctcagagaaaaggcaaaaaacattaagttaagattaaattcagaatacagggttcacagaactctccgtggtgatgtatggaataaagaagatgcctaatatctcctgaataaacataagcatgagtgaagcttaaagatagaaagatgaaagcct

SEQ ID NO: 178391 - DNA, 601 bp, Human
cagttcatctgttaattggtgattattcaagaactagattcatatatatactacgtatcctcctcctaactccaaatcctctagcttcataaccattaaggctttatttcagagaagtcttgctcatcattaaatttctcccaccagtttggctaactgtgccaaatttgctcattttatgagcaaatccctaaggtcctttatattaacttggtttctagaagaaaaaggctaactcactcagaatcacaggcatctcaaacacatcatgggaacaatactgtgcatgcaaatatggccyatgtaggccaggtgtggtggctcacgtctgtaatcccagcactctgggaggccaaggtgggcggatcacaaggtcaggagttcgagagcagccagaccaacatggtgaaaccccatctctactaaaaatacaaaaattagccaggcatggtggcacacgcctgtaatcctagctactcaggaggctgaggttgcagtgagcagagattatgccactgcactccagcctgggcaacagagcaagactccaactcaaaaaaaaaaaaaaaaatggcctgtgtaactcacatcctgcggaatt

SEQ ID NO: 178392 - DNA, 601 bp, Human
attgtttccttttagtaaagaggcaaaatgatctgagagtggcaatgaataacaaagattacatctaccccatctccaagcccactggggtgaggtctatgagaacaaagaaaaacaatcacatgggctgggcctagtggctcatgcctgtaatcccagcactttgggaggccaagatgggtggatcacctgaggtgaggagttcgagagcagcctggccaacatggtgaaaccctgtctctactaaaaatacaaaaattagccaggtgtggtggtgcacacctgtaatcccagctactcrggaggctgaggcaggagaattgcttgtgaccaggaggcagaggctacagtgaactgagagcttgccactgcactccagtctgggcaacagagcaagactccatctcaaaaacaaaacaaaacaaaacaaaacaaaacaaaacaaaacaaaaccacataagcaagcaaaagggaaagtggtattgagagaaaaccaggtttccagtagagcaaagtgaaaaaggttttgccagtaatggaccatgaattccagagggtacagtggaccagtttcaggagcttaggtgggatgggaggagac

SEQ ID NO: 178393 - DNA, 601 bp, Human
gtttaagtaatactgaccccccaactagatggtctaagtctcagacaatgacatttaaaaggacatttggttagaaataaaatctggaatccacagataatggcagatggtaccttggacttaaaagataccatttcagtctatatgtttctagaaaagagtaatacaggcacacactaaagctgggatggctagaaagaggctctaaaaatgagactagctggggataattaggagttaacatatgacacaaagggttgactttgaccgtgaaaatctttctgcaccagcatattctatycaagttagaccaggggaattccctgaagaaatggattcagtatgttatctcaagctagttatccatatataatgtgggtaggttctattatgcgcttaaagtagtttttcagcagaaactgagacagagatgggattatgagtgtgtatataatgaggctacaatgagctaccaagctgataaaatacaaacctctctttgagccctctcaaaggaaggctatgctttcatgaaggtatcagactaaagaacaaaaacctttccagcctctggaccccaaaaagaacacgaatattgcta

SEQ ID NO: 178394 - DNA, 601 bp, Human
tgttcttcactacttttgcatttcaaacgaatcagtcctacagagtccaagttaattttgtcacaaatcttgatgttgagctctaaaattcaactaatagaaactgaggcacaagaagggaaaataattttcagtctctaaagacaaagggcacaagtcaacagccctgagttgcagttactgcttggttatgatcagtaatagtttctaggagacaacagaacggaagggaggtccttttatagtacatgattccccagcttcaataatggactaatgacccccggaatcccaccgctayagcctgcacttccccaggaattcctgtttaaggcgtctctcaatgaagaccacaaacaggaaatggaggagtggggagttgcctgacatcctggaaactacgttcttaaagaactgcaggtgggagtaagtgggatagaaaaatgggcttttcaaaaactgttgagaacacggactgagtcagttgtatccgcacggctggaagacaggcagctccacctaacctcactcacttactcaggaccaaaaccctacttgctctgcccaagataaagcctgcagcatttgtacctattctaca

SEQ ID NO: 178395 - DNA, 601 bp, Human
actaaagaggtaagtacctatttaaaaaaattagaataagaataataaaataaaccaaaagaaaaatttaaagatagagacaagaacagaaattagtgaaatctgtagcagaggggattcacgaagccaacagttttggcttaaaacattttttttaagaccagttaaattcagtattttaaaacaagaaagaaaaacagagaaatcaggcataagtaactaacatcaggaacaaaatacaggactgaactaaatatggctcaggctcaagcattaagaggaataatatcaggcagggcgyggtggctcatgcctgtaatcccagtactttgggaggctgaggcgggcagatcacctgaagccaagagtttgagatcagcctcaccaacatggtgaaaccccatctctaccaaaatacaaaattagccaggcatggtagtgcatgcttgtaatcccagctactcgggaggctgaggcaggagaatcgcttgaacctgagaggcagaggttgcagtgagccgagattgtgccaccgcactccagcctgggcaacaagagcaaaactccatccccacccgctccccccaaaaaaaggaataat

SEQ ID NO: 178396 - DNA, 601 bp, Human
gttaaggtcacaaaaaataaaaactgaggaactataacaaagagtctgacttcattttttgatgtttaactgctgacagctcacctcttcctctttctctcatgtcctatatctgtacataagccagatgtaaaccttacctctttttctttctcctaagtcccttatccaggcaagctgatatgaaagtctagatgttccttccttgggaatcagcaagaaatccaaactaggtaaagtccgctcttgtgtaagaactctcaccccagcccaagcccctaaccacaataaaagcccaaaygaatctcctttccctgttctttcttttctttttttttcaagacagagcctcactctattgcccaggctggagtgcagtggcacaatctcagctcacctccacctcccaggctcaagcaatccttccacctcagcctcctgagtagctgggaatacaggtgcacaccaccatgcccagctatcctttccttgttctctacagtcatttcaaacctgcttgagaggattgccctgctctcctggacctcaattatgttaataaaccttttcataccctcttgttatgcatgtaacacgaata

SEQ ID NO: 178397 - DNA, 601 bp, Human
ttagtcaggcatggtggcacatgcttatagtcccagctgcttaggaagctgaggtaggaggatcccctgagcccagaaggctgaggctgctgtgagctgtgattatgccactgtactcagcctgggcaacagaatgagaccctgtctcagaaaaaaagcaacaacaaaaaacagtgtgagatgatgagagaagaacacattaagcaaataaagaaataaaagaaattccataaacagacatatattttaggctttgtggaccatatattaatagtttctgttgcaactactcaactctgcyggcataatatgaaaatagtcattgacaatgacaatagaatggctgtgttccaataaaaccttattaacaaaacatgttggccgtagtttgctgactcctggtctaaccaatagtgttgggacgactggctttccattttaaaggaatatagtaagatcctaattttatgatattcacaaaactaaattctagatacattaaaaatctaactataaaaaacagaaatataatcttgaataaatgaaaacttccctaagaataacaaaaaatcaagatggtataaagtaaaacatatgagac

SEQ ID NO: 178398 - DNA, 601 bp, Human
gggcatttacaggtctaaattaccctctaaccagtgctttctgtatatctcataaggcataaggttgttttttttcttttttttgagacggagtcttgctctgtcacccaggctagagcgcagtgacatgatctcagcccactgcaacctccgcctcctgggttcaagcaatcctcctgtctcagcctccttctcgagtagctgggattacaggcacatgacaccatgcctggctaattttttttttttttagacggagtctcgctatatcgcccaggctagaatgaagtggcacaatctyggctcactgcaacctacgcctcccgggttcaagcgattcttctgtctgagcctcccaagtagctgggactacaggcgcctgccacacgcccagctaatttttatagttttagtagagacggggttccatcatactggccaggctggtctcgaactcctgacctcgtgatccacctgcctcagcctcccaaagtgctgggattacaggcgtgagccaccacacccagcctaagttttgtatttttagtagtgatggggtttcgccatgttggccaggctggtctcgaactcctgacctcag

SEQ ID NO: 178399 - DNA, 601 bp, Human
tttctttccttctgcttgctttagatttagtttgctcttctctttctagtgtcttaaggttgaaggttaggttattgatttgagatcattcttcttccttactatgggcatttacaggtctaaattaccctctaaccagtgctttctgtatatctcataaggcataaggttgttttttttcttttttttgagacggagtcttgctctgtcacccaggctagagcgcagtgacatgatctcagcccactgcaacctccgcctcctgggttcaagcaatcctcctgtctcagcctccttctcragtagctgggattacaggcacatgacaccatgcctggctaattttttttttttttagacggagtctcgctatatcgcccaggctagaatgaagtggcacaatctcggctcactgcaacctacgcctcccgggttcaagcgattcttctgtctgagcctcccaagtagctgggactacaggcgcctgccacacgcccagctaatttttatagttttagtagagacggggttccatcatactggccaggctggtctcgaactcctgacctcgtgatccacctgcctcagcctcccaaagtgc

SEQ ID NO: 178400 - DNA, 601 bp, Human
tcatttggtcacccaggctggagtgcagtggctcaatcatggttcactgcatcctcaacctcctgagctcaagcaattctcccatctcagcttcccaggtagctgagactacaggcatgagccaccatgcctggctgtttttttgtttttttttttttgagacagagtctcgctctgtcacccaggctggagtgcagtggcgcaatcttggctcactgcaagctccgcctcctgggttcacgccattctcctgcctcagcctcctgagtagctgggattacaggcacccaccaccacactyggctaattttttgtatttttagtagagacagggtttcactgtgttagccaggatggtatcaatctcctgacctcgtgatctgcccgcctcggcctcccaaagagctgggattacaggcgtgagccacttcgctcggctttttgttttttgagacggagtctcgctctgtctcccaggctggagtgcagtggcacaatctcggctcactgcaaactccgcctcccaggttcacaccattctcctgcctcagcatcccaagtaactgggattataggtacccaccaccatgcaacctccgcc

SEQ ID NO: 178401 - DNA, 601 bp, Human
caacaacatctaagaaaactatataaagcaatacactcaaacactgcaaataaatcaaaatagaatctttgtttttgaggggttttcttgagacagggtctcatttggtcacccaggctggagtgcagtggctcaatcatggttcactgcatcctcaacctcctgagctcaagcaattctcccatctcagcttcccaggtagctgagactacaggcatgagccaccatgcctggctgtttttttgtttttttttttttgagacagagtctcgctctgtcacccaggctggagtgcagtggygcaatcttggctcactgcaagctccgcctcctgggttcacgccattctcctgcctcagcctcctgagtagctgggattacaggcacccaccaccacacttggctaattttttgtatttttagtagagacagggtttcactgtgttagccaggatggtatcaatctcctgacctcgtgatctgcccgcctcggcctcccaaagagctgggattacaggcgtgagccacttcgctcggctttttgttttttgagacggagtctcgctctgtctcccaggctggagtgcagtggcacaatctc

SEQ ID NO: 178402 - DNA, 601 bp, Human
ggcagaggcaataacaaatgcaaaggcctgagatagagcatgttggatgtgttgttgaaggaggagcaaaaacgtcactaaggctaaaagtagatgcaatgaagggaagagcaggagatgaagtgagagaagtaggtaaagacagatcacataaaaaaataggcctggcatggtggctcatgcctataatccaagcactttaggaggcctaggtgggagggtcacttgagtccaggtgtttgagacaagcttgggcaacatagtgagaccctgtctccatttaaaaaaaaatttagctgggcatggtggcacatgcctgtagtcccagctacttaggaggctgaagtaggaggatcactggagcccaggaggttgaggctgcagtgagccatgactgtgccactgcactccagcctggatgacagagagagtccctagtctccaaaaaacgaaaatcatataaaaaatgaaaattggccagacgcggtggctcatgcttgtaatcccagcactttgggaggctgaggcgggcggatcacctgaagtcgggagttcgagaccagcctgaccaacatgaagaaaccctgtctctactaaaaat

SEQ ID NO: 178403 - DNA, 601 bp, Human
acagcactgtttataacagcaaaaaccaaagccatgtaggtacccctaaataggggaatagtaaaccatgaactatggtacacctataaaaaaagaaggtggcagtttaaactgttgtttgtttgtttgtttgtgtttgtttgtttgagacagggttttgttctatcgccgggcaggagtgcagtggcgcgatcttggctcattgcaacctccacctcctgggttcaagcaattctcctgcctcagcctcccaagtagctggaactacaggcgcgcaccatcacgcccagctgatttttttgtatttttagtagagatggggtttcaccatgctgaccaggatggtctccatctcttgacctaaaaggaggttttctataaatactattatggaaacatggccaagacatatgtgcaaaacacaatacaatgcagtttttgtttaaaataaatgtatgaggtgcaaatcagaataaagtccagtggcagtggttacctctggggaggggaaagagagggaagcatgtgtgagcgtgtgtagtggagacggggtacaggcaggggagttggtgggacttttatggttgatctgcatggtgtg

SEQ ID NO: 178404 - DNA, 601 bp, Human
tctgcatctaagaggagcagcctggctggaatacaaagagttaatgtagaatccttgttctagcctggctcggtttccatgacaacagcttaggatagtgaaatctgaaactgtgaaatcccaaaaagtccataggctgccagatccaaggctggggctcactgctcccagcgccacctgctggctgagcatcaccagtgcagctgacctacattccaccctcatttgcttgacccgggtactggaaactgggcaaggtccattacgccacctgttgaccgtgtgcagccctcatcccacrtgtcagcgggactccaccttcccccactgcatcctagccagtacctggggacaaaccctggagtcccaggggaaggtgaaggatacttggtgtgggctttaatagcattacgaagttgtggcttacaactaagggcaaggaaattgctttacagaaaagtataaaaagtccctggtagcaagaggtatcagagcagcccttgtgcctgtgctctgtaaaatactgattcctaacaaactcagcagctctgtgaacacctcttcatttgcagaaggtttgtggcccctcaggtttagagga

SEQ ID NO: 178405 - DNA, 601 bp, Human
tctcctcctattccctcttgcatgggagagagtactttgactaattcaggtcctctgctggaaggttagtttccaacaaaattcctccttcctccacctgtgagttctgattttctacttggaaagaagtgaagaatggggcttccccagcagagggaagccactgatgtctggctacctgtggacaggaagcatctgggattctagtatagttccacaggaagaggcttaaaagggaattccccaccaaaattctgatgcaggcacttagccgacggggtcaaaaaaaaaaaaaaaaaamacaataagatgcaatgtatttttgtaaggctagaaatgcttaatgttaaggccacatcaccttgtgtggtcagtaggaaataatgttgtaagaacctataaagacaaaatacaggagtaatagtacctctagctgtactctccttgcaaacacctatctataagactaaatgctcgagcccagagagtactcagctcttcatatccacttctccccacgctttagaaagcctgtactcagagaatgccagaaaatgggtaagaactttgactcgggagctttcagtttggggaacattct

SEQ ID NO: 178406 - DNA, 601 bp, Human
gtaattgtcatttcacctactttccaatttagtatctcctagtataagtctcctcctattccctcttgcatgggagagagtactttgactaattcaggtcctctgctggaaggttagtttccaacaaaattcctccttcctccacctgtgagttctgattttctacttggaaagaagtgaagaatggggcttccccagcagagggaagccactgatgtctggctacctgtggacaggaagcatctgggattctagtatagttccacaggaagaggcttaaaagggaattccccaccaaaaktctgatgcaggcacttagccgacggggtcaaaaaaaaaaaaaaaaaaaacaataagatgcaatgtatttttgtaaggctagaaatgcttaatgttaaggccacatcaccttgtgtggtcagtaggaaataatgttgtaagaacctataaagacaaaatacaggagtaatagtacctctagctgtactctccttgcaaacacctatctataagactaaatgctcgagcccagagagtactcagctcttcatatccacttctccccacgctttagaaagcctgtactcagagaatgccagaa

SEQ ID NO: 178407 - DNA, 601 bp, Human
ccttagggaagaggaaactaggacagatggggcaatcatcatcacactaaataactcattcttgtctcaaactctcctaattatgtttcttgtcctatttacaaaagtaggggggagaataagcagtggtacaggaaatattcttagcaaccttctctagataggaggtgatatggtttggatgtatgacccctccaaacctcatgctgaaatgtggactacaatgttggaggtggggcctagtgggaggcacttgggtcatggggtggatcccttatgagtggcttggtgccctccccayagtaatgagctcatacaagcactggttgtttaaaagagcctggcatctctctagctcccacttccgccttgtgatacaccttctccccccttgattggaagcttcctgaggcctcaacagcagatgctggcgccatgctttctctacagtctgcagaactgtcagccaaataaaccccttttctttataaattacccagtctccagtatttctttataataatacaaaatagactaacacaggtggtcatgagagcaccttcctgaagcaatgtcattatgtccgactctccttgctgga

SEQ ID NO: 178408 - DNA, 601 bp, Human
agtcccacaggctgtgtgggaaaagggaacaatgttgagatactggtgaatgctctctgaggacagattcctagaagttaggggtgggctaggataaaaacaccagcaaaatcaaccatataacgcaagttttaaaaaggttagtgatttgaaaaaagacctttataaaacgtaggctaggaactattactaaagaggaagtgctcttgttaatacattaagcttccttagggaagaggaaactaggacagatggggcaatcatcatcacactaaataactcattcttgtctcaaactctsctaattatgtttcttgtcctatttacaaaagtaggggggagaataagcagtggtacaggaaatattcttagcaaccttctctagataggaggtgatatggtttggatgtatgacccctccaaacctcatgctgaaatgtggactacaatgttggaggtggggcctagtgggaggcacttgggtcatggggtggatcccttatgagtggcttggtgccctccccacagtaatgagctcatacaagcactggttgtttaaaagagcctggcatctctctagctcccacttccgccttgtgat

SEQ ID NO: 178409 - DNA, 601 bp, Human
tttaggtatgtaaatgatagctcaattggaaaaaaaaaaaaaaaaaaagacttcctggagatctgggaaagctggagtggagaaagcagtaccggaatgttttagaagcaggaccagatgaaagagccgagcactcctaaataaagaccaagactggggcagctgcatgactggaatgaagcgcctttttggaccagcaaaaagctttaggtaggcagaagccaaacaggatcagatagcccgtcttttttttttttttttgatggaatctcagtcgcccaggctggagtgcagcagcgcratcacagctcaccgtagcctcaacctcccaggctcaagtgatccacccacctcagcctccctagtagctgggactataagcatgtgccaccatatctggctatttttgtatttttttgcagagatggggtctctccatgttgtctaggctggtcttgaactcctgggctcaagcaatcctcccaccttggaacctaaagttctgggattacaagcatgagtcaccacagcctgccaaagcccaagtcttaaccaggtcttctctccctgcagagccatgacccagagctactgttttcat

SEQ ID NO: 178410 - DNA, 601 bp, Human
aagcaggatctacctatgtttccatagcctggcattttaggatttccagagatttttacccagtgaattgacttggaataaactcttaaatgtgataaagtgagccaaagggcacgtgcaaagacttggagagatatgtgcaagatcctcagctcaggttctacaatttaatatgatgtttcatctcttgttttggatctctgctattttttcagaaagaatgctgaaaaagatggctgccaaaatattcacacaagtgaaacagcaggcacaaaccagtatcctccatttctgagctctgaattgcatattttcccacaagtagcacaatcacttaaaacattttgggagtgggagattagattacctcatagacacctactgaatgtgagagatagatctccatgcgagcaaatggatgcacatatgagattccctgaataccaaatacagctttctttgaaaatattatagctatctgggtttctatgctgtatctcagtgctcagtgtcatgtaactgacacaatcaccttttattctaatggtcattgctttttttccctccctgtttctgtagcactttcttatgcaaggagcta

SEQ ID NO: 178411 - DNA, 601 bp, Human
cctgattccctaataatgttgagaagcaaaaactgtaaactaggagtctatttaaattttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttgttttatg

SEQ ID NO: 178412 - DNA, 601 bp, Human
attttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatactyacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttgttttatgtgttgtgttttctttttcagacgtttatagtattgaataaagggaaagcaatctc

SEQ ID NO: 178413 - DNA, 601 bp, Human
aaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttrttttatgtgttgtgttttctttttcagacgtttatagtattgaataaagggaaagcaatctctcgattcagtgccacccctgccctttacattttaactcccttcaaccctattagaaaattagctattaagattttggtacattcatatcctttttcaaatcgtcacttaatatgattttcttctttgaccaagttattgagctacacattttccaaaatatctgtggttggcaatgttatgtgttctttctttttctttccttttactcaatcgttagcatgttgcaaaatgagatca

SEQ ID NO: 178414 - DNA, 601 bp, Human
aaaactccctggaaaagagactcctggtggtagagggtaagggcagtttaagaaattctgatcagagaatatgagtactaaggacacagtttgtgccaggacctctctagatatccagatacaacttgaatctgtgggcttgtatttgcttcctgggggaaagaactcaccctccacaggctgaagtcattgggaggcctgaggagatgcaggttgaaatgtgaagccagccaggcaaatctattaaggtatgccaagttgagctgttgattctctgagaagtttacagatggcttagagycacaaatttattccaatgtagaaaattagattttaaaaagtctctaatttcctgacttaaagtgttatatttcagatgtctcaccttggagcagagatataacaaaaggcagtgaggctaatagtctaagatacatgaatccttccatgttttggtgatgctggtgcaattgatcaaatagcccagtaaagttagaggtatatagatgctgtagttagtaactgattttcacaataattttgtcctttattcctcttgttgcaaaccctagacttaaatcctgattttctgacttcaagt

SEQ ID NO: 178415 - DNA, 601 bp, Human
taaggacacagtttgtgccaggacctctctagatatccagatacaacttgaatctgtgggcttgtatttgcttcctgggggaaagaactcaccctccacaggctgaagtcattgggaggcctgaggagatgcaggttgaaatgtgaagccagccaggcaaatctattaaggtatgccaagttgagctgttgattctctgagaagtttacagatggcttagagtcacaaatttattccaatgtagaaaattagattttaaaaagtctctaatttcctgacttaaagtgttatatttcagatrtctcaccttggagcagagatataacaaaaggcagtgaggctaatagtctaagatacatgaatccttccatgttttggtgatgctggtgcaattgatcaaatagcccagtaaagttagaggtatatagatgctgtagttagtaactgattttcacaataattttgtcctttattcctcttgttgcaaaccctagacttaaatcctgattttctgacttcaagtacagtgtcttttactgtaagttaaaaatgcttggagagatggtcatggttgtttggccacagttgggaggtcattgta

SEQ ID NO: 178416 - DNA, 601 bp, Human
gggaggcctgaggagatgcaggttgaaatgtgaagccagccaggcaaatctattaaggtatgccaagttgagctgttgattctctgagaagtttacagatggcttagagtcacaaatttattccaatgtagaaaattagattttaaaaagtctctaatttcctgacttaaagtgttatatttcagatgtctcaccttggagcagagatataacaaaaggcagtgaggctaatagtctaagatacatgaatccttccatgttttggtgatgctggtgcaattgatcaaatagcccagtaaasttagaggtatatagatgctgtagttagtaactgattttcacaataattttgtcctttattcctcttgttgcaaaccctagacttaaatcctgattttctgacttcaagtacagtgtcttttactgtaagttaaaaatgcttggagagatggtcatggttgtttggccacagttgggaggtcattgtatatttattaccactagtttataaaccaacaaggagccattcatgttaaataagtttttattttaaacttggactaatacctctatttcaaacaaaaaccttgacttgtttctc

SEQ ID NO: 178417 - DNA, 601 bp, Human
gtatatgtgacatttactcgatttttctgctggctcagaaatatgcactggtatgcagaaaaagacctattctattctacttcaaattatccatttttacattagaaaacctctaacatcaggctatcttctacttctagtttatatataggttaaaaactcctctgcaacttctctggatattatacattattacaaagtctctgaacagagcataatgtcttttccttcctatagaataacaaagaaatgtcctataattttatactctataaatgagttattaatggtaagaaaccartaattattatcttagtggataatgactgtatactgtaagaaaagtattatccacatttatataagaaaactgagcctcaaagaattaaacaaattgctgaagcccacatggctggtaagggatgtatctgaccatggttcattgctctaaatctcatggtgcttcatcctcgctccacggagacaggggtgggtgtgccagtgttatgatgatccaggctccatgtcaagggctacttaaacaattttcactaaaaacttgaagaagtgtttcttcataatatacacaaaggaaatattt

SEQ ID NO: 178418 - DNA, 601 bp, Human
tgactgtatactgtaagaaaagtattatccacatttatataagaaaactgagcctcaaagaattaaacaaattgctgaagcccacatggctggtaagggatgtatctgaccatggttcattgctctaaatctcatggtgcttcatcctcgctccacggagacaggggtgggtgtgccagtgttatgatgatccaggctccatgtcaagggctacttaaacaattttcactaaaaacttgaagaagtgtttcttcataatatacacaaaggaaatattttacatttgccaactcgcaggttrgtatcaatcaacaggtttacccactgttatgtatacctggcataaagaaattaatagattaaaaaacatctttgtcccctgatattataaaaggtttatctgcctctattttattttacattgaaaagttcttaaagcaatattgttccaggatacagtgttcttttgaaaaatgtactctatgacttggattacacatttaaaaaataatataggatgtatgcattttgctactagtttgagccttttgaaatctgctttgacgtggggtttctatacttttttgatgcatggcatcac

SEQ ID NO: 178419 - DNA, 601 bp, Human
tctatttagagatacctatcaaaccacaagcgtaaaaacttgaccctagttatctactatttttctattaaaagcaaaattgttctttttatgtatcagaagttttaacttaagtgtatacttttattaaaatgatagccatgaaataaggaaaatgcctgttttcgacttattatcagtgactaattagaaaataattatttctcttgttaatgttgaaatatatattttacttttttatatataactaaattataccactataaagagtaagtttttaagtgtcataaaaccattgccragtccataatgcagcataatcgcataaggctgttaatttccaccttatatttttcttatatttttaccctcaaaaaatgtagaaacttgtgtaaacaatatgtatatatattttagacagagtctcactctgtcacccaggctggagtgcaatggcgtgatcttggctcactgctacctctgcctcctgggttcaagtgattcccctgccttagcctcctgattagctgggattacaggcatccgtcacgcctggctaatttttgtatttttagtagagacagagtttcaccattttacc

SEQ ID NO: 178420 - DNA, 601 bp, Human
ggagtgcaatggcgtgatcttggctcactgctacctctgcctcctgggttcaagtgattcccctgccttagcctcctgattagctgggattacaggcatccgtcacgcctggctaatttttgtatttttagtagagacagagtttcaccattttacccgggctggtctcaaactcctaacctcaagtgatctgcctgcctcagcctcctgaaatgctgagattataggcgagagccatggcacctggccaacaatatatttgaagacaaactttatgctgtatttttaaataatttatcaraaattgtttttaaaaactccatttagtaacaaatgaattgcaaaattaatttcattagtcaactgacactgtgaaatagcaaggctataatggtgaataatatagacatgattcctgtcctcatgacgctcagagagtagttgagaagatcatcattaaaatttgtcattagaggaataatataagggctgctggggtatataactggtaataggtcaatctgagtactaaagaaaaagagaggtgacatttccaagaccctaaagtcagaaacagcatataaaacattcataacatttg

SEQ ID NO: 178421 - DNA, 601 bp, Human
ctataatggtgaataatatagacatgattcctgtcctcatgacgctcagagagtagttgagaagatcatcattaaaatttgtcattagaggaataatataagggctgctggggtatataactggtaataggtcaatctgagtactaaagaaaaagagaggtgacatttccaagaccctaaagtcagaaacagcatataaaacattcataacatttgacaacctaaaataattacagtattatccaaatggggataatgcaatgaagagaaaagaaaatgaaactggagaagtagacagggrtcagacctcctagcgtcttgactctgtgttaagacatttgatcatcatcctaagagtaatagaaagctaccaaaatgatgcatattacatttacaatggtcgtgttagcacagtatgcagaatggattaaatggagccaaacatgaatttggaaacatcagtttagaggagactgcaataatctagatggactattagatttgatgctagtcttgacagacacttggaccatgcagtgatatggggatggaaaaaagtaactgaatccagagatagcaggcagaattgacaatatttgat

SEQ ID NO: 178422 - DNA, 601 bp, Human
ttagatatgaacgtttaaggggagacagaaatctaagatttctcataggtctctggctatattatgcacattttataagacacagagacgtcaaaggagtaagtaattagcaggaatggaggggtagattaaaagatacttttcaaaagttcagttttagaattcaaaatttgaagtgttgataagatatgtaagtacagatgtcctatggacaatcaagtatgtggaattcagaagagcggtctcacttggagagaagtatctgagaatggtgggtatataatggttatgtttgttgagyaatgtttgttgatggactacactaggatgaggagagtagaagagaggtagatggcttacataccttatgtctttcttttcaaaaagaaaaatgccacatttcaaagaatacagagaaattggtgccctgaggcatgaagaagccagggaattggaacctcctgaaagcagagggaagataacttagtgctaaggggaggaaccatccttgttgaatgctgcttagaaagcatgtcaaatataatctcaaattatccttttgtttttagtgacaaaacgtgaagatgttgccatctttaga

SEQ ID NO: 178423 - DNA, 601 bp, Human
atatgtaagtacagatgtcctatggacaatcaagtatgtggaattcagaagagcggtctcacttggagagaagtatctgagaatggtgggtatataatggttatgtttgttgagcaatgtttgttgatggactacactaggatgaggagagtagaagagaggtagatggcttacataccttatgtctttcttttcaaaaagaaaaatgccacatttcaaagaatacagagaaattggtgccctgaggcatgaagaagccagggaattggaacctcctgaaagcagagggaagataacttartgctaaggggaggaaccatccttgttgaatgctgcttagaaagcatgtcaaatataatctcaaattatccttttgtttttagtgacaaaacgtgaagatgttgccatctttagaaagaaaagctggtaggctgaatatatgatagatatataagaaaaggaaagataagcagctctttcaaaaagtttggccatgatatggaaaagggagataaggctgtagtagttaaggagggttgtgagtcataggagagaaatatcctttcccctatgccaggacaagggagacgtaagcaagttt

SEQ ID NO: 178424 - DNA, 601 bp, Human
tgccaggacaagggagacgtaagcaagtttgtgttgctgggaaaaagccagtaaggtgggagccattaaggataagaaaagagagagataagagattgctgaagtcttctggaatggggaaggtgtccagaataccggtggagggattggaaacctccccactgtaacaggaaggaggaaaggattggtctcaatgtggaaaagtttgttgatttgggggtgggaagtggaggcggggcattgtgatgctgtctcttctctgtaaagtagaaaataagttttcagcttgaaatggagccgraagaaagaagagggttggaagctggaggaaagtggagaatatttgaaatttttctttgcagagagtgggagatggagcctagtaggaaaatacaggactgtgttgaggaccactgaggtttgtgaccataaatttagaatggtgccaatctgccacggggtgttatttttccccaatagggctcagcagaccaacaagcacaggggaccctctagttttatataccaatagcaagtcattctttatttaatttagttttttgtttgttatagcaataaagaaaaattgtgtttctttgaa

SEQ ID NO: 178425 - DNA, 601 bp, Human
agtttaacaagtgttgcatgaggcatttgcagtaacaggctacatggtttgcatcctataacatcaagctttccgcatagaagctagactaagagacattcagactgatgcaaatttgacagtttaggcctaaaactggcaatcttttaagctgcagataaatgaaagagcaagggatagcatgagtgctgcatggggctcagatttcagatgtcttcctttttttaacccatactcaagcttgcagaattcacaaatatataacctcataattcatcgacttcaagatttcttactactytattcacatagacttttctaaaaccaataaggggttagggagtaagacatctgcaaataaaagcaaaatatttacacaaggttgatgtttaagcatgaataacaaaatcattcttttgctctaaagagtgtttggaaatacacatttggttcatttccattcacagttttctaatgaacatacaagttctgctttcattcattttcaccagctagcaggcttttcatgaaaatgttattcaatcacaaacattaaactaatattgttggcattctgcatgacatttttattttccaggac

SEQ ID NO: 178426 - DNA, 601 bp, Human
cagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatawaatggaaattatctcaatttagatgtgaatcaagtgacttagactaatttaagatgatttaatacatataaaagagatatcaaatgataccttattctatttttcttatctgtccattgatatagtaaaagttctcatttgaaaatgtgttgtcttatactcatgttgaaagtaatttcatattatgccatattaaaaaatgtttatttggtagacattaatcaggtttttcagtcattttaataaataagtcagtagtttgaactattcagtgtattccactgaaatgtgttaagaaga

SEQ ID NO: 178427 - DNA, 601 bp, Human
atactctataaaccattaagttgtttagttctctaaatattaaatattatatataatggaaattatctcaatttagatgtgaatcaagtgacttagactaatttaagatgatttaatacatataaaagagatatcaaatgataccttattctatttttcttatctgtccattgatatagtaaaagttctcatttgaaaatgtgttgtcttatactcatgttgaaagtaatttcatattatgccatattaaaaaatgtttatttggtagacattaatcaggtttttcagtcattttaataartaagtcagtagtttgaactattcagtgtattccactgaaatgtgttaagaagactgaggggaaataatttggccctatttggttgatgcaacatatgtattgagtacatatgctatatctgaaaatagagaaaccatttatcaagatgaaataagaatttgtgtgctcctcagaaggttaagtaaccctgatttagccattcacttattcatattctaattagtccctttagtgtcatcattgtattgtagttaccagtttagtttgattatatttaaggtatgaacatcagaataagct

SEQ ID NO: 178428 - DNA, 601 bp, Human
tatatttaaggtatgaacatcagaataagcttatgccatatacttcagcatgatttcttaacattgagcccagcccctctgtcatttttcatatgtgtgtgcatgtttgtatgtgaatataaaaatacgtatgtttgcatgtgtgtgcatgttttctgagatcatctttgcaacttactgaagttatatgtcatgccttaaaaataaaaactagatagctctccatagcttaaaaataaaaactagatatactcagacaacatatctctccaaagaaacaagtttattttcttcatttgawaggcagaaatcaagcaaaaatttcaaacaaaacacttatttacagtatcataagagggaataaatacctaatcccacttctcacaggaaattaagttaaaattggcgggaaaaaatgtctgaatctattttgagcctggggagaaaagtatatgtaaggtaaaatttatttgcatgaaaacacctagaaacaacaaggctttcttctttcttactttttgtgcccagcaatagactggcagctctttcttaatgtatcccatgcaatttgagcttatatttgcaatgaatgctgatataa

SEQ ID NO: 178429 - DNA, 601 bp, Human
gtctaatgcactttctttggacgatgatactgtggacattagtagctaatacctgtagcaaaattcccagtgataataggctttccatttggctcctacgatcagtgctatgctgcctttatcttcagattccaatgataagtaaatcaattgattttcattccttgtttgtactgtactaaatgcgttacatacagtatcttcttcaatgtttgcaaatttgtgagacaggttctcttattagcccattctcacatgcgaggtgcctgaagattagcaagttaagtaacttgcccaagaycgttcagctcagaagtgtcaggcaagacattgaagccaggtctgcttgatcttcaaggtcctcctatgacatttttaccacacagtgtcattcactccttgcagcatgccccacctatccttttctcacttctttaccctgttcccacacttacacacatttctgcctcaagacatcctcagtgaaaatcaactttttccttacagacttttttaactgcccttaagtcccagaagatattaatcatgatatgattgcttttatatggagacataataaatataataatgacaattatga

SEQ ID NO: 178430 - DNA, 601 bp, Human
acacatttctgcctcaagacatcctcagtgaaaatcaactttttccttacagacttttttaactgcccttaagtcccagaagatattaatcatgatatgattgcttttatatggagacataataaatataataatgacaattatgaatcacagaggaatccacaaagtagaccttatagattctgttattatataaatcagtccacttagtgctgagttaagtactgggtaaggtgagagaaatcggcttttttctagtgcctgtataaaacagacattggcatatattaaaacaggaaarccaattagcagacttgccgttattgacttcctttctttcctctaacctaattatagccagtgtcctgaaggatacatctgtgtgaaggctggtagaaaccccaactatggctacacgagctttgacacctttagttgggcctttttgtccttatttcgtctcatgactcaagacttctgggaaaacctttatcaactggtgagaacagataaaatcatttttctgagaatcataaaacaccgaactcaagagaattgctgtagaatattttattacttagagtgtaagtttgtaacatcc

SEQ ID NO: 178431 - DNA, 601 bp, Human
ttttttaactgcccttaagtcccagaagatattaatcatgatatgattgcttttatatggagacataataaatataataatgacaattatgaatcacagaggaatccacaaagtagaccttatagattctgttattatataaatcagtccacttagtgctgagttaagtactgggtaaggtgagagaaatcggcttttttctagtgcctgtataaaacagacattggcatatattaaaacaggaaaaccaattagcagacttgccgttattgacttcctttctttcctctaacctaattayagccagtgtcctgaaggatacatctgtgtgaaggctggtagaaaccccaactatggctacacgagctttgacacctttagttgggcctttttgtccttatttcgtctcatgactcaagacttctgggaaaacctttatcaactggtgagaacagataaaatcatttttctgagaatcataaaacaccgaactcaagagaattgctgtagaatattttattacttagagtgtaagtttgtaacatcctatataaaatttattaaaatctctcttccattttgcagacactacgtgctgctg

SEQ ID NO: 178432 - DNA, 601 bp, Human
ttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccaggtaaaaatattaaattacatgaattgtgttctcataaattttttaaaaraatatgccagaatttaatggagagaaaaccgccttccacctggatggcacaatgctttcagagtagtgatgattatcaagtgttttggctatcacttcagagaatttgtgagttttgcaactttttggaatcccaggaaggaaattttagatccctctgggtttggaaaaatttgcggttttgaggttttcttaaagactgaaaaatcttggagaaattttccacatcaggaattatcagcagatggttcccatctcttcttaactattgtgcgtggatctagtgaactttgggttttct

SEQ ID NO: 178433 - DNA, 601 bp, Human
ttcagcattaattcaaaagtccacagtccaaacaaagcctcatcggagacaaggcaagtcctttccatctatgagcctgaaaaatcaaaagcaagttagttacttcctagatacaatagggatacagacattagctaaatacagccattccaaatgggagaaattggccaaaacaaaggggctacatgccccatgcaagttcaaaatccagcagggcagtcaaatcttaaagctcaaaaatgatctcctttgactccatgtctcacatccaggttacgctgatgcaagaggtgggttcccytggtcttcagcagctccacccctgtcactttgcagggtacagcttccctcctgactacttccatgggctggcattgaatgtctgtggcttttccaggtacacggttcaagatgttggtggatctattattcttgggtctggaggacagtggctctcttctcacagctccagcaggcagtgccccagtagggaccctgtgttggggctctgaccccacatttcccttcctcactgccttggcagaggttctccatgagagccctgcccctgcagcaaacttctgcctgtacatccaggtgt

SEQ ID NO: 178434 - DNA, 601 bp, Human
ccttcctcactgccttggcagaggttctccatgagagccctgcccctgcagcaaacttctgcctgtacatccaggtgtttctatacatcctctgaaatctaggcagatgttcccaaatcccagttattgacttctgtgcactgacaggctcaacaccatgtggaagctgccaaggcttgaggcttgcaccctctgaagccatgggcctagctctacatttgcccctttcagccatggctggagccgcagagatacagggcaccaagttcctaggctgcacacagcgtgggactctggaccyggcacatgaaaccactttttcctcctaggcctccgagcctgtgacgggaggggctgctgcaaagatctctgacatgccctggagacattttctccattgtcttggggattaacattcagctcctcattacttatgcaaatttctacagcctgcttgaatttctcttcaggaaatgggattttcttttctgtcacattgtcaggctgcaaattttccaaacttttatgttctgcttcccttatgaaactgaatacctttagcagtacctaagtcaccacttgaatgctttgctgcttagaa

SEQ ID NO: 178435 - DNA, 601 bp, Human
aaaatgccaccagtctctttgctaaaatataacaagagtcacctttgctccatttcccaacaagttcctcatctccatgagagaccactttagcctggaccttattgtccatattgccatcaggcttttggtcaaagccattcaataagtctctagaaagttccaaactttctcacattttcctgtgttcttccgagccctccaaactgttccatcctctgcctgttatccagttccaaagctgcttccacatttttgggtatcttttcagcagcgtcccactcctggtatcaatttactstattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgtcaggcaaagagagagtgagagccaagtgaaagggatttctccccataaaatcattagatctcatgagacttattcactaccatgagaacagtatggagaaaactgccactatgattcaactatttcccaccatgtccctc

SEQ ID NO: 178436 - DNA, 601 bp, Human
ttccaaactttctcacattttcctgtgttcttccgagccctccaaactgttccatcctctgcctgttatccagttccaaagctgcttccacatttttgggtatcttttcagcagcgtcccactcctggtatcaatttactgtattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgkcaggcaaagagagagtgagagccaagtgaaagggatttctccccataaaatcattagatctcatgagacttattcactaccatgagaacagtatggagaaaactgccactatgattcaactatttcccaccatgtccctcccccaacaatggaaattatgggagatacaactcaagatgagatctgggtggggacacagccaaaccatattagtcaggcatataaaaacctagatattagtaggtataaaataatggttttagttagttttgaacctttggagaggaaaagatcaaacca

SEQ ID NO: 178437 - DNA, 601 bp, Human
ctttctcacattttcctgtgttcttccgagccctccaaactgttccatcctctgcctgttatccagttccaaagctgcttccacatttttgggtatcttttcagcagcgtcccactcctggtatcaatttactgtattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgtcaggcaaagagagagtgagagccaagtgaaagggatttctccccataaaatcattagatctcatgagacttattcactaccatgagaacagtatggagaaaactgccactatgattcaactatttcccaccatgtccctcccccaacaatggaaattatgggagatacaactcaagatgagatctgggtggggacacagccaaaccatattagtcaggcatataaaaacctagatattagtaggtataaaataatggttttagttagttttgaacctttggagaggaaaagatcaaaccaataatac

SEQ ID NO: 178438 - DNA, 601 bp, Human
agatgcccgtaacaggacaaaacattatggggacacttctgactatgttgaggtgtgggtaaagtaggagaaaagagagcagaagatggaaaatggaggaaggagaaaaagcgagagtgaaatagaaaaggtgaaccttgtagaaagtgccaaaatgccaccagcagtcatcagaggggtgctttcttccacatgtccaatgacttatccttgagtaagtcaatgactatgacacaatgaatcaaattctgtttttcagaatgccagctcttaactctcttcatctcatttttgtttcttytcttgttattcatagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggt

SEQ ID NO: 178439 - DNA, 601 bp, Human
gggaactgttactgatgcatatgaaggagactttcaaacctttttgttcatatattaaactacctgaatatatgtctataaagatctaaaaactcaacctgggtgaaaattaagaaacaatatgttttggtctgaagtcctaagtgggattggctgaaatgctaaaaggttatctgtccagtagtggacctggtccctccagcccaaatccctgggatagaggcataggaaagcccaccttgacaaacccagggctccccaaaagctgaaaatctgacagacttttaaacaacccccaaakaattatcattccaacaatatcttagtgagctttttacatctgagaaagcatggtgtatatttagttaaataacacctgttgtaggaatgctttgggctttgctgctttcaaaaatagtggttatttcatctgaaattctacttctagggcacaactactgaaacagaaataagaaagagacggtccagttcttatcatgtttccatggatttattggaagatcctacatcaaggcaaagagcaatgagtatagccagtattttgaccaacaccatggaaggtatgttaaaagtcctgcgt

SEQ ID NO: 178440 - DNA, 601 bp, Human
acagaaataagaaagagacggtccagttcttatcatgtttccatggatttattggaagatcctacatcaaggcaaagagcaatgagtatagccagtattttgaccaacaccatggaaggtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgacca

SEQ ID NO: 178441 - DNA, 601 bp, Human
gtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcmgattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgtt

SEQ ID NO: 178442 - DNA, 601 bp, Human
tggatagcctcatgcttaatgaagcagtagtggataagcaaaaatgaaccatttgcgtttcaaatttttaaaagtgcaaaatcacatagaaatgttttctggtcacacctttgtgaaggatggtgggagggtgagttagaagcgcctgaagaatcaaggtgagccagcaaaagacacagatttactgtaagtgattctatgtggataacccatgcaggaataatggagatgtggctgcagttctctcctgaatgctttgctttgttttaaagtgtgagattccccccttttttttggaatsaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagacaaaattaaattttgtagtttcttttttgttatttactgtaaataataatacctcctttttaccttcagtgtaaatataaggttatttgggagttta

SEQ ID NO: 178443 - DNA, 601 bp, Human
ataacccatgcaggaataatggagatgtggctgcagttctctcctgaatgctttgctttgttttaaagtgtgagattccccccttttttttggaatgaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagamaaaattaaattttgtagtttcttttttgttatttactgtaaataataatacctcctttttaccttcagtgtaaatataaggttatttgggagtttagaagtatttacaaaataactagtgcataataactatatttttctctgaattataaatcaaatattatttattgtttacaaagttatgtattaagggaaatggaaacaaactgggcacttgaagaatttcaatatccaaagagacaattgacaaatctatttttagtggaaattttaaaaacaataagcaataaattaatttact

SEQ ID NO: 178444 - DNA, 601 bp, Human
aggacatgtctgtgtttactaaacaaatgataaaatatgcccaagtcagataattttgaaatatcacttgtaagtacttgaagatggactatgtagggaggggacatcatctgggggattattattttttgtttttgtttcttctacagtcttagcaatattaaatttagaaattatttatttaattttgttaaaatatatattagcatttactggatacatattgatattataatatagtatactatagtgatagattttaaagtggtcttatacagagagacaaaatgaagaaaatcaygcaaaaaagtatatttatacaagtataaaatgcttattaagttcccagcttgataaatgaacatataagcaggttatatagagattgtaaataatacggtctaaagtataatatacaatatttttaggctctgaagtaaccactatattttcgaattatatttcaggtaggacttaactgaattaaatgataaagttggcatatgttggcctcttattttgtatcagatattggactaaatggtttacattaaatctctctctctagattcccacaaaaccagtcttaagatatttacta

SEQ ID NO: 178445 - DNA, 601 bp, Human
atgtctgtgtttactaaacaaatgataaaatatgcccaagtcagataattttgaaatatcacttgtaagtacttgaagatggactatgtagggaggggacatcatctgggggattattattttttgtttttgtttcttctacagtcttagcaatattaaatttagaaattatttatttaattttgttaaaatatatattagcatttactggatacatattgatattataatatagtatactatagtgatagattttaaagtggtcttatacagagagacaaaatgaagaaaatcacgcaawaaagtatatttatacaagtataaaatgcttattaagttcccagcttgataaatgaacatataagcaggttatatagagattgtaaataatacggtctaaagtataatatacaatatttttaggctctgaagtaaccactatattttcgaattatatttcaggtaggacttaactgaattaaatgataaagttggcatatgttggcctcttattttgtatcagatattggactaaatggtttacattaaatctctctctctagattcccacaaaaccagtcttaagatatttactataaat

SEQ ID NO: 178446 - DNA, 601 bp, Human
actagttctaggttctaacctggctagattcaggttctcagccagcatcattgggaatcagcttcttgtctctcttcttcccaatatgtgaccttcctctctggctgggcattttcctactattgccaagattctatcaacttttattctactaatgtagctccatgtacagaaagtttgtgcctcctaactagtagctttaattaaggcccacaaattgaatatcattgacctggttggagttacatggccatttctaaaccagtcagttaccctagctcttggttttaatgccatattygcctaaatcagaatcatatcttatcactggaggcagagtaaatgagtgaaattatgaagacaataattaggataccattaccagaaggaggatggattctagaaagaaataaacaataaatagacaactcaagctggggctggtcttacgtgttaaggaatgtaggatctgtatctaaggtgaattatggaatagtagaaaatccataggcaggatacacattcttctcaaatgcctataggatattccctaggataagttataggttaggtcataaaacacacatcaataaacttaaaa

SEQ ID NO: 178447 - DNA, 601 bp, Human
taaataagattgcagaatacaagatcaatatacaaaactcaattatatttctaaacactactaatgaacaatcagaaaataaaattaggaaaattctatttataacaacatgaaaaataataaaatacttaggaataaatttaataaaataagtgtgagatttgtacactcaaagctataaaatattgttgaaagaaattaaagaactactaaataaatgaaagcacattttatattcatagattagaggaaaatattgttaagatggcaatactcaccaaattaatctacaaatttaacrctattcatatcaaaatcccagctacctattttgcagaaagtgataaattgactataaattttatatgaaaatgcaagagactatatgccacacaatcttaactagaaaaaaaataaagttggagaactcaaacttccaaattttaaaacttactacaaagcaaaagtaagcaagatagtttggtactggcataaggatagctatatacatcaatggaataaaattgaaattccaacagtaagtcttcatatttatgttaaattaattttcaacaagaccactagacaattttattaagga

SEQ ID NO: 178448 - DNA, 601 bp, Human
gaccactagacaattttattaaggaaagaagccttttcaacaaatggtgcttggacaagtgaatatccacatatgaaagaatggaattgaacccttacttaataacatatataaaaattaagataggtcataggcctaaaggtagagctaaaactatgaactgttagaaggaaatttagaagtaaatcttcatgacctattattaagcaatgatttcttagatatgataccaaaagcacacacaatagcaataagaaaaaaaaggttcattggactttatcaaaattagaaactttcataytgcaaacaatatcatcaagtaaaaagacaacttaaagaatggaagaagacatttgcaacccagatatctgatcatgatttgtatctaatatatgtaaaggattattataactccacaacaaataaaatagataactcactaaaaatgatcaaaatatttgaatagacatattgaaaaaggagttagacaaaaggccaataagcacataaaagatggtcagcgtcactggctaattttaggggaaaggcaaatcaaaactaaaatgagataccacttcacacacactaagatggctataat

SEQ ID NO: 178449 - DNA, 601 bp, Human
acaactaactaatgggtatgcagcttctttttaaggcgatgaaaatgttctaaaattcaataatggtgatgattttacaagtctgtgaatatattacaagccactgaattgcatactaatatttcatagtatgcatgtatcactattttttcttccaatcacctattgatggatgttcaagttgattccagatactttacccccatgttgcagtaaatgttcttgtatatatcacctttcataatgctgtattaacttctagaagatagatttccaggattgaagtattcccaatattaawcatattcatgtcacataaaaattagatgatatgcaacgaaatagggaaatgtgactcatagttaatagattaaagcggtacatagaaatagatctggacaggaacaaattgttagaataaacaaaaaaggactttggaggcactattgtaaatatgttgagcaatttaaaggaaaaaaaggggtcataaggaataaacagagaacatgagcagaaaaaaatgaaaactgtaaaaaggaataactcagacattttataattgaaaagtacacattctaatatgaaaaattcactggatgtg

SEQ ID NO: 178450 - DNA, 601 bp, Human
aaacattaacctacctgacttcaaggcttgttataaagctgtactaatcaagaatctacagtattggcataaacaaagatatcaatggaacataatgctgagttcataaatagatccaaactacatgtcaatggattttttgaaataaacactacagaaaggaaatagaagaaaggaagtgttttcaacaaaatatcaggaacacataaataaatgtatggaaaataaatgaacctccacttcgatcttatgccaagtgccagaatcaataaggattgtagactaagcagaaaagctaaawcaataaaacatctgaaataaaacacaggagaacatctttgagaccttggggtaggcaaaaatttattggaaaacagacaaaaagtgctatctattatttaaatgtccatgaaatttcaaacaatggagacctactgaacaaaaaagaaaaaagtctagtaatatacacatgggtgaatttcaatttgaagtattcaagtaatatttggaaaagtcactaagactgtcaggtctctgaggtagccacctaggtagagagagattccatttactgagttagcaaatatcagaagagaagcaa

SEQ ID NO: 178451 - DNA, 601 bp, Human
tccgactcccgggttcatgccattctcctgcctcagcctcccgagtagctaagactacaggcgcccgccaccgcgcccggctaattttttgtatttttagtagagaagaggtttcaccgtgttagccaggatagtctcgatctcctgacctcgtgatctgcccacctcggcctcccaaagtgctgggattacaggcgtgagccaccgcgcccggcccacagtggtgatatttttaagggagagaaggactcggtaactgttactttctataaagaaacgggaagtagccagtagtagaaakgttggttaattgagaatgaattccttgcaaagtccaaaggaaaacacataacacaatttgagagattagctcaaaacaggggcacttctttcattttaacaagaagagaaaggcaaagcacagttacggatgtaagtagtctagtagataaagggaaacaaagttcaggctggctgactttcatcacctctaagacgctgaagtactgagactgtgcttctcagatgggaaggcataagcaaaaatggctgaggttatgtgcagaagagaaagtttgaaatagttttagataatagaaat

SEQ ID NO: 178452 - DNA, 601 bp, Human
ttgccaggctcagtggctcacgcctgtaatcgcagcattttgggagactgaagtgggcgtttcacttgaggacagtagttcgcgaccagcctagtcaacatggcaaaaccccatctctactagaaatacaaaaattagccaggcgtgatgatgcacacctgtaatcccagctacttgggaagctgaggcacgagaattgcttgagcctgggaggcagaggtggcagtgacccgagattgtgccattgcattccagcctgggtgaaagagcgagactctgttgcaaaaaaaaaaaaaaaaaagcatatactctttagacatgatttcctctcatataaaggtaacctccaagtccccaaagatagagaaaggggaagggaaaaaggcaaagtattattttatttttattcattgccaaatttcagcctcttcaacattacttttgataattctgatctatttttaaagtaacaagaaacataaacagtgtacaatctagaattataaacagtggcttaaaacaataaacactgattacttcatagtttctgtgggtcaggatttggggaataagttagctgggtggttctggtttaggatca

SEQ ID NO: 178453 - DNA, 601 bp, Human
tagatttgatttcattttctctgtatgtatatttggtatatgttggaagaagaaaagaaaacgcagagaacagaatcctttatgacaacatgaatgatcagacagcaatggggaattaagaaatataagtttgggaccagattgggtagaatttaatttatgaaaaggctgactgtgcataataaaatgtattttcctttaggcaattcaaagctacagatgattttttatcaggaaagtgacagtgaaccagtgatatttttcagaaatatacgtagcaggagaatgcagaatagatttraagaggatgaaactcagcccaccacatgttatctattagtttactgaaattaacatatctctctaatgtataaatgtgcagaaaattgaagttgaaaagagaatttcaggaaatatcaagtacttatggttgacatcagtattaatttagattgtgatgtatgcataaaaagatatagtttataaaataatcatttccatctactgggtgtaaatttaatttttgttcttttaagagagaaaaattaaaggttctcctttctttttgactatcagttaaaataacttctttgtcttgtga

SEQ ID NO: 178454 - DNA, 601 bp, Human
atcctttatgacaacatgaatgatcagacagcaatggggaattaagaaatataagtttgggaccagattgggtagaatttaatttatgaaaaggctgactgtgcataataaaatgtattttcctttaggcaattcaaagctacagatgattttttatcaggaaagtgacagtgaaccagtgatatttttcagaaatatacgtagcaggagaatgcagaatagatttaaagaggatgaaactcagcccaccacatgttatctattagtttactgaaattaacatatctctctaatgtataawtgtgcagaaaattgaagttgaaaagagaatttcaggaaatatcaagtacttatggttgacatcagtattaatttagattgtgatgtatgcataaaaagatatagtttataaaataatcatttccatctactgggtgtaaatttaatttttgttcttttaagagagaaaaattaaaggttctcctttctttttgactatcagttaaaataacttctttgtcttgtgataacctgggtatgtttctggagtagctaaggtagtcatatatatcatgtttaccactattaaggaaatgtgctt

SEQ ID NO: 178455 - DNA, 601 bp, Human
atctgactttgaaaatttaaatactgaagaattcagcagcgagtcagatatggaggaaagcaaagaggtaaaaatgtttaaataaggagatattttggtgttatataattctgttgtttaaaattatcaggtgtttttaaattgcgtgtttccttcctgttaagaaaatagaaaatatctgtctagcaatatattttccatggaaaagttggtaataaataaattaatgatagattaaaatatagctagattaacaatatgctgacttatgtttccaatactgacattttgaattcttgayagtattcttgatatgaattttttcagtatttataaataattttaaatttctcaaaatgcctcaatttctccactttcttccttgtaatttgcccacaacagtgttttttgtacgtactggaaaaatatctgatgagagggtagttgcaattctcatcttgctatgttcttagttcttaattcttacgaaatacgtcataaaatagtattgtattttgtttgcacagacatatttactcaaggaagatctgattgggatcttggcttgatatttatgtatagtttatctttcctgaagtca

SEQ ID NO: 178456 - DNA, 601 bp, Human
aaatccttaatacattatagaatgtaaaattctgaatttaccaactcagtaagtcctggtaacttaatgtattctttgatttacaagaagggtatgagcaacagaatatattttttgttttgtttgctattaacctgttgctcaataagtacagagttggaggtaaagagaggaatttaaaaccttgatatttaattgtttatacaaaaatgaagacaagatttccagtaattaaagtttgcactaactaacaaaaataacaaggaaaaacaaagattcgttccttcctcatacgaactgyttggcgaggaagataaaagcttctattcctgatgtcgggaaagaaagaatgacgacatgggggagtgtgggcactgaaaggtaaaatttaagtagcacaacatgatcatgataattaacaatcagccaaaattatgagggaaaatatagttataaaaaaagaacaaagatgggtggatcacgaggtcaggagttcgagaccagcgtggccaacatggtgaaaccctgtctctactagagattcaaaaaaattagccaggcgtggtggtgcgtgcctgtaatcccagctactcgggaggct

SEQ ID NO: 178457 - DNA, 601 bp, Human
ttttgatgtatattcccctctcattattttgaaattatgcctaatggtgaatatttccctaatagtaaaaaaagtcaatttttattttcacacatgtttagttttaggctgtcatataaactaagaatgaattatacagtatcaaacgttgaagccattggctagtttaatcttttagctaagtttcagtatcttttgaggaatgtttaacttgacatccagtcttcttaactttaagagattttacagccgtgggttttccaaaagagcgtgtattttgccttaacttaagccattatgkctgaagtaagagggaagtccagtgatgtggggtttagagtagggacatctcttgtttctcttgttatcattaagctttttgatttgttttcccattaagttagctctgagttaaatactctaaaataatatttgtgaattcagtatttcagaattggaggaagagaactgacctgccaggtggaagcagacaggattattttattgcttgagttgtggagtccttccaataccttcccagcatagagactgttacttcagtgttaacattatttggaggggtttttaattctggctttat

SEQ ID NO: 178458 - DNA, 601 bp, Human
ttcttgcctgccttctagtcatttttgtctggtcatttttctaactgggggacaggattacattgttaaatatcacaaagtagtaagaaacatcatgaggcttattaccaatcctttctaaattaattttttaattaaagaaaaaatgaggcttttttactggaatgtctaaatgaatttttttataaggcagactgagtggactcagaggttttttaggtgttcacagtaagtcctctgcaatgtctttgctaaatttgtatgattcttcagtagttttctgtagattctctagagtagrccatttaaaatcatgtcataatcccctatgctttaattttaatgttatttcgattatattaatgtaattccttttgtgattttgaatgattgttttttcttttagagtatttaataatgtggaagccatgcttgaatgactatttttcgaagtgaaatttagtagtgcgatatggtgaccttcaccgcttaccattcttacttctcacaggagtaaaatcaagctggagccatcaagaatgcagctctggtgttttttaaccagccagaggctcgtgccaccacttttacccaggttacc

SEQ ID NO: 178459 - DNA, 601 bp, Human
tttttttataaggcagactgagtggactcagaggttttttaggtgttcacagtaagtcctctgcaatgtctttgctaaatttgtatgattcttcagtagttttctgtagattctctagagtaggccatttaaaatcatgtcataatcccctatgctttaattttaatgttatttcgattatattaatgtaattccttttgtgattttgaatgattgttttttcttttagagtatttaataatgtggaagccatgcttgaatgactatttttcgaagtgaaatttagtagtgcgatatggtraccttcaccgcttaccattcttacttctcacaggagtaaaatcaagctggagccatcaagaatgcagctctggtgttttttaaccagccagaggctcgtgccaccacttttacccaggttacccaagcaagttgtacatctataaatataatcagtttctaaatgacttttgactggcctgcatgttactcagctacgttccttgcccttccattggcagtaaaataaaaacatgcacagctgctattatgctgagtcatacaaagcatggtcaggcaagtctgacaaccctaacttaaa

SEQ ID NO: 178460 - DNA, 601 bp, Human
ccaaataataataataatagtgataatgagagacttatagatggtatgctccttctaaaaatagatttagagtccatcttcttcattttcttggctcctctgtgctttctctcccctctattttattgagacctgctggaaaactttctcccgaagaatattatttaaatttatcatgatccacaaactcctgtataggaaaagaatcagaaactcttgctcctagggtgtttttaaaatgaagagacttccctatcatgtgacaatagcaataaacgtaacatcattctatgggatccaytagtcgaccttcatttcttaatgttgaaatcacagttttatgcacaaatatttaaccaaaatgcctaaacccaatttaatcatttttaagaaatgttaattattttgtcacttagatacagtttcctctccttttgccaataaaactataaaacagcactaatataaaagtgtagttggctatttggaagaagcaataatcatgccattcctggagcattcttttatactttggaacaaaatattccatcactggctctccagattcatgagctataatgcctcatatattggaggaatg

SEQ ID NO: 178461 - DNA, 601 bp, Human
cccccaaatgtcttacaagcatgttaaagtacccaaaatccatccaactgaaataatttgacccatacattatcaaggttcaagatgtgtgataagccatgaaaaggttggtgaatagcctagggtgcatatggtgagtgaagatggatggaagaaattaggagtccagatttattggggagactttatgaaagcaaggaatcatgattgttgcaaaatagacagtgaagaaagaaatggtgtggtggtgaaagtcttcccaaagtcatttaaagtattggcaacccagatacttggcagyaggagtgataattgatgttacaggaatcctatgtaaacttttgcacattttaatgaagattttctataatatgctgtctggtgacttctcccaatcactgtcaagggctagacttcattattttaagatgtctttcattcatttattcactcactcattcttttttttaagcaaaatttattaagacctgtaacatacttagcactgatgtaagctctgatacagtcattcagtaatgtcagcctgagcatttgcagaaccctgaatatggatcctcatttttcccttggggtcacccga

SEQ ID NO: 178462 - DNA, 601 bp, Human
aaggtcaaatattttttattatttctgaaaaaagatagatcataaaaatgccaaaatatactatgagtcatatgatatggggcaatatgtcactggagtaatcgcaaaaggattttctgaagaaagctaaaattatgtaatttgaggtatggatcagttatatattgtaatagcaatgctgtgtatcaaaccaccaaaaaccctgggctctaagctgcttttctagttttgactcctatttccttctgtgtaactcacagactttcttgtcactaagttttacttgtatcattgtttctcyattcttacagcttcattttctacatatgtctcttatatatccttcaagatctagtctcaaatccatttcctccataaagctcagaaattaaagtttaccagaaaactctcataatactttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagcctttgatct

SEQ ID NO: 178463 - DNA, 601 bp, Human
gaagaaagctaaaattatgtaatttgaggtatggatcagttatatattgtaatagcaatgctgtgtatcaaaccaccaaaaaccctgggctctaagctgcttttctagttttgactcctatttccttctgtgtaactcacagactttcttgtcactaagttttacttgtatcattgtttctctattcttacagcttcattttctacatatgtctcttatatatccttcaagatctagtctcaaatccatttcctccataaagctcagaaattaaagtttaccagaaaactctcataatackttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagcctttgatctagcaatccagaaattatacaaaggtgtttattggattgttattgataatggccagatttaaagcaaacgaagtattcaataatggtggaattgggctgggcacagtggctcacacctg

SEQ ID NO: 178464 - DNA, 601 bp, Human
ttgtttctctattcttacagcttcattttctacatatgtctcttatatatccttcaagatctagtctcaaatccatttcctccataaagctcagaaattaaagtttaccagaaaactctcataatactttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagyctttgatctagcaatccagaaattatacaaaggtgtttattggattgttattgataatggccagatttaaagcaaacgaagtattcaataatggtggaattgggctgggcacagtggctcacacctgtaatcccagcactttgggaggccgaggcaggcggatcacttgaggtcaggagttcaagaccagccaggcaaacatggtaagaccccatctctaccgggcgtagtggtatgtgcctgtaataccagctacttgggaggctgaggcaggagaatcgcttgaacctgggagacaga

SEQ ID NO: 178465 - DNA, 601 bp, Human
tcacctttcatctgaaatcttttccctttcccttcaatcaactcatattacccacttttaaattaaggtgtttgtaagaatgagaagaaatatgtgtgacgtgtttagcacatatgagaggcttagtaaatagcaatttttgtcactctgtctggagtagccctcgggtggaaccaaactcagatcattatggtttcttataatgtttaaagaaggatctttctgactttcagtcatcagaggcagttcttattaagactggttatgtagacatgatgtaggattatcagctaaatatcaractgaagcacgatatttccctgacccctttgcaggtgagaactagagtgcatgggtgccggtaggagcgaactccactcactcactgctccacccctcacaggagggggagcgcaggtgactgggtgcaggagccaaggcaaatgcatttgggcactgcaagagtgaactccataccggccccacaggagcgtctaggggagggtgcctgcgatccttgaagccctagaggaagtgttacagtgcccttttagctttgccatccatggatggcttaaatgttaacagttcagtggagggt

SEQ ID NO: 178466 - DNA, 601 bp, Human
ctgaaaggagatggagcaggaaggtaatcttcccctggagtctggccatccccagccagactcctctccgaagctatgctgtcaagctgtccctctgatgtcaagctacttctctctaatgtccaactgtagtctctgatgtccagctgttcctcctgtctgcctgctgagttctgggctttatataggcacaggatgggggcagggtgcaccatgggtggttttggaaaaggcaacatttaagtgagaaaacagggatgtatattctcactttgggccacggttccaggcttgagggtgragccctcgccaggtacccgtcctcttctgcccagaatttctctgcctcttgttcctgtcaaaattgcttaacataaactccatgctgcaggggactcctctgtcttcttcacactgattcgctattgccaaccacagtgaatgataagaagtagactcacttaattactgactagcaaaaaaatgatggcattacaaacttatgtctgatttcattcaatgaaatgatcaactggatcaaaatattaatataatgaaaatgatatgacctattttcttaattggtgatacaaatgtggtt

SEQ ID NO: 178467 - DNA, 601 bp, Human
cttatgtctgatttcattcaatgaaatgatcaactggatcaaaatattaatataatgaaaatgatatgacctattttcttaattggtgatacaaatgtggttgcattccttttactgtttcaatttaattaataactagagtgtttggtgagttgatttcattaggagaattactgcattggatctggaggcctctaaggcgaattctgatttgactaagaatcctgtgtcctgccatatactcagtttaaagaggatcagccatgctttattttctttacctttattattattattatttttttttagacagtcttgctgttgcccaggctggagtgcagtggtgtgatctcgactcactgcagcctccatctcttgggttcatgccattcttgtgccttaacctcgcaagtagctgggattacaggtgtgagctaccacacctggctaatttttgtacttttagtaatagagactgggttttgccatcttggccaggctggtctcgaactcctggcctcaagagatctgcccgtcttggcctcttaaagtgctggaacgacgggcgtgaaccaccgcaccttgccagacatgctttcta

SEQ ID NO: 178468 - DNA, 601 bp, Human
accatgttagaatatgctgacaaggttttcacttacatattcattctggaaatgctgctaaagtgggttgcatatggttttcaagtgtattttaccaatgcctggtgctggctagacttcctgattgttgatgtgagtatgctgcactttgctgctttattcattggcatatatgtaatagttctagcaatggtgcctgacacagtgtaggcactcagtaacactgtatcagcccaaatataaattatgtttctcatttcacagtgagaggatgcctcaaaacattttttaccaatttaartacatatacattcatagataaaaatcaaatgccatcatactatacttattcacttaatttcaaattaatatttaaaatctcaagttatgcaaaataaaatatgaatttagaaattttgctttttgcacgctcacatttcgcaaaataacttgtatttaaatttttcacaggcatctttgacattagtatgtttgtcatcactaaagcctgttgagtttaggtcacacagatgaatcattaattacaaagaaatttgaaagtccaaaaagcaagagacaccacttgatttgtatgatatag

SEQ ID NO: 178469 - DNA, 601 bp, Human
aattcaggtgtactttagaacaaaatagcttatataattttaataatttttctatatgttttcaaggaaattggacatgtgtatgtcccccgaccgtttttctttttctttttagctaagactttataatttttctcaactacattagtcaactgtatgaataactaaagacaacattgttcttgcaatttctaatttatcataaaatctcaactttttttattcactaattttgtctgacctaattaatgatattatgcccttcaaactgaaatttacaaaagtcaaagctgctttttaraggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagattagtatcattaacttcaccctgggaacctgtagaaat

SEQ ID NO: 178470 - DNA, 601 bp, Human
tcaaactgaaatttacaaaagtcaaagctgctttttagaggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagaytagtatcattaacttcaccctgggaacctgtagaaatgcaaattcttaggcctttccccaaacttactaagtcagactctgctattggtgtttttaacaagacccctgggtgattttgaaactcatgaaagttcgagaattactgattcattgcatagagcaaggctgaactgtgtagacatttttatatgtaaataagaaaattgtgttgctttttctgtataggtctcactggttagcttaactgcaaatgccttgggttactcagaacttggtgccatcaaatccctcagaacacta

SEQ ID NO: 178471 - DNA, 601 bp, Human
cacctggaggaaattaagtgaaataagccaggcacagaaagacaaatgacacatgatgtcacttatatatggaatctaaaaaacacaaactcacagaaacagaaagcagaatgacaatcaccaggggctgggggatgatgggagatgttggtcaaaggatacaaaattcaattcgacaggaagaatacattctgtagagctattgtacagcatggtgactatagttaataataatatattatatacttgaaaatagctaagtgagtagatatgttttctcatcagaaaaaaataagtatawgaagcgataattatatattacttagcttgagttagccatttcacaatatatatatatttgaaaacatcattttgtacaacataaatatattcatttttatttgtcaattaaaaaatgaatatatttttgaaaagcaattaaaataaaaatgcatatacattttaggaactctatatagatgcactaaaactatataaaaatgatataatactatacaacaataaaataaaatttttcttcctctgtgtttacaaatacttccttaggcccatctgcctagattcctcttaccatgattga

SEQ ID NO: 178472 - DNA, 601 bp, Human
aaattttttcatcaaagttcatgatatatttttatataaacacatcagagtcaaagattgttcatattgtttttatgatagcatattgttacagtagatcattatttaattatatatgctaaatatccacataagatgttatagaggaatataaatttgaagtattttcaatgcatatcgcaaaacattgccccaaaagtgaatacaaatttcaagcttatttatatgcctgtattgaatacatgtcaaatagaattttgatcaattattcaatttattttctaaaattataattttgggraaaaagaaaatgatatgacttttcttacaggccacgtttaagggatggatggatattatgtatgcagctgttgattcacgaaatgtaagtctagttagagggaaattgtttagtttgattaaatgtatatttctacaatattgtaatttagtgatattgtcaataaaataaaattatgtgcttaatttataaaacccatctatattataaggataaaatatttaatcatactatttctttcaaaattatcataggatgattttctctaatcactctgtatcttttaacatatcttttcta

SEQ ID NO: 178473 - DNA, 601 bp, Human
attttgggaaaaaagaaaatgatatgacttttcttacaggccacgtttaagggatggatggatattatgtatgcagctgttgattcacgaaatgtaagtctagttagagggaaattgtttagtttgattaaatgtatatttctacaatattgtaatttagtgatattgtcaataaaataaaattatgtgcttaatttataaaacccatctatattataaggataaaatatttaatcatactatttctttcaaaattatcataggatgattttctctaatcactctgtatcttttaacataycttttctagtatttagcaaggcacctgacacaaaactttattgtatgtattttcaaaatgagacattttatttttggctctgatagtcctggtcatttgtgcattagaagttctcacaggcaatattttttatctgtaatatatttcctccagcttttgatcttccttataataggaaggatatgactaaaaacggggacaaaaataaacaatttagtgtttctcttgggaaagtgagattaagtggtagaagggagggacttccctaatctactttatacataccagtactttgaattc

SEQ ID NO: 178474 - DNA, 601 bp, Human
gttaaaactatattacctaaccgtttcacagcccgaatttctagaaactagttatttttgtggatttgtaacacaaagttttttaccttaacaatgggactagctagcctaaatagcttgaaaaatgtactttacatatataatatgtataaattatataatgcataacatattttatatgtaaacatataaaatacatagaaataaaatttgctatacttaagtgccagtggtatcatacaagctgatgtcattaagacacttctaataacatcaaaaataaaatacatacatacataaygtgaaaatattaaatgttctcagagtacagaggagacagatcggaataattggtacgtcacagattggcctcagtttttgtccaactctgcagattgaatggaatcattaatgaaacaggccacaggttttgcttttttctggttaaacaaaaaaaagacaaacctcatattttcccctactatcccacccttaaatgagatgatatcattctttgtagggctttttattggctcttccaggtgtacatttgccagtgatactgttcgttcagtttggctgctgcagggagttgctgcca

SEQ ID NO: 178475 - DNA, 601 bp, Human
aggaggctgaggcaggagtatcgcttgaacccgggaggcagaggttgcagtgagccaagatcgtgccactgcactccaacctgtgcaacagagcgagactccatctcaaaaaataaaaaaaattaaaaaaaagagagagagataagatttgagatctgacatggagcttccctatttacactacttacctgctttgtgacctaaggcaagttacctcagctctccaatcactggttttgcaaggaatttttttttttgtaaaatgttgtgaggattaaagatgtgtttttataaaagctayattttttgttgctttcttaaaatcagaagaattgaattcgattttttttaaggtttctaatggaacttttacatattatttgttccagaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttacta

SEQ ID NO: 178476 - DNA, 601 bp, Human
gccctttcggcccctgatgaaactcaagctgggtggcccgaaggacagctgtccctcaagttgggataataaaaccagtgtggaggcaggcaagccacccacggtaacctgaccagggtggccactgggctatttttaacgaggaacaaagttaaacctggtgattgttctggggactttggcatgcagggggtggggcagcgttatctggccccctggcctgctagtgccgcctcagaagccaaaattagtccccaactccgccaggccttgtatgggcactgggtggagggctgtcccmaccccggctccatggactcccacaggataagcaggcgtgcccccagagctggctatagcacttccctgcccaggagtgagggaggctgagggaggggttcccctggggacagctggccatgccaggatgtccttgctctggggttgggggaggtcaccaccacccaggatagaatagcatctgaagaccctcagtgacccaggaggttgcaggggcttggggtgaccactctccagccctcattccctcgctctcacccctagctaagccactgagccctgagcctgccaggcatgatgg

SEQ ID NO: 178477 - DNA, 601 bp, Human
tttctcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagatgtaagccaagatgtcttatctgcactgtgcatctccctaagaaacctctggcctcccaaacctgttcttgacctttccctcatccttccgcccccttgattatgtactgtcagtattcatttggtgaagttgctttgcaggtgcctttgtgtagcgctggagaatgaagaagttggtgacccgggtaaagtgtggtcaccattccttagctcacatcagtgctgtccttaggcatttttgagggagaagtgttagtattccagggtaccctttatataaactgcggttgacacctgaatccagtgagcttgcagtgatatttgcctgattattaacaactgttgatgtcactcttcatcagtctttccacaggagccagcatacttcctgaacatggagagtgttgttcgccgctg

SEQ ID NO: 178478 - DNA, 601 bp, Human
ggttttcttacatactgtgcaaccagatctgatgcttcactttttccatttcctccctcagaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaaggtaagagatgarttgtgaaccattagtggtagtgaaggggtccttttagttcttttgggccctcagatttgtgtatgagctattattagggcagtatttatggaaacaccttcctcttttagggccagagaggaaggtcttcaagatagacagtcaagggactgtattgcgaaagtgggactttctttctggtgcgtgtgtgggatgtgaccagcttttatagttactacttaatttctgaaaataacctgcagtcttgagctgccaccagctgccttttgtccctttggtctttcccatcatctgctagga

SEQ ID NO: 178479 - DNA, 601 bp, Human
cagtagctctgaaaacaacaccaagagtctgccattacagtaactaaaatagaagagatgctttgtacactcagttataactaactttggttatgcttggccttttttgtgaactaggccataagccatttttgacaatatgtttggaagatattgtgaactcagaatagaaagttggtcccatttgtttcttgttacttttgttccagaggttgctgaaacctcagcaggccccagtgtggttagtgtgaaaaccgatggaggggatcccagtggactgctgaagaacttccaggacatyatgcaaaagcaaagaccagaaagagtgtctcatcttcttcaagataacttgccaaaatgtaagtctcattgttatttgcctgatgtagaaaagaatttataattcaaatgtacattagattaaatataaaattgcatggtgaggctgggcacagtagctcatacctgtaatcccagcactttgggaggctgaagcgggagaagatcacttgaggccaggagtttgaggccagccttggcaacatagcaagacactatctctaccaaaacagtttttttaattagccaggcatgatggctt

SEQ ID NO: 178480 - DNA, 601 bp, Human
gctattgcactccagcctgaatgacagacagagactcagtttctaggaaaaacaaaaaaatgtatggtgagttgaggcttgaaagccatatcccttgcttgcgtgagcaggtgcttttggttgtggtgactacaggtgctgttggtagcctgccttctgtcctttaatacttaccgtctacacatggcactgagccaaacacgacatacagtcttatttacttacaagatgaggacatcaaataacctgcccaggatctccctcagttgccaagctgagacttgttgtatttcaccaaaaygcagctgtgtttcacaaccatcattctgtactgtcttttgttcaatttttagctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatgtaagtagcccttggctttcaaata

SEQ ID NO: 178481 - DNA, 601 bp, Human
tgacagacagagactcagtttctaggaaaaacaaaaaaatgtatggtgagttgaggcttgaaagccatatcccttgcttgcgtgagcaggtgcttttggttgtggtgactacaggtgctgttggtagcctgccttctgtcctttaatacttaccgtctacacatggcactgagccaaacacgacatacagtcttatttacttacaagatgaggacatcaaataacctgcccaggatctccctcagttgccaagctgagacttgttgtatttcaccaaaacgcagctgtgtttcacaaccaycattctgtactgtcttttgttcaatttttagctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatgtaagtagcccttggctttcaaatattactgttgttatttggcaag

SEQ ID NO: 178482 - DNA, 601 bp, Human
ggcagttatgtaagtagcccttggctttcaaatattactgttgttatttggcaagccaatgatgatgtataggggttggatcttttatggagggaacattcagtagctgaaagtgtgccatagcaaaatactattcttagcttctgaaaaatatctacagattacttttaaaggaactctaatatgcaggtagctgctggagccccttaacttgtgagggttcaagcttataggctcaatgaccacacacgtcagtccactttctatcactctgcaagtgagtgtgcctttaacaccaggmagtctttcacagagacatccttggttgtggctgtgagtggagaaatacgaatctagcagcgctagagaaaaagctactccaaaagacatgttaaaaaggatggtagatcccatcactcgtccttcaggaggctcaccatcctagggatgctggagagagttgctggccagattctccaaaggcttgctaaagagggtcccggtttgaggtttaatgatagtgatatatccaaacattacatgactggcttgcagagggtaaccaccatccaggatgtccctctagagtttgctttttctt

SEQ ID NO: 178483 - DNA, 601 bp, Human
tttttgtgaccgatcctcgctctgttgcccaggcaggagtgcagtggtgcgatctcgactcactgcaagctccgcctcccgggttcacgtcattctcctgcctcagcctcccgagtagctgggactacagacacctgccaccacgcctggctaattttttttttttttttttttgagacggagtctccctctgtcacccaggctggagtgcagtggcgtgatctcggctcactgcaagctccacttcctgggttcacgccattctcctgcctcagcctcctgagtagctgggactacaggygcctgccaccacgcccagctaattttttgtatttttagtagagacagggtttcaccatgttagctaggatggtctcgatctactgaccttgtgatctgcccgcctcagcctcccaaagagctggaattacaggtgtgagccaccgcacctggcctaactttttgtatttttagtagacggggtttcactgtgttagtcaggatggtctcaatctcctgaccttgtgatccgcccaccttggcgtcccaaagtgctgggattacaggcgtgagccaccgcgcctggcctgttgtgtttttt

SEQ ID NO: 178484 - DNA, 601 bp, Human
tttctcctggagcacttgttaggttcaggtgttgtgaagtgctgaactccgtgcctgccacgtgggaacattctaattcatcctggttttcctctgctcttcctcatacagaggctatgtctcgtggtagatgggagctagactttggagccctgccacctcactagttgtgtgaccttgagttggtagttaacctttctatacctcagtttcatcatcaatataatggagaaaacaataggacctaaatcaaaatatatgtggagaaggtaaataagttgtatgcaaacagttattataracattccctctgagaacctatgagaaccctaaagagacgaaaattacataaatttgaagaatttttgtaattttgaagaatttttttaagccttcagaagtgggtaaggcagttggaaacccatctagcagttagctaaaatgccagtttatagcctatgcttggtaaaggaagggcaggctttttaaaaagcgtccttcagcactgtcaaggggtatgagaacctagtgcagacccagaaagcctgggagttctaagggtggaaccactaccaggagaaaaacacctgatcatgtgtct

SEQ ID NO: 178485 - DNA, 601 bp, Human
gtgctgggattacaggtgtgagccctggtgcccggcctgtttcttctttttccaagtaactaagcatgccctcaaatggttcaaaaccctaaaaggtatttattgtctgattcacatcaagagggtggagagtcattttgggagctctgagggagcctgggaatccgctcagtgtttccagtgcccccttgtctacgtggctgaaggatgcacagtaatgacttgcagggagaagaggcctctgaaggcttgagtccccgctgtccctccggagtccacctcacatttgtcttcaccactrccctctactccatgatgttgtataatccttgaataaccccacacctaatcgcctctgataagaggaattgctcaatattttcaactgccccgtggttctatactgctccacccatgtccaacctaaaggcagagatggaagggggctattagccacaggtcacctctgcctcgaaggtacattgccttcccaagcccgcccagtgtggctcagcttcctcacaggctctctgttctgttggaaatgctgggtttaaactgtcacgtggcagtgttggagcagcttcttccctacaggcct

SEQ ID NO: 178486 - DNA, 601 bp, Human
aaggtatttattgtctgattcacatcaagagggtggagagtcattttgggagctctgagggagcctgggaatccgctcagtgtttccagtgcccccttgtctacgtggctgaaggatgcacagtaatgacttgcagggagaagaggcctctgaaggcttgagtccccgctgtccctccggagtccacctcacatttgtcttcaccactgccctctactccatgatgttgtataatccttgaataaccccacacctaatcgcctctgataagaggaattgctcaatattttcaactgccccrtggttctatactgctccacccatgtccaacctaaaggcagagatggaagggggctattagccacaggtcacctctgcctcgaaggtacattgccttcccaagcccgcccagtgtggctcagcttcctcacaggctctctgttctgttggaaatgctgggtttaaactgtcacgtggcagtgttggagcagcttcttccctacaggcctgtgaaatcaagcccaactctgggttttatttttctctttatttatttttataaaagccttaaaatttttataaaagccttatctcagtagag

SEQ ID NO: 178487 - DNA, 601 bp, Human
aggatgcacagtaatgacttgcagggagaagaggcctctgaaggcttgagtccccgctgtccctccggagtccacctcacatttgtcttcaccactgccctctactccatgatgttgtataatccttgaataaccccacacctaatcgcctctgataagaggaattgctcaatattttcaactgccccgtggttctatactgctccacccatgtccaacctaaaggcagagatggaagggggctattagccacaggtcacctctgcctcgaaggtacattgccttcccaagcccgcccagygtggctcagcttcctcacaggctctctgttctgttggaaatgctgggtttaaactgtcacgtggcagtgttggagcagcttcttccctacaggcctgtgaaatcaagcccaactctgggttttatttttctctttatttatttttataaaagccttaaaatttttataaaagccttatctcagtagagatatagctcacttaccataaaattcacccttttaaagtatccaagtctatgatttttaagtacactcccagtgttatgcaaccatcacttctatctgattctagaacatttt

SEQ ID NO: 178488 - DNA, 601 bp, Human
ccctgagggcaggctttgccctggatgagggtgagcaggttggcaagccaatgagcagccaggcagggagtaggaggctgctagtggggactgagctgctccaccctctgaaccccctttccctcctcaggcatagccaatcccactgatgccttcactgtcttttatagtgagcggagtccctggtgtaagtatgagcttggagggagggctcactctacaggcgggaggctaggccagaaagggcacggtcctatgcagggttgcacagcaaagttgaggcctgagaaggccttgaacycagggcctctacctcccagctctttcctatctgagcttctctgagggcaagccctgaatgggcagaaaccagctgtatgctacgggccctgagtggggacaggaccctgccagaggagcctggaatgagggggagacctgggcccaccccaggctgattgtgtctccagcccctcaggctgaagacactgccttccccctacacctccccaggggtgcgggttaccagcactgggaggccaggccatgcctcacgcttcatggaggacacagcagcagagaagctggtacgtggcacccc

SEQ ID NO: 178489 - DNA, 601 bp, Human
gattttttaaagagaacagttggcttatattttttgttgcctctatagtaggcagtaaaattcttagtatcactatttgggaggctgaggcgagaggatggtttgagggtaggaagtctgagaccaacctgggcaatatggcaagaccccatttctaaaaaagaaattaaaaaattagctaggcttggtggtgcacgcctgtagtcctagctactcaggaagcttaggtggaaggatcgcttgagcccaggagtttaaggttgcagtgagctgtgattaccccactgtaccccagcctggktgatggagtgagaccctgtcccgttaaaaaaaacaaaacaaaacaaaaaactattttctgtaagtcacttgtaattggtttgcaaactcttggcaagtcctatgatgaaaatattcataaatcttctatatatggtaatttaaataactagtattattgatttcaggattaaatgtttattttaaaaattgcaggcagttctaagaaacatttattctatttgtagggaattttggctttggagagactcaatattatttttcatttatatataaatattaatatatatagttcttgaga

SEQ ID NO: 178490 - DNA, 601 bp, Human
ctgagaccaacctgggcaatatggcaagaccccatttctaaaaaagaaattaaaaaattagctaggcttggtggtgcacgcctgtagtcctagctactcaggaagcttaggtggaaggatcgcttgagcccaggagtttaaggttgcagtgagctgtgattaccccactgtaccccagcctgggtgatggagtgagaccctgtcccgttaaaaaaaacaaaacaaaacaaaaaactattttctgtaagtcacttgtaattggtttgcaaactcttggcaagtcctatgatgaaaatattcrtaaatcttctatatatggtaatttaaataactagtattattgatttcaggattaaatgtttattttaaaaattgcaggcagttctaagaaacatttattctatttgtagggaattttggctttggagagactcaatattatttttcatttatatataaatattaatatatatagttcttgagatataattcagacagtataaaagtcagccttttgaacggtacaattcagtagtttttattctctacacacagttatgtaactaccacctctaattttcagaacattatcatcaccccc

SEQ ID NO: 178491 - DNA, 442 bp, Human
cctgagaattctctagtgtcctagttgttttattttggggccattgattttcaaggctttgtgcagctggggagatgtaaatagtagtggggcaaattaattgttacaaaggtcactttccttaccaaaactttttttgagacagggtctctctgtcacccaggctggagtgtagggattgtgatcatagctcactgcagccttgaacttctgggctcaagcagtcctcctgccacagccttccaagtagctgggaccataggtgtatgccaccacatgcagctaatttttgtatgttttraagagttgggattttgccaggttgcccaggctgttctccaactcttgggctcaagcaatttgtctacctcggcctcccaaagtgctgggattataggcatgagccaccgtgcctggccagtattccattattaaaaatagg

SEQ ID NO: 178492 - DNA, 601 bp, Human
tagtctgagcaacagggcatgaccttgtttctttaaaaagaattaagagatatgctatgccagtggtatgaaattcaaaacagaaatgtaaatgaagagaaacttttagccatacacccctgtgctgtactactcatgatttcttcctcaagacaactaccgtgtgtgtgtgtgtgtctgtgtgtgcacgcatgtgtgcatgtgtgtgtatacaagggctggtcagaaggtgttacatttacaattatttattttttttaattaataacttttttttttttttttttttacaaatgtttattatatgtacaacaggcttcaggacaacacttcattccagctataggtggcaaaagatgctatggcagggaatacagatgtttaaatatgaatgaaatcaagggtcaccatctcctcaggcacaaggcacagcttacttgttgccagatttttttttcttttctgtttttgagatggagcctcgctttgtcacccaggctagagttcagtggtgtgatctcggtttactgcaacttctgcatcccagattcaggtgattcacctgcctcaggctcctgagtagctgagattacaggcgccc

SEQ ID NO: 178493 - DNA, 601 bp, Human
cagggttttgccattttggctaggctggtcttgaactcctgacctcaggttatccacccgcctcagcctcccaaagtgctgggattataggcatgagccattgcacccggcccagatttcttaatttcacctgcagccaggggtcccttccccatagccttctattttagctcctatttttgtttcttctgctcctctttttgtttctgcttgaaagtcttaccttcctcgtccatctccttggcctgcttcttgggctgtttcagcagcaccttcacaggcagacatggcgcctgccacrccttccccaggccctgcaaccctacttttaaaatttttatagactttgccaaattcccctccttgaactcgatgggcttctaattggagtcaagtagatttataatattgaccaaagttgtatacatgggccaacatgtacagtgagccatctaatatctttgtcttttgatttgtatgattggttcatatgctccttattaaatagctacaaataatgtctaattggaattatttagacttgaatgtgtatatttgattcacatcttttatcttgaaaatgacttcaggtcgggcacgg

SEQ ID NO: 178494 - DNA, 601 bp, Human
gccatctaatatctttgtcttttgatttgtatgattggttcatatgctccttattaaatagctacaaataatgtctaattggaattatttagacttgaatgtgtatatttgattcacatcttttatcttgaaaatgacttcaggtcgggcacggtgagagaggatctcttgagcccaggagtttgagactagcctgggcaatgtggtgaaaccccatctctacaaaaatacaaaaattagctgggtgtggtggcacatgcctgtagtcccagctatttgggaggttaaggtaggaagatcscttgagccctggaggtcaaggctgcagtgagctgtggttttgattatactactacactccagcctgggtgaaagagcaagaccttgtctcaaaggaaaaaaaaagaaaatgactttaaagtatacttgtgtgttaaatattttaagtttgataaatctgcacatttgcacagttgttgacacatggctctgagatcaccttcaagaagtataactatttctgtaatattagctgtgcaaaagggaagaataaatgacaatgatttcctatcctctcattgtaattctgactctggagatg

SEQ ID NO: 178495 - DNA, 601 bp, Human
taatgtctaattggaattatttagacttgaatgtgtatatttgattcacatcttttatcttgaaaatgacttcaggtcgggcacggtgagagaggatctcttgagcccaggagtttgagactagcctgggcaatgtggtgaaaccccatctctacaaaaatacaaaaattagctgggtgtggtggcacatgcctgtagtcccagctatttgggaggttaaggtaggaagatcgcttgagccctggaggtcaaggctgcagtgagctgtggttttgattatactactacactccagcctggrtgaaagagcaagaccttgtctcaaaggaaaaaaaaagaaaatgactttaaagtatacttgtgtgttaaatattttaagtttgataaatctgcacatttgcacagttgttgacacatggctctgagatcaccttcaagaagtataactatttctgtaatattagctgtgcaaaagggaagaataaatgacaatgatttcctatcctctcattgtaattctgactctggagatgtaagtttatttggatggctgagattgaacaaagatgggagtggtttttattacaaagtatattaactg

SEQ ID NO: 178496 - DNA, 601 bp, Human
cttgaaaatgacttcaggtcgggcacggtgagagaggatctcttgagcccaggagtttgagactagcctgggcaatgtggtgaaaccccatctctacaaaaatacaaaaattagctgggtgtggtggcacatgcctgtagtcccagctatttgggaggttaaggtaggaagatcgcttgagccctggaggtcaaggctgcagtgagctgtggttttgattatactactacactccagcctgggtgaaagagcaagaccttgtctcaaaggaaaaaaaaagaaaatgactttaaagtatacytgtgtgttaaatattttaagtttgataaatctgcacatttgcacagttgttgacacatggctctgagatcaccttcaagaagtataactatttctgtaatattagctgtgcaaaagggaagaataaatgacaatgatttcctatcctctcattgtaattctgactctggagatgtaagtttatttggatggctgagattgaacaaagatgggagtggtttttattacaaagtatattaactgcttgagagaagaccttttcctattttttttttttccttgggacagagtctcactctgt

SEQ ID NO: 178497 - DNA, 601 bp, Human; identical to SEQ ID NO: 39018

SEQ ID NO: 178498 - DNA, 601 bp, Human; identical to SEQ ID NO: 39019

SEQ ID NO: 178499 - DNA, 601 bp, Human; identical to SEQ ID NO: 39020

SEQ ID NO: 178500 - DNA, 601 bp, Human; identical to SEQ ID NO: 39021

SEQ ID NO: 178501 - DNA, 601 bp, Human; identical to SEQ ID NO: 39022

SEQ ID NO: 178502 - DNA, 601 bp, Human; identical to SEQ ID NO: 39023

SEQ ID NO: 178503 - DNA, 601 bp, Human; identical to SEQ ID NO: 39024

SEQ ID NO: 178504 - DNA, 601 bp, Human; identical to SEQ ID NO: 39025

SEQ ID NO: 178505 - DNA, 601 bp, Human; identical to SEQ ID NO: 39026

SEQ ID NO: 178506 - DNA, 601 bp, Human; identical to SEQ ID NO: 39027

SEQ ID NO: 178507 - DNA, 601 bp, Human; identical to SEQ ID NO: 39028

SEQ ID NO: 178508 - DNA, 601 bp, Human; identical to SEQ ID NO: 39029

SEQ ID NO: 178509 - DNA, 601 bp, Human; identical to SEQ ID NO: 39030

SEQ ID NO: 178510 - DNA, 601 bp, Human; identical to SEQ ID NO: 39031

SEQ ID NO: 178511 - DNA, 601 bp, Human; identical to SEQ ID NO: 39032

SEQ ID NO: 178512 - DNA, 601 bp, Human; identical to SEQ ID NO: 39033

SEQ ID NO: 178513 - DNA, 601 bp, Human; identical to SEQ ID NO: 39034

SEQ ID NO: 178514 - DNA, 601 bp, Human; identical to SEQ ID NO: 39035

SEQ ID NO: 178515 - DNA, 601 bp, Human; identical to SEQ ID NO: 39036

SEQ ID NO: 178516 - DNA, 601 bp, Human; identical to SEQ ID NO: 39037

SEQ ID NO: 178517 - DNA, 601 bp, Human; identical to SEQ ID NO: 39038

SEQ ID NO: 178518 - DNA, 601 bp, Human; identical to SEQ ID NO: 39039

SEQ ID NO: 178519 - DNA, 601 bp, Human; identical to SEQ ID NO: 39040

SEQ ID NO: 178520 - DNA, 601 bp, Human; identical to SEQ ID NO: 39041

SEQ ID NO: 178521 - DNA, 601 bp, Human; identical to SEQ ID NO: 39042

SEQ ID NO: 178522 - DNA, 601 bp, Human; identical to SEQ ID NO: 39043

SEQ ID NO: 178523 - DNA, 601 bp, Human; identical to SEQ ID NO: 39044

SEQ ID NO: 178524 - DNA, 601 bp, Human
cccatctcgcagaagaaacctagcatgttcaactattaatcacatggaaccctctttgttttgtcaaaaacatctgaagttgtttttgactttccctcatggaacttgttgactattggtctcctgcagatacttagctttagacagagtttaccacctgtgttagtcagcttgggctgccataataaaattccagactgggtggcttcaacattagaactgtattttctcagagctgtggaggctgaaagtctatgatcaaggtatcagccgattcagtttctggtgaaggctcttgtcyatggaccaccttcccattgtgtactcacatgacaagaagggcaggtgagagaaagcatgctccggtgtctcttcttaggaggacactaatcatagcggatcacgacctcatttagtcttaactactttcttactccaaatacattaccattggatattaggttttgaagacaaaatttgaggggaacacacacaattcagtccccagcacactcactttgggctgcatttccaaattctccctggctacaatgggcctgaattagtagcccctctgtgttaatacccacagctgggagcg

SEQ ID NO: 178525 - DNA, 601 bp, Human
caatgttgatatcagggttgacagaatcattccggaagtcatattctgccaacagagggtactccaggtggatgcaacgtttctggagttcctcaatcatttcctggaaagagggcacaaaaggggttttaaaatcttgttactgtgctcaaaaacattacatcttctaagaggtccaatggtcaaaaaagtggcattctatctaaacttatacaagattttagatcttgctcagtcaacaaccgggataaagcacagaaaagcaacccagactaacaacactttgaaaatgaaatctaakcagcaggcaaaattgaccttcaggcaccatttctcacatctcctcaggaacctgtgaagaccagcctaccagcctgaaaaagaggacactgggactttaactccatcaggagaaatgatgccatggctcacagataataaaaaggagaaagcaattcagggaccaacagggactccttcctttcacacagactacaggcagagtcgacacatggctggactagcttctaacagcagctcagtgaaggaaccaggaggaaggtacattcactaacctgcttgacttcaaaagacactgtct

SEQ ID NO: 178526 - DNA, 601 bp, Human
aaaaaaaaattagccgggtgtggtagtacacacctgtagtcccagctacttgggaggctgaggcaggggaatcagttgaacccaagaggcggaggttgcagtgggccaagatcacacgactgcactccagcctgggcaacaaagcaagatgccatctcaaaaaaaaaaagaaaagaaaacttggatcatggtcatggttgcactggtccacaaatttactaaaactcattggattatatatttacaaggggtgattttatggtatataaattaaatcaatagagcagcttaaaaaaaaaaaggtttgcccatgatacttggagaagtagggcttctattacatattgactaaggatcaatattccgggcttcaaataaaacacatcaccaccattttgggaagggcttttcagtgctcctaacccagtttttagagggccattaaaaaacggatgaagctgagcagcaaaaggaagatggaggaaagaaaatatcattttctaaatcactactgagccagtgattaagcaaactgtgaatgtgaacactcctgcctgcatcccacttaagaattactggccgggcacggtggctcacgcct

SEQ ID NO: 178527 - DNA, 601 bp, Human
gactgcaaatgagtacaaaggaaatctaaaactggatcatggtggccgaatgcagtggctcacgtctataatcccagtactttgggaggcccaagcaggcagatcacttaaagtctggacttcaagaccagcctggctaacatggcgaaaccctttctctactaaaaatacaaaaatttggccaggtgtggtactttacgcctgtaatcccagggtgaggctgaggtgggcggatcacctgaagtcaggagtttgagaccagcctgaccaacacggagaaaccctgtctctactaaaaatwtaaaattagctgggcatggtggcgcacacctgtaatcctagctactcgggaggctgaggcaggagaatcacttgaacccgggaggcagagcttccagtgagctgagattgcaccactgcactccagcctgggcaacaagagcgaaactgtctcaaataaaaaaaaattagccgggtgtggtagtacacacctgtagtcccagctacttgggaggctgaggcaggggaatcagttgaacccaagaggcggaggttgcagtgggccaagatcacacgactgcactccagcctgggcaacaaa

SEQ ID NO: 178528 - DNA, 601 bp, Human
cagtatttttacagtgtaaagtcaactcatgtcatgctctgctcaaatccctcagatggcttcacactaagagtacaagccaaagttcttgtcgtggcctacaaggtcctacaagacctgccccaataccgctaatcttcctcagccttgactactgttcctatgctctcctctggccgcatggccaccttgtgctgtctcactatgccaagtactttcccacagcagggcccacaccctgggcttccatcagaaagacctccaatccctccctggccagctgtgaacatctctaggtatytccagaaacccatcagggctgaagagctctcatgcacagaaagaaccagatgctggggccattttgacattttgaacactacctgtgaaaatgcctcagatttcattttgttcatagtaacctctattagactccttaatttaccctaatctgttcatctttattttttttttttgagacagagtctcacactctgtcacccatgctggagtacagttgcacaatcatggttcactgcagcctcaacctcccaggttcaagtgatcctcccacctcagcctcctcagcagctgagaccac

SEQ ID NO: 178529 - DNA, 601 bp, Human
ggttgaaccctttttcaagtgcttttttgacatatgtatatccttttttggtgaaatgtctatcaatttctttggcctatttcttaacctttttgccatggcctgaatgcctaacaggaaactcaaattcacacatctaaagcccaactcctgatagtcaccttccagaccagctcctttgagagtgttccccatctcaattaatgcccactgtatcctccctttgttcaagccaaaaaccttagtgtcattcttgatttctctctgattccacacctgacctgtcaattaaagcttcacracatatccagagtcggatcacgccttcatccttactgggattccacaaactcacctcaccgcttctgtcttgcttccttcagtctatttccagcacagcagccagggcagtatttttacagtgtaaagtcaactcatgtcatgctctgctcaaatccctcagatggcttcacactaagagtacaagccaaagttcttgtcgtggcctacaaggtcctacaagacctgccccaataccgctaatcttcctcagccttgactactgttcctatgctctcctctggccgcatggccaccttgt

SEQ ID NO: 178530 - DNA, 601 bp, Human
ctgtaccatcaattttcaatcctagcagacccaatacccacccttccaccttttttcttttgagtttttaaattctcacagtaaaactgacttggggcggggggtggggggggcacttctatgcattttaacatatttacatttttgtaaccagcaccacaatcagggtacagataaagacagcatcccccaaaattcccctgtgctctcctttagagtcatccatctctgaccccccacttctggcaaccactgatctgctggccagcactatactgtcgttgtataaatgaaatcacayactatggaagcttttgaggctgacttctttcactcagcaccatgcttttgagattcatccaggttgcaacatgcagcaagtttgttctttttcactactgagtagtgttccagtgtatggatgtaccacagcttgtttatccagacacccactgatgagcacctgggttttggatattatgaacagagctgccataaacattcgtgtacaggattttgtgtaaacctcttttcatgtatccaggatacacaggaatgggactgatgggtcatgtggtaatttcataataaatggacaaac

SEQ ID NO: 178531 - DNA, 601 bp, Human
tctttcttattttttatttatttattttaaaatattttttgtagagatggggtctcattatattgcccaggctggtcttgaactcctggcctcaagcaatccccctgccttcgcctcccaaagtgctgggattacagacgtgacccactgcacccagcctacactgtcactttttcaaatgctcatagctgtgcaacttaacactggcttatgacaccacctgaactaacccttgggtttcaggaccacagaagctggctctagacaagaatgactaggcaaatgcttcaccatcactttyagacctgtccaaaagaaaatgaaaaggagaacaagagggtgaaatgagcttaaggaatctccaagttaatgaatcccagcattcccctcacaacagttatcagtagaagtacagatggcaatttgaaatacaacctgcaatacttactattaataccattaagctctaaattacgcaaagaattttcccctaacacttgtacccaggttactgaaaagaaagttgacaatctagggagaggaagaaatgaaagaagccagctcttctcagcttcccatcattttcccagaaaccgagaag

SEQ ID NO: 178532 - DNA, 601 bp, Human
acaaaaccagtcaggtgcagtggctcatgcctgtaatgccagcagtttgggaggctgaggcaggcagatcacttgaggccaggagttcaagaccagcctggccaacacagtgaaacccagtctctactaaaaatacaaaaattagctgggtgtggtagtgcatgtctgtaattccagctacgcaggaggctaaggcaggagaatcacttgcccaggaggcggaggttgcagtgagccaagatcacgccactgcactccagcctgggtgacagagtgagaccctgttttaaaaaaaaaaaaatgctatgtgaattagaaatcagtacaactgaaaataaatgcatgcacaaaactaaacccaacctaatacctcctattgaactggacgttttcacatgttaaccacttaaaagatttttaaatgcaatcacatccagggagttattttcacaccagctgcaagtgtgcgaaaccagattctcaattggtagtgtcagcaattcttccatttaggccacacttccacacacgagtcagcactgctactgagtaccgccacctcttcacacacttcccagcagggctgggagcatatcagtta

SEQ ID NO: 178533 - DNA, 601 bp, Human
agaaaatgtaaggccgggcatggtggctcacacctgtaatcccagcactttggaaggccgaggcaggcagatcacgaggtcaagagatcgagaccatcctggccaatatggtgaaaccctatctctaccaaaaatacaaaaattatccaggctgtggtggcgggtgcctgtagtcccagctactcaggaggctgaggcaggagaatcacttgaacccacaaggcagaggttgcagtgagctgagatagcgccactgcactccagcctggcaacagagcaagactccgtctcaaaaaaaaaaggaaaatgtaatagtactctacagctctgcctgaacatacttacacagtcaaaataatgtaactgaatattaaagtaacccccaacttgtgctattcccatattgggagaatggtaggagagaaaacaggagtggggagagtggtgtatgtaagaaagctaaaccctcaactcctacagtaggaagttaataggcaatttctataactgatcatcaagaaattactacataagctattgcttagaaagatgaaggctggccaggtgtggtggctcatgactctaatcccagcactttggg

SEQ ID NO: 178534 - DNA, 601 bp, Human
gagacagccacaatctgctgcccttcactgtgacagactggcttggaattgacagtgccaggcaaattaacgtccctgcccaagcagatgctcgggaggctgcggctaaggcacaagcctcaggagtgctgcaaatgtaggtgggggaggcccctggagtgaggctccagaagactggaggagcattgctgtgggaggaaggatggggagagaatagttcttaaataaggcaaagtaaatataggaactgtctcattgccctgctcaaattggcactaatgtgacagaacacaaacccacmaagaaaacaggagaagaaataacagcagatgagagaagtgggtaacatttcagaagctgaaaagcagacagatgcaggcacagtacctgagctaacagactagagaaagcagaagctggagccggcaggagggaagaccgatacaaaacccgccgcctctgtgtcctctgcagcacgcaggagggctcaggaactagtcaccagttgcctgagaaggtggggaggtgcacaggaggactggcagtgtgtgagtgtgaggagcagttgggtccggccggcagcaggcaggccacctccact

SEQ ID NO: 178535 - DNA, 601 bp, Human
gggtggcagtagctccatgtgaccaaagtacaaaaggagttcagaggtaaacaactttcccacatccagtctgtctgatcccaaaaacgatgctctgcccacagccccacactgccatataaccctaagcctctcttgcaaagtgctttggtgataccaatgcctttcttatgaaggctgggaggagccaaaagcttggagaatccccaccacacacgagcaaagaatggagcaatgcccgagagccacaggatcactttttttttaaaggatggggtctcactatattgcccaagctggwcttgaactcctgggctcaagtgatctttctgccttggccccccaaagtgctgggattataggcatgagccactgcgcctggcccgcaggatcattttagaagcgagaaaaccaagaagaaaaaacactacttcatacatttaaaggccagagacacaaaaaaaaggtaaaaagtacacattgtaatgatcattctagtacacaggagacagccacaatctgctgcccttcactgtgacagactggcttggaattgacagtgccaggcaaattaacgtccctgcccaagcagatgctcggg

SEQ ID NO: 178536 - DNA, 601 bp, Human
gcatgtcatgcagtgaaaaaggttagaagccccactcgtcagaacagcctgactcttgagacccaggtttttaggtggttttctcctcccccatcaccaggaaaaactacttgcacagtggggagccctcagtttctaaaggttcccccacacagatgaaatagaaggaaaagcaccctccaagtggagaatgtcacatttactaaatacttacaagctgccaggcacaagaatccaccccccaccatcaagggacaccaggacccagtacacattgggtggcagtagctccatgtgaccraagtacaaaaggagttcagaggtaaacaactttcccacatccagtctgtctgatcccaaaaacgatgctctgcccacagccccacactgccatataaccctaagcctctcttgcaaagtgctttggtgataccaatgcctttcttatgaaggctgggaggagccaaaagcttggagaatccccaccacacacgagcaaagaatggagcaatgcccgagagccacaggatcactttttttttaaaggatggggtctcactatattgcccaagctggtcttgaactcctgggctcaagtgat

SEQ ID NO: 178537 - DNA, 601 bp, Human
cagctctggggctccaaacatcgaggttcccagccacagacatgaaggtttggtgcttataagcgcccagccacaatcacataaaatctcatttcttttttttttttttttttttttttttttgagacggagtctcgctcttgttgcctaggctggagtgcaacggcacaatctcagctccactgcaacctccacctcccgggttcaagtgactgaaccctgctgcctcagcctcctgagtagttgggattacaggcgtctgccaccacacccagctaatttttgtatttttagtagagasagggtttctccatgttggccaggctggtctcgaactcctgacctccggtgatccacccgcctcagcctcccaaagtgctgggattacagatgtgagccaccgcgcccggttgtaaaatctcatttcttttgggctttgggtctgtcttaatctgaatgactattctaaactgtggggctacagcttctgattgcagagtaaaccatccctgagctgggcctgcggaagtctgtgctgacatccaccacccatcatcaagggacaccaggaaccaggacaaaggctgccgcgacacacagg

SEQ ID NO: 178538 - DNA, 601 bp, Human
acctgttggccactgacaccagcagcacacgtgggatgtgacctgggaggaacaactgccccatatggaattctgactgtaggtggattcctcagctctggggctccaaacatcgaggttcccagccacagacatgaaggtttggtgcttataagcgcccagccacaatcacataaaatctcatttcttttttttttttttttttttttttttttgagacggagtctcgctcttgttgcctaggctggagtgcaacggcacaatctcagctccactgcaacctccacctcccgggttcaastgactgaaccctgctgcctcagcctcctgagtagttgggattacaggcgtctgccaccacacccagctaatttttgtatttttagtagagacagggtttctccatgttggccaggctggtctcgaactcctgacctccggtgatccacccgcctcagcctcccaaagtgctgggattacagatgtgagccaccgcgcccggttgtaaaatctcatttcttttgggctttgggtctgtcttaatctgaatgactattctaaactgtggggctacagcttctgattgcagagtaaaccatcc

SEQ ID NO: 178539 - DNA, 601 bp, Human
acagagactgactttgagtcattcatttttttggctacagaaatatgtctccacaaaaccatccatactcttacctgttggccactgacaccagcagcacacgtgggatgtgacctgggaggaacaactgccccatatggaattctgactgtaggtggattcctcagctctggggctccaaacatcgaggttcccagccacagacatgaaggtttggtgcttataagcgcccagccacaatcacataaaatctcatttcttttttttttttttttttttttttttttgagacggagtctcrctcttgttgcctaggctggagtgcaacggcacaatctcagctccactgcaacctccacctcccgggttcaagtgactgaaccctgctgcctcagcctcctgagtagttgggattacaggcgtctgccaccacacccagctaatttttgtatttttagtagagacagggtttctccatgttggccaggctggtctcgaactcctgacctccggtgatccacccgcctcagcctcccaaagtgctgggattacagatgtgagccaccgcgcccggttgtaaaatctcatttcttttgggctt

SEQ ID NO: 178540 - DNA, 601 bp, Human
ctttgctttgggattccctccctccagagtctatttagccccagggcacatggcagctctcacccctatcgtcttcctaactaaagtggtttaagaggagtgacctcctgcaacagaagatgaaaggccactttaccttttttagctcgaagcacccgccctagcctttgggcttcctgacgcctggagccaccatgggatgagatctgaatgaggacatttgcttccggcagatcaaacgaagtgtcacctacctacagaaacaagttggaaggtttttatatatgaggaaaaaaaaaaagtcaactgatccagaatttaaataagttctgtagataattttgaaacataatcactcttttctcctctttataccagggtctatctgatgcaggcagagagaggtgaagcaataaacctcagaaaggcatctctgggtctccaggaccttgtgtgagttctgctaagagtcatcctgaagaattaataccaggcatcagtgacattcagtgctgggtgccaggagcccagagatgagagggcccttgaacagagactgactttgagtcattcatttttttggctacagaaatatgtctcc

SEQ ID NO: 178541 - DNA, 601 bp, Human
tgtgtctgcccaagctgctcctaccaaacctttccctgcctcctgatcaagttccagaagcagcttccagctcctccacttacactggtggcccagctctgttttctcccttccatgtctaccccataagcactgccttgccctggctccctctcaccatctaccaacacagctgcacagtgtacagagcacatctgtgtggattccgtgacactgtcatggaaaacacctgcatattcacccccaaggtatgagaaataatgatgggccataaggatctaggtctttgctttgggattcyctccctccagagtctatttagccccagggcacatggcagctctcacccctatcgtcttcctaactaaagtggtttaagaggagtgacctcctgcaacagaagatgaaaggccactttaccttttttagctcgaagcacccgccctagcctttgggcttcctgacgcctggagccaccatgggatgagatctgaatgaggacatttgcttccggcagatcaaacgaagtgtcacctacctacagaaacaagttggaaggtttttatatatgaggaaaaaaaaaaagtcaactgatccagaa

SEQ ID NO: 178542 - DNA, 601 bp, Human
ggctcaagctatcctcctgccttggcctcccaaagtgctgggattataggtgtaagccactgtgcccagccagccgactacattttatgacttataagctgaatcctcacagcagtcttggcaagacaggattgtcacccccactttggatgggaaaaccaagtctcagaggagaaaataatttgccaaaggtgacacagctggcttggtgcctgagtccatgctatttctagtccatgctatctgcctcatctccattttaaatacaagctactagacgcttcttaaacacatctgaacrcagtacagttccaacagatgcccactaatcttgtcattttcaaacattctagcagtccagatgcctccttgaataagcagactccttgaggatagggcttgtgtccttgtctcaggatgtgccctggtcccagtaagacagacacggccatctcttagcaagagtgtcagtccctgccatgtccacaatggcagtctgggcccttttaccgcagtaagcaagcacaggggtgccacgcctcctcagaaaaagcctttgcaatgaggattctcacctcctcactcactgagcttgccctgc

SEQ ID NO: 178543 - DNA, 601 bp, Human
tggcctgtttttttgtttgtttttgttttaaacaggatcttgttctgttgcccaaggtggaataccgtggtgagatgtcagatcactgcaacctctgcctcccagactaaagcgattctcttgcctcagcctccggagtggctgggactacaggcgcacaccaccacacccagctagctaattgttgtattttttgtaggaacagggtttcatcatgttgcccagactggtctcaaactcctgagttcaagcaatctgcctaccttggcctcccaaagtgctgggattacaggtgtgagcygccgtgcccagccaggatttcttttcttttctttaagaatgctaaaaacagtcccccaatctcttctgacttgtaaagtttctgctgagaagtctgctgttagcatgatgagttatatgaccctttctctagctgtctttaagattctttcttttgtattgaccttggaaagtctgacggctatgtgctctggggatgatcatcttgtacagcaggaagagtcattctcaccctcgatcttagcaaccttagcatatgatttttattcccttgcttaaattaataacttttaccttttcg

SEQ ID NO: 178544 - DNA, 601 bp, Human
ttgattcctgccttaatttgtttatccaaaagtcattcaggagcaagttgtttagtttctatgtaattgtgtgggtttttttttttcttttttcttttatttagcgatgaggtctcgctatgttgcccagaatggtcttgaactcctgagttcaaatgatcctcccactttggcctcccaaagtgctgcggttacaggcatgagccactgtgcctggccaattgtgtggttttgagagttcttcctggtactgatttctacttttattccactgtgacccaagaaaatgcttggtatgatytcgacttttttgaatttattgagtcttttttttttttttttttttttgagagagtctcgctctgttgcccaggctggagtgcagtggcgcgatctcggctcactgcaagctccgcctcccaggttcacgccattctcctgcctcagcctcccgagtagctgagactacaggcaactgccaccacacacccggctaattttttgtatttttagtagagacggggtttcactgtgttagccaggatggtctcgatctcctgacctcgtgatccacccgccttggcttcccaaagtgctggga

SEQ ID NO: 178545 - DNA, 601 bp, Human
atggatgagggtttcttttgggagctgatgagaatattctaaacatgaattgtgttgatagttgcacaactttgtgaatattgtatttcctaggttttcttcgaggatccttatagtttgaggtcttacatttacatctttaatccattatgagttgatttttgtatgtggtgataggcaggggtctggtttcatccttctgcatacagttagccagtttccccagcaccatttattgaatagggagtactttccccactgcatatttttgccaattttgttgaacatcagttggctgcargtacatggcattatttctgagctctctattctgctccattggtctatgtgcctgttctgtaccagtaccatgctgttttggttactgtaagccctgtagcatagtttgaagttggatactgtgaggcctttggctttgttccttttgcttaggattgctttggctattcaggtgcttttgtggttccagatgaattttataagttttttttctaattctgtgaaaaatgatgttggcaatttgatagaatagtgttgaatctgtagattgttttgggcagtttggcaattttaatgatat

SEQ ID NO: 178546 - DNA, 601 bp, Human
ataccagtgagtagaaaaaggcattgtactcttctgcaaccatccctgcaggaaaaaatgagaaacggcaataaagaagacaacattagccattagaatgccaagagctaagggtcccaggctcaaaagcaagcactggagtggaaaagccctgcactcggggttaccacctgaacttggcatgggattgcatcaaaatttggaagtcttttgtgcttccaaggacaccatcaagtgaaaaaacaatcctcagaataaaaaaatgtggaaagcatatatctgataagggatttgtatctasgttatacaaagaactgttgaaactcaacaacaagacaaattaattataaatgagagaagaatatgaacagattacttctccaaaaacaatataaaaatagccagtaagcacatgaaatgatgctccacaccattaatcaccagggaaatgcaactcaaaagcacaatgagattatcacctcacgcccctctccgaggatggctacaatcaaaaaagcagataactgccactgttgtcaaggatgtggaaaaactagaacccgcatgcattgctgttgagaatgtaaatgatgcggctgct

SEQ ID NO: 178547 - DNA, 601 bp, Human
tctgacctggtgctcctcttaccctcacagctcggcaggaatcaggaggtaggaatgctattaccaacagggattttcatggatggataaaaaggtcatgatgcaaatcctccaaaaaactgggctcaaaacccaagcatcttgtcctctaggccagcatgagaggtctgaagtgtcactgcctctagctaaaagagggaaggtcagacaaccctgtcctcctaaggccaataatgggaactctcaccaatgcataaagagacacattaaaaacgtatctcaaaaggcagcctggattgcrgtcttttgcaatcaagaacctgggagtctaatgttctagggatgtccttttagtggaccatagggggaatttaattcccctacttctagaaccctccatctatccccaaaatataaagccctctggacaccaaatactgacataaacgtaatatttgtgtaacaggaaagaaagcaaatgcctcagccagtgaaagttagccaaagctttagaatttcccaattattaaaatacctgatttgtagtacaggatagctctgatgtctgggaggcaaactgaggcaaactaaggcctggagc

SEQ ID NO: 178548 - DNA, 601 bp, Human
catgactctgggaactccaaccactgctcctcaacaggcagcaccgaagacacagctccaaccaacacaaactactacggcatggcattgtgcctttttgtcgaggtcacctttcaaagaattgctctttctgacctggtgctcctcttaccctcacagctcggcaggaatcaggaggtaggaatgctattaccaacagggattttcatggatggataaaaaggtcatgatgcaaatcctccaaaaaactgggctcaaaacccaagcatcttgtcctctaggccagcatgagaggtctgargtgtcactgcctctagctaaaagagggaaggtcagacaaccctgtcctcctaaggccaataatgggaactctcaccaatgcataaagagacacattaaaaacgtatctcaaaaggcagcctggattgcggtcttttgcaatcaagaacctgggagtctaatgttctagggatgtccttttagtggaccatagggggaatttaattcccctacttctagaaccctccatctatccccaaaatataaagccctctggacaccaaatactgacataaacgtaatatttgtgtaacaggaaaga

SEQ ID NO: 178549 - DNA, 601 bp, Human
cgctggagggaaggtcaaagaggtggaaggaaaatgttatgctgaaaatccctttccaacaagggtgccaagcgccggtcttgaacgaagtaccctgcctaagcatcatttcctaaagcgcttgaagagcgggtgtacatgtttgctgggcgccttgctccgcgatgagtggtactccatgtacacagtgtcgtcggccccagacatagaactcatggtgccaaagcgccgagatgcctgccgggaagggggaaccagcccatgttagtctccagaagaaaagatactccttttataatayttataatcacagcaaattttataagacttacataaatttaatacatcatttttaataatgtttacagatcgcttactgtctcaggcattgttctaagcattttacatgcattatctcctctaatcctcaaaactactataatccacacctgaaagaagaggaaactgagacacagagagattaactaacctatccaagatcacatagctcttaaggagatgggatttgaacacccaggtagcctggcttcagactgttcttaaccataatgccacactacctcacttaataacaacttct

SEQ ID NO: 178550 - DNA, 601 bp, Human; identical to SEQ ID NO: 27219

SEQ ID NO: 178551 - DNA, 601 bp, Human; identical to SEQ ID NO: 27220

SEQ ID NO: 178552 - DNA, 601 bp, Human; identical to SEQ ID NO: 27221

SEQ ID NO: 178553 - DNA, 601 bp, Human; identical to SEQ ID NO: 27222

SEQ ID NO: 178554 - DNA, 601 bp, Human; identical to SEQ ID NO: 27223

SEQ ID NO: 178555 - DNA, 601 bp, Human; identical to SEQ ID NO: 27224

SEQ ID NO: 178556 - DNA, 601 bp, Human; identical to SEQ ID NO: 27225

SEQ ID NO: 178557 - DNA, 601 bp, Human; identical to SEQ ID NO: 27226

SEQ ID NO: 178558 - DNA, 601 bp, Human; identical to SEQ ID NO: 27227

SEQ ID NO: 178559 - DNA, 601 bp, Human; identical to SEQ ID NO: 27228

SEQ ID NO: 178560 - DNA, 601 bp, Human
gtcaccccacagagacaatggggtgtgagccaacgtctcctgcctgggccgggcccacaacgcgggccgtgcggagcacttcccgccgctgtgctgggagctgaagggtccggcctgcacctggccctcctcccctgtgccgccgccagcgcccttagggtggaggacgggacagagacccctggtgccaggcacagctgtgtccccctgccaaccccagcagccgcatttccgactgtgggctccccagagtcccccgcagacccccagagctgagccccccagagcttccttgggggcyaccccggcctctccccagcgggctcagggtcacagactggccacccctagagtgggtggcggggcactcgggggcctcacctttcctcagggccatcctgcatgcagggcaggccgcaggcaggcagcgagggagggtacgtctgctgtgccggccacccctgccctctggatttccccactgcggggcagcccgcgcctgtcacctggctggcccaacccagctggccctggctctgttaaccccctcgtgccgggcggccggcatcagcccggagccctggggtgcagacagtgcagg

SEQ ID NO: 178561 - DNA, 601 bp, Human
tgcaaggggtcaccccacagagacaatggggtgtgagccaacgtctcctgcctgggccgggcccacaacgcgggccgtgcggagcacttcccgccgctgtgctgggagctgaagggtccggcctgcacctggccctcctcccctgtgccgccgccagcgcccttagggtggaggacgggacagagacccctggtgccaggcacagctgtgtccccctgccaaccccagcagccgcatttccgactgtgggctccccagagtcccccgcagacccccagagctgagccccccagagcttccytgggggctaccccggcctctccccagcgggctcagggtcacagactggccacccctagagtgggtggcggggcactcgggggcctcacctttcctcagggccatcctgcatgcagggcaggccgcaggcaggcagcgagggagggtacgtctgctgtgccggccacccctgccctctggatttccccactgcggggcagcccgcgcctgtcacctggctggcccaacccagctggccctggctctgttaaccccctcgtgccgggcggccggcatcagcccggagccctggggtgcagac

SEQ ID NO: 178562 - DNA, 601 bp, Human
gggagtggcctgagccagctctggagctcagctcaggcttgggggtggccgaagctgcaaggggtcaccccacagagacaatggggtgtgagccaacgtctcctgcctgggccgggcccacaacgcgggccgtgcggagcacttcccgccgctgtgctgggagctgaagggtccggcctgcacctggccctcctcccctgtgccgccgccagcgcccttagggtggaggacgggacagagacccctggtgccaggcacagctgtgtccccctgccaaccccagcagccgcatttccgactstgggctccccagagtcccccgcagacccccagagctgagccccccagagcttccttgggggctaccccggcctctccccagcgggctcagggtcacagactggccacccctagagtgggtggcggggcactcgggggcctcacctttcctcagggccatcctgcatgcagggcaggccgcaggcaggcagcgagggagggtacgtctgctgtgccggccacccctgccctctggatttccccactgcggggcagcccgcgcctgtcacctggctggcccaacccagctggccctggctct

SEQ ID NO: 178563 - DNA, 601 bp, Human
aaggggagggaactgagccattggccaaggtccggccattttcagaatattctggagcaggtcttggtgggcactcgctcactgccctcagaggctggacagggagctgggcacctcctgccccagttaggccccccagcggggtctcacctgcctgcatccaggccttggtcgggtgctgcgggaggggaccggggcaccgccgtcgggggacaggtaggaaccctggaccgtcggccaccaaagctcacattgcctttcaggacaaggggccacaggccccacagacccagccagcagsctcccaagcagcgatgacccaaaacctctactgtatggcccccccatcctcagagagtgtggaattgctgggatggtggcaggggcgaggtggggcccccccgactgcccttctgtcacgatgggttgggagtggcctgagccagctctggagctcagctcaggcttgggggtggccgaagctgcaaggggtcaccccacagagacaatggggtgtgagccaacgtctcctgcctgggccgggcccacaacgcgggccgtgcggagcacttcccgccgctgtgctgggagctgaagggtc

SEQ ID NO: 178564 - DNA, 601 bp, Human
agatgcgaagaagccggtgagccccacaggtcctccggctcaaaagctgacactgcgcttcccaccccatgggacagaggagtggccgccccgccccgctgcacagacgctcagggcttggctctccagctgtgcgcaggccacgtgggctcggccaggctgggtctcgggctgtctggccatgtggcagccgcacccccaaggcaggcgcttgagccaggccagtctgccacgttggcctagaggaaggggagggaactgagccattggccaaggtccggccattttcagaatattctgsagcaggtcttggtgggcactcgctcactgccctcagaggctggacagggagctgggcacctcctgccccagttaggccccccagcggggtctcacctgcctgcatccaggccttggtcgggtgctgcgggaggggaccggggcaccgccgtcgggggacaggtaggaaccctggaccgtcggccaccaaagctcacattgcctttcaggacaaggggccacaggccccacagacccagccagcagcctcccaagcagcgatgacccaaaacctctactgtatggcccccccatcctcaga

SEQ ID NO: 178565 - DNA, 601 bp, Human
gtggcaggacccagcctgctgggagggccgcgggtctggaggtggaaatcgtctggcagcgcctcaatcccctctaaggccacgggtggttcgggtgcgtccagctgagccaatggtgggagtggaaggtgcggacatggcgccaccgcctccactgtgccctgcaggctccgtgcccctggaccctgcgctcatgaggaccctggaggagggccacgacttcatccaggagttccccgggagccccgccttcgctgcactcacctccatagcccagaagattctggacgcgacgcccgcrtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtc

SEQ ID NO: 178566 - DNA, 601 bp, Human
caggacacgccatgaggggccgctgacgtggcccgtcctgaccctgccagcttgccctgctccaggagagccagtgaaagcaccttctccttcctgctcagcctgacactcttgcaaccacctacgaccgctccaagcccctccagctctgagggcaccacccccagaggcagcatgcaggggcagaaagcccccaagaagactcaagtgcccaggattgtactgcacagcgctttctgtgtcactgcctctcgcctccacccttcttggggccctgttaacagagtggccggagactaayttccatttagcttaggcaaagttgcaaggacactgcggttaggaaacccatcgggggtgaggactccgagctgggtgaccagggcagggagagccaggcacagccatgcgcaccttctggggctgcaccggatccacaatggcagcctccttggtctcatcatcaatgaccaggtacatgtagttgtcggtcagggcaggcagcacctctaccttcatggtgccctcgtccacggtcaggttcttccgcaaatctgtgtggcagaaaactcccagcagggctggacctgcagacacagag

SEQ ID NO: 178567 - DNA, 601 bp, Human
ctgggggcttgtcctcacaaagcagacagagccgtggggggagacaggccttgatgtccctaaacccaccggggcgagaagtgagccaggtcccacacccccaggtgagacgcggcacttaccagtggtggtgggtggtgagcactgtggtcagtttcaccccgtgctttctcgccgcgtccacgacctgcagtggccccggggaaggacaaaggcctgtcacactcctaggcctggcttgctggcctatatggtagggtgcccagcagaacccaggacacgccatgaggggccgctgacrtggcccgtcctgaccctgccagcttgccctgctccaggagagccagtgaaagcaccttctccttcctgctcagcctgacactcttgcaaccacctacgaccgctccaagcccctccagctctgagggcaccacccccagaggcagcatgcaggggcagaaagcccccaagaagactcaagtgcccaggattgtactgcacagcgctttctgtgtcactgcctctcgcctccacccttcttggggccctgttaacagagtggccggagactaatttccatttagcttaggcaaagttgcaa

SEQ ID NO: 178568 - DNA, 601 bp, Human
ctggggagaggcctggggtggatttcttgtcctggtgcagtgggtccagggcatggcctgggggtggatttttgatttttgaaggcccccaggtgatcctgatgtgctgcccagtttgtggcccgacactctggcaggagatcaaactgttcagcatgggaatcacctgggtgcgtctgggatgagcagctggccctagacgcggcctgtctgcaggggaggccagcctgggccagctccagcaggtggaggtgcctcctacgcgcccaggtttccccaggggagcctgcctgacccgcakttcagaaaggggcggttgaaggggcccttcccgggtctcacatgatatcacagactccttcgtgtgcctcccatgaagactccagcaaccacaccagaaaccgcctgccttggcaccactgggccccaagataacagggtggagtggtggccgctgccctctgcccctcccacccttcaggagggcgcggcaccacaggccttggtctgcccatcaccacccaccatcggtgagcaaaccccaccccgctgaagctatggcctggcttaggacttcacgtgtcggcatgaatgttagagg

SEQ ID NO: 178569 - DNA, 601 bp, Human
tttacaaagcaccacctggttcccacccccacatcctagggcagtgggtctggggcgtggcctgggggtggatttcttgtcctggtgcagtgggtctggggagaggcctggggtggatttcttgtcctggtgcagtgggtccagggcatggcctgggggtggatttttgatttttgaaggcccccaggtgatcctgatgtgctgcccagtttgtggcccgacactctggcaggagatcaaactgttcagcatgggaatcacctgggtgcgtctgggatgagcagctggccctagacgcggyctgtctgcaggggaggccagcctgggccagctccagcaggtggaggtgcctcctacgcgcccaggtttccccaggggagcctgcctgacccgcagttcagaaaggggcggttgaaggggcccttcccgggtctcacatgatatcacagactccttcgtgtgcctcccatgaagactccagcaaccacaccagaaaccgcctgccttggcaccactgggccccaagataacagggtggagtggtggccgctgccctctgcccctcccacccttcaggagggcgcggcaccacaggccttgg

SEQ ID NO: 178570 - DNA, 601 bp, Human
cgaggcgcccgtccctcccgccatgccctccgccctcctctggggctccctggccacaccttctccctgcacccctggtttgactccacccaggggtccgagtgtggccctgggtcactcccacctgggttcaaggctggggctgccacctcccaccaggaggcctcccagccgtacaaggcccacatcgagtcaccgggtgaaaccccgcactgtgaggccagtcgggacaaggccacagtaacaagcacgggaggcagcccccaccaccagcagcctccgcaccgccttagaaggccgmagccatgaagggcccggcctacagtgaggccgtcccccggccatatgacctccacaggtggctccacaggtctgcaaccaccctgggaggcaggcagggcccccagactagcacaggtccctgagtccacactacggcatcaaggaacacagccccagggctgagccacccctcgccctgctggaagaaactgactcctttcccgtgggacccgcccggaccccagctgtccagcagtctccgccagcacagcccttgctgcaagcgtaacttccttccagaccacgatccaaacccatc

SEQ ID NO: 178571 - DNA, 601 bp, Human
aggtccccaactccatccctcccacaccggcaccacccaggctcatcccccagccctgcgcactgcagcctgaaggcaccttatccctcacagcgaggcgcccgtccctcccgccatgccctccgccctcctctggggctccctggccacaccttctccctgcacccctggtttgactccacccaggggtccgagtgtggccctgggtcactcccacctgggttcaaggctggggctgccacctcccaccaggaggcctcccagccgtacaaggcccacatcgagtcaccgggtgaaaccycgcactgtgaggccagtcgggacaaggccacagtaacaagcacgggaggcagcccccaccaccagcagcctccgcaccgccttagaaggccgcagccatgaagggcccggcctacagtgaggccgtcccccggccatatgacctccacaggtggctccacaggtctgcaaccaccctgggaggcaggcagggcccccagactagcacaggtccctgagtccacactacggcatcaaggaacacagccccagggctgagccacccctcgccctgctggaagaaactgactcctttcccgtg

SEQ ID NO: 178572 - DNA, 601 bp, Human
tgccgtgcagggcgagctgggccacactggcctgaatcccaggcctgctctctgggctcagagtgtgagtgtctacccactctggcgaccccgctgtgcacagcggccctgagcagcccacaggaaggcactgcgcagtgacggccccactcaccttggcccaggccagcttctcccggatggcggcattgccgggctccacgtggcgtgcaaacttgaggttgttgatggtgtactcgtggccacagtagactctctgaggagagaggtgacaggtgagctcggaaggctgttaccaccygtgaaagtcctcagggacgggacctggatgcccccggggggtgtccggtgagagggtgccaggagggagagcagccccgccctggttaaggccccccacaccccggcccgcagggaggcgctgcctactgtgtccggggggagccggcccaagacctccagcagagctttacacatctcatccgcagtcccttcatagaacttcccgcagccagccacaaacaaggtgtcacctggaaacaaggacagccacgaggtgggggccacttgaggctggtggctaggactcaggagggggcca

SEQ ID NO: 178573 - DNA, 601 bp, Human
agggatctccatagaacccctgggtttgccgtgcagggcgagctgggccacactggcctgaatcccaggcctgctctctgggctcagagtgtgagtgtctacccactctggcgaccccgctgtgcacagcggccctgagcagcccacaggaaggcactgcgcagtgacggccccactcaccttggcccaggccagcttctcccggatggcggcattgccgggctccacgtggcgtgcaaacttgaggttgttgatggtgtactcgtggccacagtagactctctgaggagagaggtgacasgtgagctcggaaggctgttaccacctgtgaaagtcctcagggacgggacctggatgcccccggggggtgtccggtgagagggtgccaggagggagagcagccccgccctggttaaggccccccacaccccggcccgcagggaggcgctgcctactgtgtccggggggagccggcccaagacctccagcagagctttacacatctcatccgcagtcccttcatagaacttcccgcagccagccacaaacaaggtgtcacctggaaacaaggacagccacgaggtgggggccacttgaggct

SEQ ID NO: 178574 - DNA, 601 bp, Human
acacagagccacgttctgtggcctggagagccagcagagccacgtgctgccagcctgaccctactgctcagaatgtgggaacaggctgggcgctttttacacacgcagcgtctgaggcctactccagaccctccgaggcagagggatctccatagaacccctgggtttgccgtgcagggcgagctgggccacactggcctgaatcccaggcctgctctctgggctcagagtgtgagtgtctacccactctggcgaccccgctgtgcacagcggccctgagcagcccacaggaaggcactgygcagtgacggccccactcaccttggcccaggccagcttctcccggatggcggcattgccgggctccacgtggcgtgcaaacttgaggttgttgatggtgtactcgtggccacagtagactctctgaggagagaggtgacaggtgagctcggaaggctgttaccacctgtgaaagtcctcagggacgggacctggatgcccccggggggtgtccggtgagagggtgccaggagggagagcagccccgccctggttaaggccccccacaccccggcccgcagggaggcgctgcctactgtgt

SEQ ID NO: 178575 - DNA, 601 bp, Human
ctcctgagtagttgggattacaagcgtgagccaccacgcccggccagcagggagaatttcttgaacccgggaggtgctggttgcagtgagccgagattacgccactgtactccagcctgggcgacagagggagactccgtctcaaaaaaaaattaaaaaaaaaaaaaagatgagtatttatgattcatctgatttagagttggaatttgcatgagtaaatactgtaaaataatgttaacctctactctaagaaattgaaaaagatgctcaaaaaaccgggtgatttatttaaaacaaccckgtcagaggcagcgactctcactccactcagcagagggagcccacgcctgagaccacccaggcgtgcgtgcttgtgacaccgtttccagtgaattcggggaaacacacccctggagaaccccgtcctgctcctggcagactttggcccagctggcctgggctacgccatggaggctcacgtggggccaccgtggagataagagtcctttggacacagagccacgttctgtggcctggagagccagcagagccacgtgctgccagcctgaccctactgctcagaatgtgggaacaggctggg

SEQ ID NO: 178576 - DNA, 601 bp, Human
ctcgctctgtcaccaggctggagcgcagtggagcgatcttggctcactgcaacctctgcctcctgagttcaagcgattctcctgcctcagcctcctgagtagttgggattacaagcgtgagccaccacgcccggccagcagggagaatttcttgaacccgggaggtgctggttgcagtgagccgagattacgccactgtactccagcctgggcgacagagggagactccgtctcaaaaaaaaattaaaaaaaaaaaaaagatgagtatttatgattcatctgatttagagttggaatttgyatgagtaaatactgtaaaataatgttaacctctactctaagaaattgaaaaagatgctcaaaaaaccgggtgatttatttaaaacaaccctgtcagaggcagcgactctcactccactcagcagagggagcccacgcctgagaccacccaggcgtgcgtgcttgtgacaccgtttccagtgaattcggggaaacacacccctggagaaccccgtcctgctcctggcagactttggcccagctggcctgggctacgccatggaggctcacgtggggccaccgtggagataagagtcctttg

SEQ ID NO: 178577 - DNA, 601 bp, Human
aataaaaacatgttcacaaaagacttgtacacaaatgtccatagcagctttattcaaatagcaaaaaactggaaacagacaaatgcataaacaaattgtagcatttccacacaatgggctactcagaagcaaagagcgtggctgaccctcaccaacatcagcggggccgagaatgccacagagatgacggagcaatgagattctgttcatgggaaactagaaagtgacctgaggtcacagcagagcaacagctggcggggacgccacatgggagggacacaggagcctttggggtagtggwaagttccacatctggactgtggaggggattacacaagtgcaaacatcatcaacattcctcaaactgcaatctgtccactcaagacagacacacgggccaggtgacgtggctcacgcctgtaatctcagcactttgggaggccaaggcaggcggattacctgaagtcaggagttcaagacgagcctggccaacatggcaaaaccctatctctactaaaagtagaaaaattagctgggcgtgttggctggcgcctgtaatcccagctactcaagaggctgaggcagggagaatttttttttt

SEQ ID NO: 178578 - DNA, 601 bp, Human
tcaagcattggtgggggactgtagaacagtacaaccatttttggaaaacggttcacacctttaaccacacaacacagcaattccactcttaggtagtatccaagagcaataaaaacatgttcacaaaagacttgtacacaaatgtccatagcagctttattcaaatagcaaaaaactggaaacagacaaatgcataaacaaattgtagcatttccacacaatgggctactcagaagcaaagagcgtggctgaccctcaccaacatcagcggggccgagaatgccacagagatgacggagcratgagattctgttcatgggaaactagaaagtgacctgaggtcacagcagagcaacagctggcggggacgccacatgggagggacacaggagcctttggggtagtggtaagttccacatctggactgtggaggggattacacaagtgcaaacatcatcaacattcctcaaactgcaatctgtccactcaagacagacacacgggccaggtgacgtggctcacgcctgtaatctcagcactttgggaggccaaggcaggcggattacctgaagtcaggagttcaagacgagcctggccaaca

SEQ ID NO: 178579 - DNA, 601 bp, Human
ggctgaggcaggagaatggcttgaacccgggaggcagagcttgcagtgagatgagatcacaccactgcactccagcctgggcgacagagcaagactttgtctcaaaaaacaaacaaataaatatatatatgtatatacacacacacacacacacacacacacacatatatatatatatctcacaaagacttgtttccagatgatataaggaactcttacaagagcagcccaacaggccaaacccaatatttaaaatggacaaaagattgaacataaacttcatgagaaggcatccaaaggycgacacacatgaaaagatggtcaaccccactagtcatggggaaatccacattttaaaggcagtgagacgccaccacaggcaagttagaatggcaaaaattggagagaccgacaacaccaagcagtgctggcacagcatggaggccccggaactcaagcattggtgggggactgtagaacagtacaaccatttttggaaaacggttcacacctttaaccacacaacacagcaattccactcttaggtagtatccaagagcaataaaaacatgttcacaaaagacttgtacacaaatgtcca

SEQ ID NO: 178580 - DNA, 601 bp, Human
ggaggccgaggcgggtggatcacgaggtcaggagatcgagaccttcctggataacacggtgaaacccatctctactaaaaatacaaaaaattagctgggcgtggtgacgggcacctgtagtcccagctacttgggaggctgaggcaggagaatggcttgaacccgggaggcagagcttgcagtgagatgagatcacaccactgcactccagcctgggcgacagagcaagactttgtctcaaaaaacaaacaaataaatatatatatgtatatacacacacacacacacacacacacacacatatatatatatatctcacaaagacttgtttccagatgatataaggaactcttacaagagcagcccaacaggccaaacccaatatttaaaatggacaaaagattgaacataaacttcatgagaaggcatccaaaggccgacacacatgaaaagatggtcaaccccactagtcatggggaaatccacattttaaaggcagtgagacgccaccacaggcaagttagaatggcaaaaattggagagaccgacaacaccaagcagtgctggcacagcatggaggccccggaactcaagcattggt

SEQ ID NO: 178581 - DNA, 601 bp, Human
gagtaggccgggcgcagtggctcacatctgtaatcccagcacttttggagcccaaggtgggcagatcacctgaggtcaggagttcgagtccagcctgatcaacatggagaaaccccatctctactaaaaatacaaaattaaccgggtgtggtggtgcatgcctgtaatcccagctactcgggaggctgaggcaggagaatcgcttaaacccaggaggtggatgttgcggtgagctgagatcgcgccgctgcactccagcctgggcaacaagagtgaaactccgtctcaaaaaaaaaaaaaagaaacaaacaaaaaataagtaaatggaacttcaccaaaactataaactattttccaaaagacaatgttaagaaaatgaaaaggcaagccatgagctgggagagaaaaacatcttttaaatatatatctcagctgggcgtggtgggtcacgcctgtaatcccagcactttgggaggccgaggcgggtggatcacgaggtcaggagatcgagaccttcctggataacacggtgaaacccatctctactaaaaatacaaaaaattagctgggcgtggtgacgggcacctgtagtcccagctac

SEQ ID NO: 178582 - DNA, 601 bp, Human
aaaacttctaggaagaaacacaggagaaagtctttgtgagctaagggtatgcaaagatatcttagaaagggcacaagaaacataaaagaaaaattgagtaggccgggcgcagtggctcacatctgtaatcccagcacttttggagcccaaggtgggcagatcacctgaggtcaggagttcgagtccagcctgatcaacatggagaaaccccatctctactaaaaatacaaaattaaccgggtgtggtggtgcatgcctgtaatcccagctactcgggaggctgaggcaggagaatcgcttraacccaggaggtggatgttgcggtgagctgagatcgcgccgctgcactccagcctgggcaacaagagtgaaactccgtctcaaaaaaaaaaaaaagaaacaaacaaaaaataagtaaatggaacttcaccaaaactataaactattttccaaaagacaatgttaagaaaatgaaaaggcaagccatgagctgggagagaaaaacatcttttaaatatatatctcagctgggcgtggtgggtcacgcctgtaatcccagcactttgggaggccgaggcgggtggatcacgaggtcaggaga

SEQ ID NO: 178583 - DNA, 601 bp, Human
ttgtttgtaaatataaaagctaagactttaaaacttctaggaagaaacacaggagaaagtctttgtgagctaagggtatgcaaagatatcttagaaagggcacaagaaacataaaagaaaaattgagtaggccgggcgcagtggctcacatctgtaatcccagcacttttggagcccaaggtgggcagatcacctgaggtcaggagttcgagtccagcctgatcaacatggagaaaccccatctctactaaaaatacaaaattaaccgggtgtggtggtgcatgcctgtaatcccagctaytcgggaggctgaggcaggagaatcgcttaaacccaggaggtggatgttgcggtgagctgagatcgcgccgctgcactccagcctgggcaacaagagtgaaactccgtctcaaaaaaaaaaaaaagaaacaaacaaaaaataagtaaatggaacttcaccaaaactataaactattttccaaaagacaatgttaagaaaatgaaaaggcaagccatgagctgggagagaaaaacatcttttaaatatatatctcagctgggcgtggtgggtcacgcctgtaatcccagcactttgggaggc

SEQ ID NO: 178584 - DNA, 601 bp, Human
gacagtccttcgacagacagccctgaacacctcgggatcacactgcgagagggtgaacctctaccctcacctcgcaccacacacaaacaccatcttgaaagggaacactgtaaattgtttgtaaatataaaagctaagactttaaaacttctaggaagaaacacaggagaaagtctttgtgagctaagggtatgcaaagatatcttagaaagggcacaagaaacataaaagaaaaattgagtaggccgggcgcagtggctcacatctgtaatcccagcacttttggagcccaaggtgggcrgatcacctgaggtcaggagttcgagtccagcctgatcaacatggagaaaccccatctctactaaaaatacaaaattaaccgggtgtggtggtgcatgcctgtaatcccagctactcgggaggctgaggcaggagaatcgcttaaacccaggaggtggatgttgcggtgagctgagatcgcgccgctgcactccagcctgggcaacaagagtgaaactccgtctcaaaaaaaaaaaaaagaaacaaacaaaaaataagtaaatggaacttcaccaaaactataaactattttccaaaagac

SEQ ID NO: 178585 - DNA, 601 bp, Human
ctagcttttctgatagaagttcacgagatgattctgaaaacggaaatgtaaaaggcttaaaacaactaaaaccattttgaaaaagaacactggaggattcacacataccagtgccaagactcagcacagagttacagtcatcaaggtgctgtcctcggacaccgtggcaagtcatagagaccaacgaaacagagcagagaccagaagcagactcgggcatagagggcccattcttttcagaaaggtgccaaggcaatccagggaggaaaggacagtccttcgacagacagccctgaacacstcgggatcacactgcgagagggtgaacctctaccctcacctcgcaccacacacaaacaccatcttgaaagggaacactgtaaattgtttgtaaatataaaagctaagactttaaaacttctaggaagaaacacaggagaaagtctttgtgagctaagggtatgcaaagatatcttagaaagggcacaagaaacataaaagaaaaattgagtaggccgggcgcagtggctcacatctgtaatcccagcacttttggagcccaaggtgggcagatcacctgaggtcaggagttcgagtccag

SEQ ID NO: 178586 - DNA, 601 bp, Human
gcagccaggctagcttttctgatagaagttcacgagatgattctgaaaacggaaatgtaaaaggcttaaaacaactaaaaccattttgaaaaagaacactggaggattcacacataccagtgccaagactcagcacagagttacagtcatcaaggtgctgtcctcggacaccgtggcaagtcatagagaccaacgaaacagagcagagaccagaagcagactcgggcatagagggcccattcttttcagaaaggtgccaaggcaatccagggaggaaaggacagtccttcgacagacagcsctgaacacctcgggatcacactgcgagagggtgaacctctaccctcacctcgcaccacacacaaacaccatcttgaaagggaacactgtaaattgtttgtaaatataaaagctaagactttaaaacttctaggaagaaacacaggagaaagtctttgtgagctaagggtatgcaaagatatcttagaaagggcacaagaaacataaaagaaaaattgagtaggccgggcgcagtggctcacatctgtaatcccagcacttttggagcccaaggtgggcagatcacctgaggtcaggagtt

SEQ ID NO: 178587 - DNA, 601 bp, Human
gcgccctgcaggaggcggcctctcaccagggactgggctccagcacctcctttcaaacggctggctccaccgcgtgggctggctccaccgtgtggtgtgccgaaagacacggaccagctggtgtgcccacgccttcccagcaggaaagcaaacaccacaagcaccggggaaggggagtttggcagtttctttaaaagtcaaacacacctcccatccagcccggccactcccttctcctgggtgttcacacggggctgcggctgggatgtccatccctccaaacgcatgctcaaatctgatycccaattaatggaggtgtttggatcatggggggaatcctttgtgaacggcttggtgccctgctccaagtgcgagtttttgctgttagttcccacaggatctggttgtttaaaagaaacttttgcctcccccactctctccttcctctggccacatgcttcacacccaccagctcctttcgccttctgccatgagcagaagcagcctgaggcctcaccaggtgcagacgcccaggccatgctgcttatatagcctgcataaccatgagccacataaacctccttttataagtcacccggcc

SEQ ID NO: 178588 - DNA, 601 bp, Human
gcataaaaaaatctattggacttcattaaaattaaaaatgttggctcaaaagatactgctaagaaaaccagaggccgcagaatgggaggcgccctgcaggaggcggcctctcaccagggactgggctccagcacctcctttcaaacggctggctccaccgcgtgggctggctccaccgtgtggtgtgccgaaagacacggaccagctggtgtgcccacgccttcccagcaggaaagcaaacaccacaagcaccggggaaggggagtttggcagtttctttaaaagtcaaacacacctcccrtccagcccggccactcccttctcctgggtgttcacacggggctgcggctgggatgtccatccctccaaacgcatgctcaaatctgatccccaattaatggaggtgtttggatcatggggggaatcctttgtgaacggcttggtgccctgctccaagtgcgagtttttgctgttagttcccacaggatctggttgtttaaaagaaacttttgcctcccccactctctccttcctctggccacatgcttcacacccaccagctcctttcgccttctgccatgagcagaagcagcctgaggcc

SEQ ID NO: 178589 - DNA, 601 bp, Human
ccgggaggcaggggttgcggtgagccgagatcgcgccattgcactccagcctgggcggcaagagcgaaacgctgtctcaaaaaaaaaaaaacaaaaaacaaaaaaaaacacacaaattgtcaaaatcaggaatgaaagcaggaatatcattacagatccagcagacatttggggggtgggagttcatactaagttttaaaactatacaaattccaaaaataaaatacatgagaaaattttttgaccttgcgataaacaaagatttcttagatgggagacaaaaaagaatgaagcataaaaraatctattggacttcattaaaattaaaaatgttggctcaaaagatactgctaagaaaaccagaggccgcagaatgggaggcgccctgcaggaggcggcctctcaccagggactgggctccagcacctcctttcaaacggctggctccaccgcgtgggctggctccaccgtgtggtgtgccgaaagacacggaccagctggtgtgcccacgccttcccagcaggaaagcaaacaccacaagcaccggggaaggggagtttggcagtttctttaaaagtcaaacacacctcccatccagccc

SEQ ID NO: 178590 - DNA, 601 bp, Human
tgcctgtagtcccagctacttgggaggctgaggcatgagaatcgcttgaacccgggaggcaggggttgcggtgagccgagatcgcgccattgcactccagcctgggcggcaagagcgaaacgctgtctcaaaaaaaaaaaaacaaaaaacaaaaaaaaacacacaaattgtcaaaatcaggaatgaaagcaggaatatcattacagatccagcagacatttggggggtgggagttcatactaagttttaaaactatacaaattccaaaaataaaatacatgagaaaattttttgaccttgsgataaacaaagatttcttagatgggagacaaaaaagaatgaagcataaaaaaatctattggacttcattaaaattaaaaatgttggctcaaaagatactgctaagaaaaccagaggccgcagaatgggaggcgccctgcaggaggcggcctctcaccagggactgggctccagcacctcctttcaaacggctggctccaccgcgtgggctggctccaccgtgtggtgtgccgaaagacacggaccagctggtgtgcccacgccttcccagcaggaaagcaaacaccacaagcaccgggga

SEQ ID NO: 178591 - DNA, 601 bp, Human
ttacccaggcatggtggcacatgcctgtagtcccagctacttgggaggctgaggcatgagaatcgcttgaacccgggaggcaggggttgcggtgagccgagatcgcgccattgcactccagcctgggcggcaagagcgaaacgctgtctcaaaaaaaaaaaaacaaaaaacaaaaaaaaacacacaaattgtcaaaatcaggaatgaaagcaggaatatcattacagatccagcagacatttggggggtgggagttcatactaagttttaaaactatacaaattccaaaaataaaatacakgagaaaattttttgaccttgcgataaacaaagatttcttagatgggagacaaaaaagaatgaagcataaaaaaatctattggacttcattaaaattaaaaatgttggctcaaaagatactgctaagaaaaccagaggccgcagaatgggaggcgccctgcaggaggcggcctctcaccagggactgggctccagcacctcctttcaaacggctggctccaccgcgtgggctggctccaccgtgtggtgtgccgaaagacacggaccagctggtgtgcccacgccttcccagcaggaaagc

SEQ ID NO: 178592 - DNA, 601 bp, Human
gccaggcacagtggctcacgcctgtaatcccagcactttgggaggctgaggcgggcagatcacgaagtcacgagtttgagatcagcctggccaacatggtaaaaccccatctctactaaaaatataaaaattacccaggcatggtggcacatgcctgtagtcccagctacttgggaggctgaggcatgagaatcgcttgaacccgggaggcaggggttgcggtgagccgagatcgcgccattgcactccagcctgggcggcaagagcgaaacgctgtctcaaaaaaaaaaaaacaaaaaaaaaaaaaaaacacacaaattgtcaaaatcaggaatgaaagcaggaatatcattacagatccagcagacatttggggggtgggagttcatactaagttttaaaactatacaaattccaaaaataaaatacatgagaaaattttttgaccttgcgataaacaaagatttcttagatgggagacaaaaaagaatgaagcataaaaaaatctattggacttcattaaaattaaaaatgttggctcaaaagatactgctaagaaaaccagaggccgcagaatgggaggcgccctgcaggaggcggc

SEQ ID NO: 178593 - DNA, 601 bp, Human
atgacaggccaggcacagtggctcacgcctgtaatcccagcactttgggaggctgaggcgggcagatcacgaagtcacgagtttgagatcagcctggccaacatggtaaaaccccatctctactaaaaatataaaaattacccaggcatggtggcacatgcctgtagtcccagctacttgggaggctgaggcatgagaatcgcttgaacccgggaggcaggggttgcggtgagccgagatcgcgccattgcactccagcctgggcggcaagagcgaaacgctgtctcaaaaaaaaaaaaacaaaaaacaaaaaaaaacacacaaattgtcaaaatcaggaatgaaagcaggaatatcattacagatccagcagacatttggggggtgggagttcatactaagttttaaaactatacaaattccaaaaataaaatacatgagaaaattttttgaccttgcgataaacaaagatttcttagatgggagacaaaaaagaatgaagcataaaaaaatctattggacttcattaaaattaaaaatgttggctcaaaagatactgctaagaaaaccagaggccgcagaatgggaggcgccctgcagg

SEQ ID NO: 178594 - DNA, 601 bp, Human
gcctaggcaacatgctgtaaaccccctctctaccaaaaatacaaaaattaaccaggcatgatggcacaggcctgtagtcccagctacgggaggctgaggcagcagaatcgcctgaacccaggaggcggaggttgcagtgagccgagattgtgccactgcactccagcctgggcggcagagcaagacgctgtctctccccaaccaaaaaaaaaaaaaaaaaagaatgacaggccaggcacagtggctcacgcctgtaatcccagcactttgggaggctgaggcgggcagatcacgaagtcasgagtttgagatcagcctggccaacatggtaaaaccccatctctactaaaaatataaaaattacccaggcatggtggcacatgcctgtagtcccagctacttgggaggctgaggcatgagaatcgcttgaacccgggaggcaggggttgcggtgagccgagatcgcgccattgcactccagcctgggcggcaagagcgaaacgctgtctcaaaaaaaaaaaaacaaaaaacaaaaaaaaacacacaaattgtcaaaatcaggaatgaaagcaggaatatcattacagatccagcagacatt

SEQ ID NO: 178595 - DNA, 601 bp, Human
tgcagcacagctcagaagagctccacctcgtgtgggttctggactccagggtgcaaaaggagttgaaaactctcaacgtccctcctattgggattggtaaaatgatttatgggtgacacccacgcaatagtatattttacacctatcaaaaagaatgaggccgggcgtggttggcacatgcctgtaatcccagcactttgggaggccaaggcaggaggatcacttgagcccagaaattcaagaccagcctaggcaacatgctgtaaaccccctctctaccaaaaatacaaaaattaaccargcatgatggcacaggcctgtagtcccagctacgggaggctgaggcagcagaatcgcctgaacccaggaggcggaggttgcagtgagccgagattgtgccactgcactccagcctgggcggcagagcaagacgctgtctctccccaaccaaaaaaaaaaaaaaaaaagaatgacaggccaggcacagtggctcacgcctgtaatcccagcactttgggaggctgaggcgggcagatcacgaagtcacgagtttgagatcagcctggccaacatggtaaaaccccatctctactaaaaatat

SEQ ID NO: 178596 - DNA, 601 bp, Human
tgcctcaaaaaaataaaaataaaaaaataaggtcagtccttgcagcacagctcagaagagctccacctcgtgtgggttctggactccagggtgcaaaaggagttgaaaactctcaacgtccctcctattgggattggtaaaatgatttatgggtgacacccacgcaatagtatattttacacctatcaaaaagaatgaggccgggcgtggttggcacatgcctgtaatcccagcactttgggaggccaaggcaggaggatcacttgagcccagaaattcaagaccagcctaggcaacatgstgtaaaccccctctctaccaaaaatacaaaaattaaccaggcatgatggcacaggcctgtagtcccagctacgggaggctgaggcagcagaatcgcctgaacccaggaggcggaggttgcagtgagccgagattgtgccactgcactccagcctgggcggcagagcaagacgctgtctctccccaaccaaaaaaaaaaaaaaaaaagaatgacaggccaggcacagtggctcacgcctgtaatcccagcactttgggaggctgaggcgggcagatcacgaagtcacgagtttgagatcag

SEQ ID NO: 178597 - DNA, 601 bp, Human
cagcttgggtgacagagtgagactctgcctcaaaaaaataaaaataaaaaaataaggtcagtccttgcagcacagctcagaagagctccacctcgtgtgggttctggactccagggtgcaaaaggagttgaaaactctcaacgtccctcctattgggattggtaaaatgatttatgggtgacacccacgcaatagtatattttacacctatcaaaaagaatgaggccgggcgtggttggcacatgcctgtaatcccagcactttgggaggccaaggcaggaggatcacttgagcccagaarttcaagaccagcctaggcaacatgctgtaaaccccctctctaccaaaaatacaaaaattaaccaggcatgatggcacaggcctgtagtcccagctacgggaggctgaggcagcagaatcgcctgaacccaggaggcggaggttgcagtgagccgagattgtgccactgcactccagcctgggcggcagagcaagacgctgtctctccccaaccaaaaaaaaaaaaaaaaaagaatgacaggccaggcacagtggctcacgcctgtaatcccagcactttgggaggctgaggcgggcagat

SEQ ID NO: 178598 - DNA, 601 bp, Human
ggagaatcgcttgaacccgggaggcggaggctgcagtagtgagccgagatcgcaccactgcactccagcttgggtgacagagtgagactctgcctcaaaaaaataaaaataaaaaaataaggtcagtccttgcagcacagctcagaagagctccacctcgtgtgggttctggactccagggtgcaaaaggagttgaaaactctcaacgtccctcctattgggattggtaaaatgatttatgggtgacacccacgcaatagtatattttacacctatcaaaaagaatgaggccgggcgtggwtggcacatgcctgtaatcccagcactttgggaggccaaggcaggaggatcacttgagcccagaaattcaagaccagcctaggcaacatgctgtaaaccccctctctaccaaaaatacaaaaattaaccaggcatgatggcacaggcctgtagtcccagctacgggaggctgaggcagcagaatcgcctgaacccaggaggcggaggttgcagtgagccgagattgtgccactgcactccagcctgggcggcagagcaagacgctgtctctccccaaccaaaaaaaaaaaaaaaaaagaat

SEQ ID NO: 178599 - DNA, 601 bp, Human
ccccgtctctactaaaaatacaaaaattagccagacgtggtggcacatgtctgtaattccagctacttgggaggctgaggcaggagaatcgcttgaacccgggaggcggaggctgcagtagtgagccgagatcgcaccactgcactccagcttgggtgacagagtgagactctgcctcaaaaaaataaaaataaaaaaataaggtcagtccttgcagcacagctcagaagagctccacctcgtgtgggttctggactccagggtgcaaaaggagttgaaaactctcaacgtccctcctatkgggattggtaaaatgatttatgggtgacacccacgcaatagtatattttacacctatcaaaaagaatgaggccgggcgtggttggcacatgcctgtaatcccagcactttgggaggccaaggcaggaggatcacttgagcccagaaattcaagaccagcctaggcaacatgctgtaaaccccctctctaccaaaaatacaaaaattaaccaggcatgatggcacaggcctgtagtcccagctacgggaggctgaggcagcagaatcgcctgaacccaggaggcggaggttgcagtgagcc

SEQ ID NO: 178600 - DNA, 601 bp, Human
ccgaggtgggtggattgcctgaactcaggagttcgagaccagcctgggcaacacggtgaaaccccatctctactaaaatagaaaaaatcagccgggtgtggtggcgggcgcctgtaatcccagctactggagaagctgaggcaggagaatcacttgaacccaggaggtggaggctgcagccagccaagaccatgccactgcactccagcctgggcagcagagcaagacactgtctcccaaagaaagaacaacaggccgggcgcggttgctcacacctgtaatcccagcactgggggaggcygaggcaggtggatccacctgaggtcaggagtttgagaccggcctggccaacatggtgaaaccccgtctctactaaaaatacaaaaattagccagacgtggtggcacatgtctgtaattccagctacttgggaggctgaggcaggagaatcgcttgaacccgggaggcggaggctgcagtagtgagccgagatcgcaccactgcactccagcttgggtgacagagtgagactctgcctcaaaaaaataaaaataaaaaaataaggtcagtccttgcagcacagctcagaagagctccacct

SEQ ID NO: 178601 - DNA, 601 bp, Human
taaaacgagttttaatgttctagctatttttcctacaaagtacgaagcatttaaagacaaaaataaggtcagtcagccgagcgcagtggctcacgcctgtaatcctaacactttgggaggccgaggtgggtggattgcctgaactcaggagttcgagaccagcctgggcaacacggtgaaaccccatctctactaaaatagaaaaaatcagccgggtgtggtggcgggcgcctgtaatcccagctactggagaagctgaggcaggagaatcacttgaacccaggaggtggaggctgcagcsagccaagaccatgccactgcactccagcctgggcagcagagcaagacactgtctcccaaagaaagaacaacaggccgggcgcggttgctcacacctgtaatcccagcactgggggaggccgaggcaggtggatccacctgaggtcaggagtttgagaccggcctggccaacatggtgaaaccccgtctctactaaaaatacaaaaattagccagacgtggtggcacatgtctgtaattccagctacttgggaggctgaggcaggagaatcgcttgaacccgggaggcggaggctgcagta

SEQ ID NO: 178602 - DNA, 601 bp, Human
gcagctggtcacctcctctcgagatggagatggtctcccttccgaccagcactgaccagggcagatggggtgggggcggggggaggagaatgcaaacccagccacggggccaacagttagcaggaaaacacagggcggcaacagcggggtctccacacagccccggcccttctaccgcagccgcaccaggagggcctcagggcagagctctgacagaagctgctggtgcccacgcacaggctcaagaccaccgcgcctcacccccgaggttccccacccgctatgggcagtggtgtcggtsagtgactcttcagctggtagagctgcaccaagcgggggtctggtagatgccaagatggtttctcactaatctgttcttcccttctggcgaaaagaatctgagaatgttttaaaatattccctgtgttcccaccaacattctcaatcctaagaaatctccctctgcctcctacgagggaagcaaagttaacacttctaaggagacctttaaaacagaggaagtacaaattgtcataagcttttaggttacctattaaaacgagttttaatgttctagctatttttcctacaaagtacgaag

SEQ ID NO: 178603 - DNA, 601 bp, Human
tttgagaccagcctggacaacatggcgagaccctgtgtctactaaaaatacaaaaaactagccaggcatggtggcaggcacctgtggtcccagctactcagggggctgaggtgggaggatctcttgagcacaggtcgaggctacagtgagccaagactgtgctactgccctccagcctgggtgacagcgacatcacgtctcaaaaaagatgcttcagaacacctcctggtaaccttagcacactgcccgactgacaaggctgagaaggcaaggtgagcagaccccggcgggtgtgcgcgtrtggaagagggaagagaagccagcgtccgggatgagccacacatccgccttcccgcaccggcctggagaggacgacagggacggagcttccttttcattcacatggtttacatttcacattatggaggtaacagcaatgcaggagacacagaaaagaaaccgccacagctgcaccctcacagcaagcacggggaggaggggcacagggaccagcagcaggggaggccacccaagcccctgcaggcaggcagctggtcacctcctctcgagatggagatggtctcccttccgaccagcactg

SEQ ID NO: 178604 - DNA, 601 bp, Human
gatcacttgagccctggagtttgagaccagcctggacaacatggcgagaccctgtgtctactaaaaatacaaaaaactagccaggcatggtggcaggcacctgtggtcccagctactcagggggctgaggtgggaggatctcttgagcacaggtcgaggctacagtgagccaagactgtgctactgccctccagcctgggtgacagcgacatcacgtctcaaaaaagatgcttcagaacacctcctggtaaccttagcacactgcccgactgacaaggctgagaaggcaaggtgagcagascccggcgggtgtgcgcgtatggaagagggaagagaagccagcgtccgggatgagccacacatccgccttcccgcaccggcctggagaggacgacagggacggagcttccttttcattcacatggtttacatttcacattatggaggtaacagcaatgcaggagacacagaaaagaaaccgccacagctgcaccctcacagcaagcacggggaggaggggcacagggaccagcagcaggggaggccacccaagcccctgcaggcaggcagctggtcacctcctctcgagatggagatggtc

SEQ ID NO: 178605 - DNA, 601 bp, Human
ctcacgtctgtgataccagcactttgggaggctaaggcagatggatcacttgagccctggagtttgagaccagcctggacaacatggcgagaccctgtgtctactaaaaatacaaaaaactagccaggcatggtggcaggcacctgtggtcccagctactcagggggctgaggtgggaggatctcttgagcacaggtcgaggctacagtgagccaagactgtgctactgccctccagcctgggtgacagcgacatcacgtctcaaaaaagatgcttcagaacacctcctggtaaccttagsacactgcccgactgacaaggctgagaaggcaaggtgagcagaccccggcgggtgtgcgcgtatggaagagggaagagaagccagcgtccgggatgagccacacatccgccttcccgcaccggcctggagaggacgacagggacggagcttccttttcattcacatggtttacatttcacattatggaggtaacagcaatgcaggagacacagaaaagaaaccgccacagctgcaccctcacagcaagcacggggaggaggggcacagggaccagcagcaggggaggccacccaagcccct

SEQ ID NO: 178606 - DNA, 601 bp, Human
acttctcctgcaagagaaacgcgccactttatcacgggaacttcacaggatggcagaccaggcacggaggctcacgtctgtgataccagcactttgggaggctaaggcagatggatcacttgagccctggagtttgagaccagcctggacaacatggcgagaccctgtgtctactaaaaatacaaaaaactagccaggcatggtggcaggcacctgtggtcccagctactcagggggctgaggtgggaggatctcttgagcacaggtcgaggctacagtgagccaagactgtgctactgcyctccagcctgggtgacagcgacatcacgtctcaaaaaagatgcttcagaacacctcctggtaaccttagcacactgcccgactgacaaggctgagaaggcaaggtgagcagaccccggcgggtgtgcgcgtatggaagagggaagagaagccagcgtccgggatgagccacacatccgccttcccgcaccggcctggagaggacgacagggacggagcttccttttcattcacatggtttacatttcacattatggaggtaacagcaatgcaggagacacagaaaagaaaccgccacagc

SEQ ID NO: 178607 - DNA, 601 bp, Human
aaactcctctgccagggtggatggcactgtgggctccccgatgctgtacttctcctgcaagagaaacgcgccactttatcacgggaacttcacaggatggcagaccaggcacggaggctcacgtctgtgataccagcactttgggaggctaaggcagatggatcacttgagccctggagtttgagaccagcctggacaacatggcgagaccctgtgtctactaaaaatacaaaaaactagccaggcatggtggcaggcacctgtggtcccagctactcagggggctgaggtgggaggatckcttgagcacaggtcgaggctacagtgagccaagactgtgctactgccctccagcctgggtgacagcgacatcacgtctcaaaaaagatgcttcagaacacctcctggtaaccttagcacactgcccgactgacaaggctgagaaggcaaggtgagcagaccccggcgggtgtgcgcgtatggaagagggaagagaagccagcgtccgggatgagccacacatccgccttcccgcaccggcctggagaggacgacagggacggagcttccttttcattcacatggtttacatttcacatta

SEQ ID NO: 178608 - DNA, 601 bp, Human
gaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctmgatgtgcgcttccagcaaatcagcagcgtccgcgaccgccggcgcgcggtgttgctggacctgggcttctcaggtgggcggggccggggcggtgagcgcggagagccttccgggtgggcggggagggggcggggcctgggcggggaacaccgctggagtttccagctgggcgtggccgtgacgaggggcggggactgaggcagggagtgtcaatgggcctcccgggtgggcggggagggggcggagcctggacggggagcgccgcgggactttctaggtaggcggggcccgggtctgggc

SEQ ID NO: 178609 - DNA, 601 bp, Human
acctgggaagcagaggctacattgagctgagattggccattgcactccagcctgggtgacagaacaagactctgtcaccaaaaaaaaaaaaaaaattaaaaattaaccaggtgtgggctgggcgtggtggctcatgcctataattcgagcactttgagaggccaaggtgggcagatcacctgaggtcaggagtttaagaccagcctggccaccatggtgaaaccccgtatctactaaaaatacaaaaattagctgggcgtggtgatgcgtgcctgcaatcccagctacttgggaggccaaracaggagaattgcttgaaccaggaggcagaggttgcagtgagctgagatcgcgccactgcacaccagcctgcacgacagagcaagactccatctcagaaaaaaaaaaaaaaaggatgaggattcatcaagctattattgtgtgccaggcccaggtgcacgtgacacgcagctgtcctcacagccctgctaccaccgccactctgcagaggaggaggcaggctctgagcggctaagaagcaaggccacagtcctagccagtgggagacacagccgcacagactggggcctcaggctctgcc

SEQ ID NO: 178610 - DNA, 601 bp, Human
agctacttgggaggctgaggcaggagaactgcttgaacctggggggcggaggttgcagtgagctgagatcacaacactccactacagcctgggtgacagagcaagacccgatctcaaaacaaacaacaaaacctcctaattgacttccgtttactgtcataataaactccaaactctatcctggcatcaaagctcctgccaccctggctggcatcaccacctgcctgctcccagctgcaccagttcctcctgccatagtctggactacccctggggtccctgggtgcctatgggaatccarctctggccaattctgcagaagtcccagcgggactagcgcagaggccctgtccgtgtccctcactgctcactgcagtgcttggcccccagcaggtcctcaacggctgcaggataaatataataagtgccatgccctttcctgttttccctcagaggcaccctcccccgagctgggggagcaggcttctggctgcgtgtgtccttggcacccagcctctccgaggacagcaagttcactgcaggagggcggggatgggacccacagagcctggagtggagagtcccggacagagtggtggga

SEQ ID NO: 178611 - DNA, 601 bp, Human
taaaaatacaaaagttagccgggtgtggtggcaggggcctatagtctcagctacttgggaggctgaggcaggagaactgcttgaacctggggggcggaggttgcagtgagctgagatcacaacactccactacagcctgggtgacagagcaagacccgatctcaaaacaaacaacaaaacctcctaattgacttccgtttactgtcataataaactccaaactctatcctggcatcaaagctcctgccaccctggctggcatcaccacctgcctgctcccagctgcaccagttcctcctgmcatagtctggactacccctggggtccctgggtgcctatgggaatccaactctggccaattctgcagaagtcccagcgggactagcgcagaggccctgtccgtgtccctcactgctcactgcagtgcttggcccccagcaggtcctcaacggctgcaggataaatataataagtgccatgccctttcctgttttccctcagaggcaccctcccccgagctgggggagcaggcttctggctgcgtgtgtccttggcacccagcctctccgaggacagcaagttcactgcaggagggcgggga

SEQ ID NO: 178612 - DNA, 601 bp, Human
ttgctaagatggggggtcatctgggcagatggggcccctgcctacctttgggggggcactggagtcatagcagtgctcagtccccagatggtccacaggtgcatcctttttgttcctcatggcacggatgttgaccagctgttgctgccagtcctggggctcccagactggcaccttgaggggctcagccccctcacctttctcactgtccgagccctcataggccacacgcagtctctgtgctttccgcggacgcttcacggggctgtggcttttcctcgcttctgcaaaaagcaccacrcagtccctctggtggggccacaggtgaaggtagggtaggggtgccatcccgcctgctagctcacccctcactcgttcatgccacaactgtccatcatctaatacacttggggtgctctgccctctgcagtctggggtatgtgggccctccttatgccagcgaccctgacaaggtccatgttagctcatgaggactctagcaacagcctgtaccaaggtgcccccaatacatcttctatactgcaccagagacagtctgctaacacccacatcaggttgtgtcactcccttttaaaaaatc

SEQ ID NO: 178613 - DNA, 601 bp, Human
cctcctgcccacctggacagtgaatgacgaggactgcctcacccactttgtggccagagcttagagaagccaagggcctggcccagagtcacccagccaggaggtgcagagctgggaccggagccagcaatctatggctgtggcatttttttttttttttaaacggagtcttgctctgtcacccaggctggatacagacaatggtgcgatctccactcactgcaactttcgcctctgggtttcaagcgattctcctgcctcagcctcccgaggagctggaattacaggctcctgccaccaygcccggctaatttttttttttttggtgagacggagtcacgctttgtcgcccaggctggagtacactggcgcgatctcagctcactgcaagccccacctcccaggttcacactattctcctgcctcagcctcccgagtagctgggacaacaggcgcctgacacaatgcctggctaattttttgtgttttttagtagagacggggtttcaccatcttagcctggatggtcttgatctcctgacctcgtgatctgcctgcctcggcctcccaaagtgctgggattacaggcgtgagccaccac

SEQ ID NO: 178614 - DNA, 601 bp, Human
cctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcagrataaacaggccctgcctgggacccacacgcctctgtcttttctgagcctcctccccgtggggtgagaggggtggagggatgaggctgtttcagggagccccctccccgagtctcagcagctggaaacggtctcgttcctgagcccgtgccctgcatccatctgctcccagccctgctccatctcccccgctgacccccatgggaccccctgctgtgtggcacatcctgggcccatgcccatctctcttatttggcagactcagcctcccaccttcaccttccctgtgaagccatccggcc

SEQ ID NO: 178615 - DNA, 601 bp, Human; identical to SEQ ID NO: 115240

SEQ ID NO: 178616 - DNA, 601 bp, Human; identical to SEQ ID NO: 115241

SEQ ID NO: 178617 - DNA, 601 bp, Human; identical to SEQ ID NO: 115242

SEQ ID NO: 178618 - DNA, 601 bp, Human
cccggcgcccctcagcgccccacattccgcggggtctggcgagctccgcctcgcccacgcagccctcccggccaccgagcccggcgcggcctccgaagactccagaccccaggcgcccccgccagcccggccccgccgaggagccccggggcgcgttcccgagtccaccgcgcctcggtcgcctccaggaccgagacacgcggcgccgccagaaggctcacgagggcgcgggctgcggggcgcacgagggctcagtttccccgcctgcgccctgcccggcctcacctggcgcgcagccccrggcccagccccgttcagcagcggcgtccccccgccgggccgcgccgtcctccgcagcagcggcgccgcctcctcgtcgtcccggtcccggccggaccaggacaccttcttagagacgttggccatggcccgccgcggagcgacaccggccgggaagcgccggctgcccccgtgtttgttctcgtgacccgcgccggcggccacgtgacgcgcgacggggccacgtgatgagcgacggcgaccatgtgacctgcaacggcaaccaccgaggcccggtcgcgcgggggctcctgggagccgc

SEQ ID NO: 178619 - DNA, 601 bp, Human
gaatgaacgtgcgccacggctgccccggcgcccctcagcgccccacattccgcggggtctggcgagctccgcctcgcccacgcagccctcccggccaccgagcccggcgcggcctccgaagactccagaccccaggcgcccccgccagcccggccccgccgaggagccccggggcgcgttcccgagtccaccgcgcctcggtcgcctccaggaccgagacacgcggcgccgccagaaggctcacgagggcgcgggctgcggggcgcacgagggctcagtttccccgcctgcgccctgcccsgcctcacctggcgcgcagccccaggcccagccccgttcagcagcggcgtccccccgccgggccgcgccgtcctccgcagcagcggcgccgcctcctcgtcgtcccggtcccggccggaccaggacaccttcttagagacgttggccatggcccgccgcggagcgacaccggccgggaagcgccggctgcccccgtgtttgttctcgtgacccgcgccggcggccacgtgacgcgcgacggggccacgtgatgagcgacggcgaccatgtgacctgcaacggcaaccaccgaggcccggtc

SEQ ID NO: 178620 - DNA, 601 bp, Human
tgaaagtcgggactgatccccacacagaaagatggcagataaaggcgctcagtcattctcactgaaagacagtgacccggctgcaatcttaactgtttccatctcccagggggtcaaaaacgcaaacaaaattagttgctcgtgtaggatgacaatttttaaaagtcacctgaacagaaagccacttgcacccctttagggccagtctgggggacaccggagggaatgaacgtgcgccacggctgccccggcgcccctcagcgccccacattccgcggggtctggcgagctccgcctcgcycacgcagccctcccggccaccgagcccggcgcggcctccgaagactccagaccccaggcgcccccgccagcccggccccgccgaggagccccggggcgcgttcccgagtccaccgcgcctcggtcgcctccaggaccgagacacgcggcgccgccagaaggctcacgagggcgcgggctgcggggcgcacgagggctcagtttccccgcctgcgccctgcccggcctcacctggcgcgcagccccaggcccagccccgttcagcagcggcgtccccccgccgggccgcgccgtcctccgc

SEQ ID NO: 178621 - DNA, 601 bp, Human
tgtaattccagctactcaggaggctgaggcaggagagtcacttaaactcgggaggtgggggttgcagtgagccgagatcgcgccattgcactccagcctgggcaactacagtgaaactccgtctcaaaaaaaaaaaaatattaagacaatacacagacagggaaacaaatgtacccgcaacggttctccagaccttaacactgctcagacgcacgctgcagggtgacatgcggaacgcattccaacctctgacttgctgcttattgtgtttgcctgcacattgcaaattcaactcggtgckaagggagactgagtacaaatactcgtcactcccaagatcacctgaaagtcgggactgatccccacacagaaagatggcagataaaggcgctcagtcattctcactgaaagacagtgacccggctgcaatcttaactgtttccatctcccagggggtcaaaaacgcaaacaaaattagttgctcgtgtaggatgacaatttttaaaagtcacctgaacagaaagccacttgcacccctttagggccagtctgggggacaccggagggaatgaacgtgcgccacggctgccccggcgcccct

SEQ ID NO: 178622 - DNA, 601 bp, Human
tgggaggctgaggtgcgggggatcacgtgaggtcgggagttcgaggccagcctgaccaacacggaggaaccccgtctctactaaaaatacaaaattagccgggcgcggtggcgcacgcctgtaattccagctactcaggaggctgaggcaggagagtcacttaaactcgggaggtgggggttgcagtgagccgagatcgcgccattgcactccagcctgggcaactacagtgaaactccgtctcaaaaaaaaaaaaatattaagacaatacacagacagggaaacaaatgtacccgcaacrgttctccagaccttaacactgctcagacgcacgctgcagggtgacatgcggaacgcattccaacctctgacttgctgcttattgtgtttgcctgcacattgcaaattcaactcggtgcgaagggagactgagtacaaatactcgtcactcccaagatcacctgaaagtcgggactgatccccacacagaaagatggcagataaaggcgctcagtcattctcactgaaagacagtgacccggctgcaatcttaactgtttccatctcccagggggtcaaaaacgcaaacaaaattagttgc

SEQ ID NO: 178623 - DNA, 601 bp, Human
aaaaaaaaaaaagcacctcactgcagcttcaacctcctgggctcatgcgactcttctgcctcagcctcccgagccagtagctgggactacagatgcatatcaccacacctggctaattttgtttttttttttttgagacagggtttcactattttgcccaggctggtcttgaacttctgggctcaagtgatcctcccctaccttggcctcccaaagtgctaggattacaggcatgagccaccacacctggcctttcttttaaaacagaaacacacacacacacacacagaggcatacacayacacacacaggcatacacacaaataactaatcacccatggccccatcacttcaaattaaccccttcagatcacttttcatgcagactacagcacggagagcaggagggcccacttcaaagggagctgagctgctgcttcttatcagcaaaaggcagactatgaccttctttgtctggtgcgtttctaaggaattgggaaaacctaaatgtaggttctatggaaacaggctgattttcgtgtccttcctaaacttttttttttttttttttttttttgagacggagtctcgctctgcccag

SEQ ID NO: 178624 - DNA, 601 bp, Human
tctcaaactccagcctgggcaaaagagtgacaaactacctcggaaaaaaaaaaaaaaaagcacctcactgcagcttcaacctcctgggctcatgcgactcttctgcctcagcctcccgagccagtagctgggactacagatgcatatcaccacacctggctaattttgtttttttttttttgagacagggtttcactattttgcccaggctggtcttgaacttctgggctcaagtgatcctcccctaccttggcctcccaaagtgctaggattacaggcatgagccaccacacctggcctatcttttaaaacagaaacacacacacacacacacagaggcatacacatacacacacaggcatacacacaaataactaatcacccatggccccatcacttcaaattaaccccttcagatcacttttcatgcagactacagcacggagagcaggagggcccacttcaaagggagctgagctgctgcttcttatcagcaaaaggcagactatgaccttctttgtctggtgcgtttctaaggaattgggaaaacctaaatgtaggttctatggaaacaggctgattttcgtgtccttcctaaact

SEQ ID NO: 178625 - DNA, 601 bp, Human
ggtggcaacgacaccaccagccaacctgaaaatcctgcaacaaaccctaaagagcctggaggcagctaggaccagttctcatgttcactggaacagtcccgtcagcaggggatggcctgggttgatattttagctcaaaacagctctggaggccttgaacccaagggcagcttacagtaccccgtctgtggccacactggggtgcgcctgagcctaactgtgagctgtgcccaccagtcagagcagaccctcccccagaaaagcagcaccaagaaatccagtagctactcaggaagttggrcaggaaagtcacaacgaacacgaatccctcttgtgttgctggttttaacacgaccgggcacgactcacgtttcttcagagcgtagtttgtgacaggcaccgtgctcagcgctatgcatgcgttaactttttcgcagacgggaaaactgggcaacagggaggctacaggccttgcaggaggccatcggcgagtccgatgctcagagcacaaacgcctggcctaagaggtggtgtcttggcctctagactccgcctctccagtctgtctgcaggggaaggctggggcccttcaggaatgggg

SEQ ID NO: 178626 - DNA, 578 bp, Human
caggcagctctgaagggcctgggctttcagcgggcacccagcctccaacaagccactccacagtctgccctgcccagggcagccacctcatagtgtttggccagctgtgcccacgctgaggtggcaacgacaccaccagccaacctgaaaatcctgcaacaaaccctaaagagcctggaggcagctaggaccagttctcatgttcactggaacagtcccgtcagcaggggatggcctgggttgatattttagctcaaaacagctctggaggccttgamcccaagggcagcttacagtaccccgtctgtggccacactggggtgcgcctgagcctaactgtgagctgtgcccaccagtcagagcagaccctcccccagaaaagcagcaccaagaaatccagtagctactcaggaagttggacaggaaagtcacaacgaacacgaatccctcttgtgttgctggttttaacacgaccgggcacgactcacgtttcttcagagcgtagtttgtgacaggcaccgtgctcagcgctatgcatgcgttaactttttcgcagacgggaaaactgggcaacaggg

SEQ ID NO: 178627 - DNA, 601 bp, Human
cacaccactgcccttcagcctgggcgacagagggagactccgtcaaaaacaaaaacaaaaataaacaaaaaaccaaaaaccaaaaacaaacataaaaaagcagcgtctgaaagtcccacttgcacgccatgttcacagcagcaccgttcacaatgaccaaaatgcggaagcacctgctgtgccgatggatgagtgagtcaaggaaatgcagcctctccccgcaatggaataattcagccataaagaggaatgaccaccgacccgtgctgcagcacgacgggccggaggacactgtgccccrtgaaataagccagtcagaaaaagacagctcccgcaggtccactcgcaagagggccctggagccgtcaggtcccctgaggcagatggcaacgagggggctgggcagcaggaggaagggagagcgttgaatgggtgcagtttcagtttggcaaggaatgggttgtgtaacactaagagcgtgctcaaccctactgtctgcactcacggatgattaaacggtcattaaacaaaatgttttttagaaacaaggtcttgctatgttgcccaggctggtctctaagtcctgggctcaaatgatcct

SEQ ID NO: 178628 - DNA, 601 bp, Human
gcgaaaccccaactctcctaaaaatacaaaaattagccgggcatggtggtgggcgcctgtaatcccagctactcaggaggctgaggcaggagaatcacttgaacccaataggcagaggttgtggtaagctgagatcacaccactgcccttcagcctgggcgacagagggagactccgtcaaaaacaaaaacaaaaataaacaaaaaaccaaaaaccaaaaacaaacataaaaaagcagcgtctgaaagtcccacttgcacgccatgttcacagcagcaccgttcacaatgaccaaaatgcrgaagcacctgctgtgccgatggatgagtgagtcaaggaaatgcagcctctccccgcaatggaataattcagccataaagaggaatgaccaccgacccgtgctgcagcacgacgggccggaggacactgtgccccgtgaaataagccagtcagaaaaagacagctcccgcaggtccactcgcaagagggccctggagccgtcaggtcccctgaggcagatggcaacgagggggctgggcagcaggaggaagggagagcgttgaatgggtgcagtttcagtttggcaaggaatgggttgtgt

SEQ ID NO: 178629 - DNA, 601 bp, Human
agatcctgccactgtattccagcctgggcaacagagcaagaccctgtctcaaataaataaataaaataaaacaaaataaaagtcaaaataatgtatagaggggaactacatcaaactttaaaacttctacacatcaaagaaaacaacagagcaaaaggtaacctatgaaacgagaaaatatttgcaaatgtgataaggaattaatatctgataagggattaatattcagaatacataaaaaaactcagggtcaggggaggtggctcacgtctgtcatcccagcactttgggaggctgaggygggctgatcacttgaggtcaggagttcaagaccagcctgaccaatgtggcgaaaccccaactctcctaaaaatacaaaaattagccgggcatggtggtgggcgcctgtaatcccagctactcaggaggctgaggcaggagaatcacttgaacccaataggcagaggttgtggtaagctgagatcacaccactgcccttcagcctgggcgacagagggagactccgtcaaaaacaaaaacaaaaataaacaaaaaaccaaaaaccaaaaacaaacataaaaaagcagcgtctgaaagtccc

SEQ ID NO: 178630 - DNA, 601 bp, Human
ggaaactcggtgaagggtacacaagccccctgtgctacctttgcagcttcctgtgaatccagagtgatttaaaagtcaaaaaagggctgggcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagctactcgggaggctaaggcaggagaactgcttraacccgggaggtggaggttgcagtgagccgagatcctgccactgtattccagcctgggcaacagagcaagaccctgtctcaaataaataaataaaataaaacaaaataaaagtcaaaataatgtatagaggggaactacatcaaactttaaaacttctacacatcaaagaaaacaacagagcaaaaggtaacctatgaaacgagaaaatatttgcaaatgtgataaggaattaatatctgataagggattaatattcagaatacataaaaaaactcagggtcaggggaggtggctcacgt

SEQ ID NO: 178631 - DNA, 601 bp, Human
agaggcgagactcgggccggacgggaggcgaggtcatcagggttgggagtgggtgggactagaaagatgggtctgaaaatagcctgcacccccttcctggtgcttacgcggatctacacgcattgcagcgacactctcttggttttggggctgcgctgttacggaaaggtaaacattggggggaaactcggtgaagggtacacaagccccctgtgctacctttgcagcttcctgtgaatccagagtgatttaaaagtcaaaaaagggctgggcacagtggctcacgcctgtaatcccagcrctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagctactcgggaggctaaggcaggagaactgcttgaacccgggaggtggaggttgcagtgagccgagatcctgccactgtattccagcctgggcaacagagcaagaccctgtctcaaataaataaataaaataaaacaaaataaaagtcaaaat

SEQ ID NO: 178632 - DNA, 601 bp, Human
gctcaggaacacgtgagccaacactcccgagaggcgagactcgggccggacgggaggcgaggtcatcagggttgggagtgggtgggactagaaagatgggtctgaaaatagcctgcacccccttcctggtgcttacgcggatctacacgcattgcagcgacactctcttggttttggggctgcgctgttacggaaaggtaaacattggggggaaactcggtgaagggtacacaagccccctgtgctacctttgcagcttcctgtgaatccagagtgatttaaaagtcaaaaaagggctggrcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagctactcgggaggctaaggcaggagaactgcttgaacccgggaggtggaggttgcagtgagccgagatcctgccactgtattccagcctgggcaacagagcaagaccctgtctcaaataaataa

SEQ ID NO: 178633 - DNA, 601 bp, Human
ttaaatgcaagctcttataaattaaacactagatgctgttcctcaaactcctgccacacacggcaacctacacggtcccaagcgccggacactaactaaaaacagacaggctcaggaacacgtgagccaacactcccgagaggcgagactcgggccggacgggaggcgaggtcatcagggttgggagtgggtgggactagaaagatgggtctgaaaatagcctgcacccccttcctggtgcttacgcggatctacacgcattgcagcgacactctcttggttttggggctgcgctgttacrgaaaggtaaacattggggggaaactcggtgaagggtacacaagccccctgtgctacctttgcagcttcctgtgaatccagagtgatttaaaagtcaaaaaagggctgggcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagctactcgggaggct

SEQ ID NO: 178634 - DNA, 601 bp, Human
tactttcttttttaaatgcaagctcttataaattaaacactagatgctgttcctcaaactcctgccacacacggcaacctacacggtcccaagcgccggacactaactaaaaacagacaggctcaggaacacgtgagccaacactcccgagaggcgagactcgggccggacgggaggcgaggtcatcagggttgggagtgggtgggactagaaagatgggtctgaaaatagcctgcacccccttcctggtgcttacgcggatctacacgcattgcagcgacactctcttggttttggggcygcgctgttacggaaaggtaaacattggggggaaactcggtgaagggtacacaagccccctgtgctacctttgcagcttcctgtgaatccagagtgatttaaaagtcaaaaaagggctgggcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagcta

SEQ ID NO: 178635 - DNA, 601 bp, Human
gttcagcaatgcattccgtgcggttactttcttttttaaatgcaagctcttataaattaaacactagatgctgttcctcaaactcctgccacacacggcaacctacacggtcccaagcgccggacactaactaaaaacagacaggctcaggaacacgtgagccaacactcccgagaggcgagactcgggccggacgggaggcgaggtcatcagggttgggagtgggtgggactagaaagatgggtctgaaaatagcctgcacccccttcctggtgcttacgcggatctacacgcattgcascgacactctcttggttttggggctgcgctgttacggaaaggtaaacattggggggaaactcggtgaagggtacacaagccccctgtgctacctttgcagcttcctgtgaatccagagtgatttaaaagtcaaaaaagggctgggcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggt

SEQ ID NO: 178636 - DNA, 601 bp, Human
ccagcgctgggcctctgacccccacctcccaggtggacaggtgccccgatgccccaaacagagaccacggaacccaaaagacccatttcaccatgaggaaggaccccacgtccaaacaggcaccctgtgggacacaccctgcccagagggccaccctctccatcactcaagatgtcggcacttctctctaacgccactcaaggcctgccgtgcttctcaggctattccttgctggaaataacggatcattctggccggacgtggtggctcacgcctgtaatcccagcactttgggaggctsaggcaggaggatcgcttgagcccaggagttcaaagccaacctggacaacgtagtgagaccctgtctctacaaaaaatcaaaatcagcaaggcatggtggcgtgtacctgtggcccaaactactcaggaggctgaggcaagaggatcgcttgagcctgggaagtcgaggctacagtgagctatggttgcaccactgcgctccagcctgggcaacacggcaagaccctatctctaaaattaaaaaaaaaaacccaaacaaaacgaaaacagccacagtcacatgtcctgggcgccaggcctg

SEQ ID NO: 178637 - DNA, 601 bp, Human
atccccatcaaaagccaggagcagaggccagacagacagacagacagactcgcaggtgtctgccgtggcatctccacgcccaggggagagtgtgggaggggctagagtgcacaggtcctgctggacacaaccctgagtcacagggcgcctgcccctcctcttcccccagccttgccacatgccagtggctctccctgagccctcagtcacaggcgaaactcacagcttgagtctcctgccacacgggctgacggtgggaggaggaaggtgccacggtccaggcatgatggaagcagtggcmtggccagctgcccactccctcttgctcacactcacatcaaagcccctggactccaggtctcaccaccagaaaacagccctgggaccagcgctgggcctctgacccccacctcccaggtggacaggtgccccgatgccccaaacagagaccacggaacccaaaagacccatttcaccatgaggaaggaccccacgtccaaacaggcaccctgtgggacacaccctgcccagagggccaccctctccatcactcaagatgtcggcacttctctctaacgccactcaaggcctgccgtgcttc

SEQ ID NO: 178638 - DNA, 601 bp, Human
aaaaaaaaaaaaaaaaaaaaaaaaaaaaaagaacctgaccttccagcccactgccctccagggaccccttccccaaccatcgtcctgttaccagccaccgtcgcccttgctgtacaccccccgtgttgatgacccggtaagtggccctggcaggggaaggaacctgggcacgtgccactggcccttggcagacaccagtcagagcctcctcctctccccaggcaaagagcactctcaggccatccccatcaaaagccaggagcagaggccagacagacagacagacagactcgcaggtgtytgccgtggcatctccacgcccaggggagagtgtgggaggggctagagtgcacaggtcctgctggacacaaccctgagtcacagggcgcctgcccctcctcttcccccagccttgccacatgccagtggctctccctgagccctcagtcacaggcgaaactcacagcttgagtctcctgccacacgggctgacggtgggaggaggaaggtgccacggtccaggcatgatggaagcagtggcctggccagctgcccactccctcttgctcacactcacatcaaagcccctggactccaggtc

SEQ ID NO: 178639 - DNA, 601 bp, Human
ctaaaaatacaaaaagtaggcgggctacttgggaggctaaggcgggagaatcgcttgaagccgggaggtggagtctgcagtgagctgagatcgcaccactgcactccagcctaggtaacagcaagactctgtctcaaaaaaaaaaaaaaaaaaaaaaaaaaaaaaagaacctgaccttccagcccactgccctccagggaccccttccccaaccatcgtcctgttaccagccaccgtcgcccttgctgtacaccccccgtgttgatgacccggtaagtggccctggcaggggaaggaaccygggcacgtgccactggcccttggcagacaccagtcagagcctcctcctctccccaggcaaagagcactctcaggccatccccatcaaaagccaggagcagaggccagacagacagacagacagactcgcaggtgtctgccgtggcatctccacgcccaggggagagtgtgggaggggctagagtgcacaggtcctgctggacacaaccctgagtcacagggcgcctgcccctcctcttcccccagccttgccacatgccagtggctctccctgagccctcagtcacaggcgaaactcaca

SEQ ID NO: 178640 - DNA, 601 bp, Human
aaccccatctctactaaaaatacaaaaagtaggcgggctacttgggaggctaaggcgggagaatcgcttgaagccgggaggtggagtctgcagtgagctgagatcgcaccactgcactccagcctaggtaacagcaagactctgtctcaaaaaaaaaaaaaaaaaaaaaaaaaaaaaaagaacctgaccttccagcccactgccctccagggaccccttccccaaccatcgtcctgttaccagccaccgtcgcccttgctgtacaccccccgtgttgatgacccggtaagtggccctggcmggggaaggaacctgggcacgtgccactggcccttggcagacaccagtcagagcctcctcctctccccaggcaaagagcactctcaggccatccccatcaaaagccaggagcagaggccagacagacagacagacagactcgcaggtgtctgccgtggcatctccacgcccaggggagagtgtgggaggggctagagtgcacaggtcctgctggacacaaccctgagtcacagggcgcctgcccctcctcttcccccagccttgccacatgccagtggctctccctgagccctcagtcaca

SEQ ID NO: 178641 - DNA, 601 bp, Human
ccgccatctgcatcagagagcccgtgcgcctgtcaggaaagtgttggcggaggagtccagcggctggtaccggccgtgggaagaccaacgaggctgccgcccgccttccctgggagcagccctcccggcccccaacgccgtcccctcctcatccccccatctctccctccaccttcctcaggctcggcctcccgcaccaggtttcagcagggcctggaagtgcttcttggtgatagaacggcaggtgatggcgccaggagcccacagggccgaggtggggacggggagacgtgcaggaacrgcctgcactggggcccagttttccctcaacctccacctatccacggggatcacgattaccacacacaggcaaggacacagaagcagagaaggaaggtttgggatctgaggtcactgcgagccaggggtgggggtcctgctttctctggagtgctcacccctgaaggagacgggctccccaaaccgccatcccagaaactgccttcagaaccagaccttcccggcggggtacagtggctcatgcctgtaatcccagcactttcggaggctgaggcgggcaaatcacttgaggccaggagtt

SEQ ID NO: 178642 - DNA, 601 bp, Human
ccgccccagctcagggcaggggcagggcagcgggccctgggtggcgtggtgcagatgtgacttacggagctcccaccccagtctccggctccttactagagccaaggcgctgaggccaggctaggaggagccaagacctcagcctcctttccccaaagagatcctttggagacgactccaatttccactatctcctgaatctttagcaacatctggggacatgaagggaagaagggctgccttccaggtggagggaccgcatgcgcagggcgcccgccatctgcatcagagagcccgtgcrcctgtcaggaaagtgttggcggaggagtccagcggctggtaccggccgtgggaagaccaacgaggctgccgcccgccttccctgggagcagccctcccggcccccaacgccgtcccctcctcatccccccatctctccctccaccttcctcaggctcggcctcccgcaccaggtttcagcagggcctggaagtgcttcttggtgatagaacggcaggtgatggcgccaggagcccacagggccgaggtggggacggggagacgtgcaggaacggcctgcactggggcccagttttccctc

SEQ ID NO: 178643 - DNA, 601 bp, Human
gcgtcagggaccatgtccccccaaggaaatcttccctgaaccccggctctggggccccactatctccctgccgctcggcccgtgcccatccctgtcaccctctgctaagatgcagctagctctgcgggaggacggggaacacccccaactcaccgggtccaaaagttcatcatccagctccacgctgctcatatgtccgactcggaaaagcgcagaacgtggtgactaaaagcagaagagaaatcatgagggcgctcaggcgtcgcacgctctgctccgtggattctcactcccgccgcckcaccctggcctcgcctgaccctgcccgggagctcaggaatgggctaggccaggcctgcctgctgggtgggggcagcagggctgggacaggcctccctgggccctggaagcagaactgatccggctgcccctcggcctgtcagcgacacgtccagcccgagtccagggcgcaagctccctgctctagactgaaagcgaggcacctgccacccaccaggaaagaagggctggacaacacgccgcccccaatgcagtgcccgccacagcaccctgggccatcctgcccaaccctgctcccgag

SEQ ID NO: 178644 - DNA, 601 bp, Human
ggaggaagctgaaacgggaggattgcttgagcctgagagatggagttcagcctgggccacacagtgagacctcatctcaaagaatagtaataattaatttttttagacagggtcccgtctgtcacgcaggctgaagtacaatggtgtgatcatggctcactgcagcctcaacctcctgggttcgatcaatccacctgcctcagcgtcctgagtagctgggaccacaggcgcacaccaccacacctggctaattttcgtttttgtttttgttttttgtagagacagggtctcactgtgttgyctaggctgatctccaaatcctgggctgcagccttggtttcccaaagtgttgggattacaggtgtgaaccaccacacctgcccagaaaaaaaaaaaaaaaatttgaggcaggatctcactctgtcacccaggctgaagtgcagtggcaccatctcagctcactgaaacctccacctcctgggctcaagtgatcctccaacctcagcctcccaagtagctgggactactggtgcctatcaccaggcccagctaatatttatattttttgtagagacagggtttcaccatgttgatcaggctg

SEQ ID NO: 178645 - DNA, 601 bp, Human
ctgtctcaaaaaaagagagagagagagggagggtatgacgttggacccttacctcacaccacatccaaaaattaactcaaaagggatgaaagacctaaaactgtaaaattcttaggaaaaaacgggtcagtcgtcatactcttgggtgaggcaatggtttcttagatttgacaccaaaagtacaagcaacacaagaaaaaacagattagctgaacctcagcaatacaacctgtgcggggtgtgatgcacctgtggtcccagctcctcaggaggaagctgaaacgggaggattgcttgagcytgagagatggagttcagcctgggccacacagtgagacctcatctcaaagaatagtaataattaatttttttagacagggtcccgtctgtcacgcaggctgaagtacaatggtgtgatcatggctcactgcagcctcaacctcctgggttcgatcaatccacctgcctcagcgtcctgagtagctgggaccacaggcgcacaccaccacacctggctaattttcgtttttgtttttgttttttgtagagacagggtctcactgtgttgtctaggctgatctccaaatcctgggctgcagcc

SEQ ID NO: 178646 - DNA, 601 bp, Human
aggaggcagaggctgcagtgaaccatgattgcaccactgcactccagcctgggtgacagtgagaccctgtctcaaaaaaagagagagagagagggagggtatgacgttggacccttacctcacaccacatccaaaaattaactcaaaagggatgaaagacctaaaactgtaaaattcttaggaaaaaacgggtcagtcgtcatactcttgggtgaggcaatggtttcttagatttgacaccaaaagtacaagcaacacaagaaaaaacagattagctgaacctcagcaatacaacctgtgyggggtgtgatgcacctgtggtcccagctcctcaggaggaagctgaaacgggaggattgcttgagcctgagagatggagttcagcctgggccacacagtgagacctcatctcaaagaatagtaataattaatttttttagacagggtcccgtctgtcacgcaggctgaagtacaatggtgtgatcatggctcactgcagcctcaacctcctgggttcgatcaatccacctgcctcagcgtcctgagtagctgggaccacaggcgcacaccaccacacctggctaattttcgtttttgtttt

SEQ ID NO: 178647 - DNA, 601 bp, Human
aaaaaaaaaaccaggcatggtactggcatgaagatggccacaaaagaatggaagagaattgagagagtccagaaagaaatccaaaacatgtacgatcaattgatttcccacaacagtgtcaaaacatttcaacagagaaaggtagtgttttcaacaaatggtgctggtacaactggatttccacatgcaaaaatgaagctgggccgggcgcaatggctgacagctataatcccagcactctgggaggcagaggcagaaggactgcttgaggccaggagtttgtgatcagcctgggcaacayagtaagactccatctctacaaaatattagctgagtatggtgacatgcgcctgagtcccagctacttgggagacagacaggaggcagaggctgcagtgaaccatgattgcaccactgcactccagcctgggtgacagtgagaccctgtctcaaaaaaagagagagagagagggagggtatgacgttggacccttacctcacaccacatccaaaaattaactcaaaagggatgaaagacctaaaactgtaaaattcttaggaaaaaacgggtcagtcgtcatactcttgggtgaggcaatgg

SEQ ID NO: 178648 - DNA, 601 bp, Human
ggcgcctgtaatcccagctactcaggaggctgaggcaggagaatcgcttgaacccgggatgcagaggttgcagtgagccgagattgcgccgttgcactccagcctgggtgacagagcaagactccgtctcaaagaaaaaaaaaaaaagagaactacagaccaacacccctacaaccacggatgcaaagatctttggtaagacacaagcaaagtgattccagcaatgccaggagcaaggtgaattcagcctaggaatacaagttagtttaacatccaaaaatcaatccatgaggccgggtgsggtggctcacacctgtaatcccagcactctgggaggcagaggcaagaggatcaactgaagccaggagttcaagaccagcctgggcaacagagtaaaaccctcatctgtctttttttttttttttttttttttttttttgagatacagtcactctttttgcccaggctagagtgcagtgacgcgatctcaactcactgcaacctccgccttccaggttaaagccattctcctgcctcagcctcccaagtagctgggattacaggtgtgcaccaccacgcctggctaatttttgtatcttta

SEQ ID NO: 178649 - DNA, 601 bp, Human
gcacatggggtgcggtggctgacacctacaatcccagcactttgggaggccgaggcaagtggaccagctgcggtcaggagttcgagaccagcctggacaacaagatgaaaccctgtcgctactaaaaatacaaaaattagctgggcgtggtggtgggcgcctgtaatcccagctactcaggaggctgaggcaggagaatcgcttgaacccgggatgcagaggttgcagtgagccgagattgcgccgttgcactccagcctgggtgacagagcaagactccgtctcaaagaaaaaaaaaaaragagaactacagaccaacacccctacaaccacggatgcaaagatctttggtaagacacaagcaaagtgattccagcaatgccaggagcaaggtgaattcagcctaggaatacaagttagtttaacatccaaaaatcaatccatgaggccgggtgcggtggctcacacctgtaatcccagcactctgggaggcagaggcaagaggatcaactgaagccaggagttcaagaccagcctgggcaacagagtaaaaccctcatctgtctttttttttttttttttttttttttttttgagatac

SEQ ID NO: 178650 - DNA, 601 bp, Human
cctgccacccacctctatgaaagccacaatcacagagcccacgagcacgaaggcggcgttcagcgtggcccacagcaacagggagaaggacagtccgcccttctctgtgaacttgtcgatatctggggctcatcaaggagggctggctgcttccccgtcaggaccacccagcccagacctcagccctgccccacagaccagcctggcagatgccaccctgctgggtggagccatgatgttcactggacatcccagagacgtctcacggcccaaccatgacagggacacagccagcctggcsgggccgcctccacctgcactggaacacgctgggctcaggacttctgcccgggactcggcccaggccacgcccccctcccaagctgcagcggccgcactgggaaggatactgcccttgatgaccctgtacttgaggccagccaggttttccaccacgatgtcaatgaagcaggccacgaggcccgtgaggatcccaatgagggcgcagatgacccagcgcttgatctccaccgtccggaaggcctgcagggcgcggtcagggcgagggtcaggcagggccctggcgcagtcactctggcag

SEQ ID NO: 178651 - DNA, 601 bp, Human
ggtgagctgcaggggttcccgcccattcaccaagacccccaatccttcatggggtccgccatagctgcggcatcctgccacccacctctatgaaagccacaatcacagagcccacgagcacgaaggcggcgttcagcgtggcccacagcaacagggagaaggacagtccgcccttctctgtgaacttgtcgatatctggggctcatcaaggagggctggctgcttccccgtcaggaccacccagcccagacctcagccctgccccacagaccagcctggcagatgccaccctgctgggtgragccatgatgttcactggacatcccagagacgtctcacggcccaaccatgacagggacacagccagcctggccgggccgcctccacctgcactggaacacgctgggctcaggacttctgcccgggactcggcccaggccacgcccccctcccaagctgcagcggccgcactgggaaggatactgcccttgatgaccctgtacttgaggccagccaggttttccaccacgatgtcaatgaagcaggccacgaggcccgtgaggatcccaatgagggcgcagatgacccagcgcttgatctc

SEQ ID NO: 178652 - DNA, 601 bp, Human
ggttgtgagtctggaccgcgtgattctaaaagtgcccgggttgtcagccaatgtgatggtgggggtgggtgagctgcaggggttcccgcccattcaccaagacccccaatccttcatggggtccgccatagctgcggcatcctgccacccacctctatgaaagccacaatcacagagcccacgagcacgaaggcggcgttcagcgtggcccacagcaacagggagaaggacagtccgcccttctctgtgaacttgtcgatatctggggctcatcaaggagggctggctgcttccccgtcakgaccacccagcccagacctcagccctgccccacagaccagcctggcagatgccaccctgctgggtggagccatgatgttcactggacatcccagagacgtctcacggcccaaccatgacagggacacagccagcctggccgggccgcctccacctgcactggaacacgctgggctcaggacttctgcccgggactcggcccaggccacgcccccctcccaagctgcagcggccgcactgggaaggatactgcccttgatgaccctgtacttgaggccagccaggttttccaccacgatgt

SEQ ID NO: 178653 - DNA, 601 bp, Human
agaggccctggtgtgtctgctcctcctgaggttgtgagtctggaccgcgtgattctaaaagtgcccgggttgtcagccaatgtgatggtgggggtgggtgagctgcaggggttcccgcccattcaccaagacccccaatccttcatggggtccgccatagctgcggcatcctgccacccacctctatgaaagccacaatcacagagcccacgagcacgaaggcggcgttcagcgtggcccacagcaacagggagaaggacagtccgcccttctctgtgaacttgtcgatatctggggctcrtcaaggagggctggctgcttccccgtcaggaccacccagcccagacctcagccctgccccacagaccagcctggcagatgccaccctgctgggtggagccatgatgttcactggacatcccagagacgtctcacggcccaaccatgacagggacacagccagcctggccgggccgcctccacctgcactggaacacgctgggctcaggacttctgcccgggactcggcccaggccacgcccccctcccaagctgcagcggccgcactgggaaggatactgcccttgatgaccctgtactt

SEQ ID NO: 178654 - DNA, 601 bp, Human
actcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagccagcccatctgcacacagygccaccagtacacagggtggctgaggccagttctggaaggcaggcagccaagagagctgctcctgaaccagcaaagagcgggcgcccaccctgcccagccagggccaccgcaccctcaccttgagccgcaccacgtgggggatcttcaccccgttgaggaagcacttgatctgggggattccgctgccagcagccaccggctgaaagaggggaagcacggctgagtgggtcacggccaggctgagacagatgcagcccctcagccccaggagccccaggagctgaggagagcagcagaca

SEQ ID NO: 178655 - DNA, 601 bp, Human
gaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagccagccmatctgcacacagtgccaccagtacacagggtggctgaggccagttctggaaggcaggcagccaagagagctgctcctgaaccagcaaagagcgggcgcccaccctgcccagccagggccaccgcaccctcaccttgagccgcaccacgtgggggatcttcaccccgttgaggaagcacttgatctgggggattccgctgccagcagccaccggctgaaagaggggaagcacggctgagtgggtcacggccaggctgagacagatgcagcccctcagccccaggagccccaggagctgagg

SEQ ID NO: 178656 - DNA, 601 bp, Human
ccacagggaccaggccccggaagcacccccagggggcagcggccatgctgcccacccatcctcagacgggacggggctgcggcaagtctcaggctaaggaacgatggcggcacagacagaagcaaccacagcggaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcrcacagctgtgtcacacatgcaccacgcaagcatttctgtatgactactcatttcttacgtaatttaatatgtgcaaataccagttgttaccactttcagaaaaaaaggtgaccccttcacacccagccagcccatctgcacacagtgccaccagtacacagggtggctgaggccagttctggaaggcaggcagccaagagagctgctcctgaaccagcaaagagcgggcgcccaccctgcccagccagggccaccgcaccctcaccttgagccgcaccacgtgggggatcttcaccccgt

SEQ ID NO: 178657 - DNA, 601 bp, Human
ggacacactggtcccgctccttggccacagggaccaggccccggaagcacccccagggggcagcggccatgctgcccacccatcctcagacgggacggggctgcggcaagtctcaggctaaggaacgatggcggcacagacagaagcaaccacagcggaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacrcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagccagcccatctgcacacagtgccaccagtacacagggtggctgaggccagttctggaaggcaggcagccaagagagctgctcctgaaccagcaaagagcgggcgcccaccctgcccagccagggccaccgcaccctcaccttgagccgca

SEQ ID NO: 178658 - DNA, 601 bp, Human
cattcccagctgctccagtaaacctgatctcccaccacagggcaggggcaccccaaggtcacctgggagctttcgccagaggggacacactggtcccgctccttggccacagggaccaggccccggaagcacccccagggggcagcggccatgctgcccacccatcctcagacgggacggggctgcggcaagtctcaggctaaggaacgatggcggcacagacagaagcaaccacagcggaactgggtcaggactcccagcacctccagaaccagatgctctgataacaccaagtgtaaaygaccatgaggcaaactgaaagcgggaaactgctacacgcccactaccacgacagcttccacggtgaatcagtcaccaccacgcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagccagcccatctgcacacagtgccaccagtacacagggtggctgaggccagttctggaaggcaggcagc

SEQ ID NO: 178659 - DNA, 601 bp, Human
aacaaaagttatagagcaacatccaagaaggttcaggccagcctggcgcgggtgacaggcgggtcgccattcccagctgctccagtaaacctgatctcccaccacagggcaggggcaccccaaggtcacctgggagctttcgccagaggggacacactggtcccgctccttggccacagggaccaggccccggaagcacccccagggggcagcggccatgctgcccacccatcctcagacgggacggggctgcggcaagtctcaggctaaggaacgatggcggcacagacagaagcaaccrcagcggaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagc

SEQ ID NO: 178660 - DNA, 601 bp, Human
gtgtttatcagcctccctgccccagggcagaacccacaagggcgcagaccctaaacacaagggcgctgagtgtgtgggggaggactgtatgttaaagatgccgagcaaactcaaccctcagccaacaaaagttatagagcaacatccaagaaggttcaggccagcctggcgcgggtgacaggcgggtcgccattcccagctgctccagtaaacctgatctcccaccacagggcaggggcaccccaaggtcacctgggagctttcgccagaggggacacactggtcccgctccttggccacrgggaccaggccccggaagcacccccagggggcagcggccatgctgcccacccatcctcagacgggacggggctgcggcaagtctcaggctaaggaacgatggcggcacagacagaagcaaccacagcggaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcgcaca

SEQ ID NO: 178661 - DNA, 601 bp, Human
ttgttacctttcccacggccaggcccccgaccacggacaggatcacaccggacactttgatcaccaacgtctgaaacacagggagacgcacggcctctgatgaaaaggcaggcgctgtctttggacctgagccgtaaaacagcacacacagccctcatcaggcagagtggctgggacacggggcctccgggagggggccagcacccccaggctgggtctccccatggccacagtggagctaaacagcagccaagcgtcccccgcactcactcgggggacctgccctctgtggcctcagcaytgagcaggcaaggggttctttcgtttccttccttcctgaggcaaagctgggccgcccaccgcatcctacaggcacaacctgcctccgccagcgtggccagcacaggggaggtgttcccgctagccccgcctagcaaggctcctcatacacccctggcactggaaggctggtcacctgcggctccacgatgccccctctcccttcggctgctccccgcccccaggggcctcatcctctccacctgagaaggtgtgtaaggtgtttatcagcctccctgccccagggcagaacccacaaggg

SEQ ID NO: 178662 - DNA, 601 bp, Human
gacaaataaacaacaggtgggcacacttggtctcaggttctgcactcctctgagaagccgcttggagccacagaccctcccacgggaaacactgatgcacgtgtggcaggggacccaaggagggaagcagcgggccgtagggaggccttgccgggcagggactgtgcccgctggctctgggagccacccgccaggctgtcctcagatggggctggggctctcggcctgggggtgctgagggaagcccatctccctgagtggtgcccgtgcccgtgcccatggcatctggagcccacccacrcaagatttcaactcaccttgaaatctcgtttcagtgacgttgaccttccctgagagatcccggcggcaatcactgaacctgagtggatcatcggcccttcctggagaccagaaggaccggtgctcagagacacgcgtgacgcggcccttcctggagaccagaaggaccgatgctcagagacacgcgtgacgcggcccttcctggagaccagaaggaccgatgctcagagacacgcgtgacgcggcccttcctggagaccagaaggaccggtgctcagagacacgcgtgacgcggcccttc

SEQ ID NO: 178663 - DNA, 601 bp, Human
ggcgtggtggcgggcacctataatcccagctactcgggatgctgaggcaggagaattgcttgaacctgggaggtggaggctgcagtgagctgagattgtaccactgcactccagcctgggcaacagagagactccatctcaaaaaaaaaaaaaaaatacaatcacacacaaatgcagctcaatccccatcaacatgctggggacttttttggggaaaaagtgttccaaagtgtgtcttgacaaataaacaacaggtgggcacacttggtctcaggttctgcactcctctgagaagccgctyggagccacagaccctcccacgggaaacactgatgcacgtgtggcaggggacccaaggagggaagcagcgggccgtagggaggccttgccgggcagggactgtgcccgctggctctgggagccacccgccaggctgtcctcagatggggctggggctctcggcctgggggtgctgagggaagcccatctccctgagtggtgcccgtgcccgtgcccatggcatctggagcccacccacgcaagatttcaactcaccttgaaatctcgtttcagtgacgttgaccttccctgagagatcccg

SEQ ID NO: 178664 - DNA, 601 bp, Human
acatggccggcgcggtgcctcacgcctgtcatcccagcactttgggaggccgaggcaggcggatcacctgaggtcgggagtttgagaccagcccggccaacatggcaaaaccccatctctactaaaaatacaaaaaacttagccaggcgtggtggcgggcacctataatcccagctactcgggatgctgaggcaggagaattgcttgaacctgggaggtggaggctgcagtgagctgagattgtaccactgcactccagcctgggcaacagagagactccatctcaaaaaaaaaaaaaaaatacaatcacacacaaatgcagctcaatccccatcaacatgctggggacttttttggggaaaaagtgttccaaagtgtgtcttgacaaataaacaacaggtgggcacacttggtctcaggttctgcactcctctgagaagccgcttggagccacagaccctcccacgggaaacactgatgcacgtgtggcaggggacccaaggagggaagcagcgggccgtagggaggccttgccgggcagggactgtgcccgctggctctgggagccacccgccaggctgtcctcagatggggctggggc

SEQ ID NO: 178665 - DNA, 601 bp, Human
tgctgcagaccacggcaagagacagcagggtcagcaccaccaccggcagcccagggaaacacgcaaacacccagccaggagctccactttccagcgcacgcaagattccaaaaacctctaccctctaacgaaaagcgcacggatggaaacccagccttgctgttctttgtcctgcgggacgctgcctgcctctaaattcacacatggccggcgcggtgcctcacgcctgtcatcccagcactttgggaggccgaggcaggcggatcacctgaggtcgggagtttgagaccagcccggccawcatggcaaaaccccatctctactaaaaatacaaaaaacttagccaggcgtggtggcgggcacctataatcccagctactcgggatgctgaggcaggagaattgcttgaacctgggaggtggaggctgcagtgagctgagattgtaccactgcactccagcctgggcaacagagagactccatctcaaaaaaaaaaaaaaaatacaatcacacacaaatgcagctcaatccccatcaacatgctggggacttttttggggaaaaagtgttccaaagtgtgtcttgacaaataaacaacagg

SEQ ID NO: 178666 - DNA, 601 bp, Human
gcaccgtgctgcagaccacggcaagagacagcagggtcagcaccaccaccggcagcccagggaaacacgcaaacacccagccaggagctccactttccagcgcacgcaagattccaaaaacctctaccctctaacgaaaagcgcacggatggaaacccagccttgctgttctttgtcctgcgggacgctgcctgcctctaaattcacacatggccggcgcggtgcctcacgcctgtcatcccagcactttgggaggccgaggcaggcggatcacctgaggtcgggagtttgagaccagccyggccaacatggcaaaaccccatctctactaaaaatacaaaaaacttagccaggcgtggtggcgggcacctataatcccagctactcgggatgctgaggcaggagaattgcttgaacctgggaggtggaggctgcagtgagctgagattgtaccactgcactccagcctgggcaacagagagactccatctcaaaaaaaaaaaaaaaatacaatcacacacaaatgcagctcaatccccatcaacatgctggggacttttttggggaaaaagtgttccaaagtgtgtcttgacaaataaac

SEQ ID NO: 178667 - DNA, 601 bp, Human
cttgagggcacggctctcagaaagggagagcaactgccaggacaggggctgtgcaggggaaggggctttcaggacaaccgagtcagcagctctgattcctgaagagcaccgtgctgcagaccacggcaagagacagcagggtcagcaccaccaccggcagcccagggaaacacgcaaacacccagccaggagctccactttccagcgcacgcaagattccaaaaacctctaccctctaacgaaaagcgcacggatggaaacccagccttgctgttctttgtcctgcgggacgctgcctgcytctaaattcacacatggccggcgcggtgcctcacgcctgtcatcccagcactttgggaggccgaggcaggcggatcacctgaggtcgggagtttgagaccagcccggccaacatggcaaaaccccatctctactaaaaatacaaaaaacttagccaggcgtggtggcgggcacctataatcccagctactcgggatgctgaggcaggagaattgcttgaacctgggaggtggaggctgcagtgagctgagattgtaccactgcactccagcctgggcaacagagagactccatctcaaaa

SEQ ID NO: 178668 - DNA, 601 bp, Human
gacgaagtcccgcttctctgtgtctctgcggaagtactcgaagatctgcaacagggacagaccagggtcggggcaggttccttgagggcacggctctcagaaagggagagcaactgccaggacaggggctgtgcaggggaaggggctttcaggacaaccgagtcagcagctctgattcctgaagagcaccgtgctgcagaccacggcaagagacagcagggtcagcaccaccaccggcagcccagggaaacacgcaaacacccagccaggagctccactttccagcgcacgcaagattccraaaacctctaccctctaacgaaaagcgcacggatggaaacccagccttgctgttctttgtcctgcgggacgctgcctgcctctaaattcacacatggccggcgcggtgcctcacgcctgtcatcccagcactttgggaggccgaggcaggcggatcacctgaggtcgggagtttgagaccagcccggccaacatggcaaaaccccatctctactaaaaatacaaaaaacttagccaggcgtggtggcgggcacctataatcccagctactcgggatgctgaggcaggagaattgcttgaa

SEQ ID NO: 178669 - DNA, 601 bp, Human
ccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcggggcaggttccttgagggcacggctctcagaaagggagagcaactgccaggacaggggctgtgcaggggaaggggctttcaggacraccgagtcagcagctctgattcctgaagagcaccgtgctgcagaccacggcaagagacagcagggtcagcaccaccaccggcagcccagggaaacacgcaaacacccagccaggagctccactttccagcgcacgcaagattccaaaaacctctaccctctaacgaaaagcgcacggatggaaacccagccttgctgttctttgtcctgcgggacgctgcctgcctctaaattcacacatggccggcgcggtgcctcacgcctgtcatcccagcactttgggaggccgaggcaggcggat

SEQ ID NO: 178670 - DNA, 601 bp, Human
tcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacgtcagaaagaagctaatggggtgggccccagccacacagagagggaccctgagggaggtctgagggctggacccaagtacactgccggccgcttccaaatgccccggccgtgactccaagcctctgccaccctcagcgggcamtgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcggggcaggttccttgagggcacggctctcagaaagggagagcaactgccaggacaggggctgtgcaggggaaggggctttcaggacaaccgagtcagcagctc

SEQ ID NO: 178671 - DNA, 601 bp, Human
cagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacgtcagaaagaagctaatggggtgggccccagccacacagagagggaccctgagggaggtctgagggctggacccaagtacactgccggccgcttccaaatgccccggccgtgactccaarcctctgccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcggggcaggttccttgagggcacggctctcagaaagggagagcaactgccaggacaggggctgtgcaggggaaggggcttt

SEQ ID NO: 178672 - DNA, 601 bp, Human
tgagagcgcagcatgcaccctgatcaggaggcagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacgtcagaaagaagctaatggggtgggccccagccacacagagagggaccctgagggaggtctgagggctggacccaagtacactgccggycgcttccaaatgccccggccgtgactccaagcctctgccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcggggcaggttccttgagggcacggctctcagaaagggagagcaactgcc

SEQ ID NO: 178673 - DNA, 601 bp, Human
cagccgcagctcgatgggtggccccaaggtggaccccatggtgggaaatgagagcgcagcatgcaccctgatcaggaggcagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacgtcagaaagaagctaatggggtgggccccagccacacagaragggaccctgagggaggtctgagggctggacccaagtacactgccggccgcttccaaatgccccggccgtgactccaagcctctgccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcg

SEQ ID NO: 178674 - DNA, 601 bp, Human
gcaggaccaaggcctgacagacccacagggggtccagctccagccgcagctcgatgggtggccccaaggtggaccccatggtgggaaatgagagcgcagcatgcaccctgatcaggaggcagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacrtcagaaagaagctaatggggtgggccccagccacacagagagggaccctgagggaggtctgagggctggacccaagtacactgccggccgcttccaaatgccccggccgtgactccaagcctctgccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcg

SEQ ID NO: 178675 - DNA, 601 bp, Human
cagagggcaggaaaccagcgccctcagagccacgctcccagcccagggctcacggaccagcagggaccatcgcccctcctgtcagccccggggccaggagtctgcagaccccgcccaaggcagaagggaaggggctggagccaggggtgggcgcactgtgcgggcaaggaggggcccagccctctctggacttgccagtggagagcaagaggggaaggtggggcagggctgggttcccggctgtttgatcccctacccgggagccacccagggctggcaatggtgcccaggaccaagggcraactgggcagcaaaggcaggaccgctgctttgggcaggaccaaggcctgacagacccacagggggtccagctccagccgcagctcgatgggtggccccaaggtggaccccatggtgggaaatgagagcgcagcatgcaccctgatcaggaggcagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaac

SEQ ID NO: 178676 - DNA, 601 bp, Human
ggttacctccgagtcaaaccttccgaagttgatgaggcctgggctggacaggtcccacatgttcccgtggtaaatgctcagaacaaaattcagggtgaacgtggagatcatggaagcaaagaactgcggcagagggcaggaaaccagcgccctcagagccacgctcccagcccagggctcacggaccagcagggaccatcgcccctcctgtcagccccggggccaggagtctgcagaccccgcccaaggcagaagggaaggggctggagccaggggtgggcgcactgtgcgggcaaggagsggcccagccctctctggacttgccagtggagagcaagaggggaaggtggggcagggctgggttcccggctgtttgatcccctacccgggagccacccagggctggcaatggtgcccaggaccaagggcaaactgggcagcaaaggcaggaccgctgctttgggcaggaccaaggcctgacagacccacagggggtccagctccagccgcagctcgatgggtggccccaaggtggaccccatggtgggaaatgagagcgcagcatgcaccctgatcaggaggcagccatcagcaggaactt

SEQ ID NO: 178677 - DNA, 601 bp, Human
ccttaagcaaacagggtcctggaccaggatacgaggtgggcgaggtgggcgatggggcaggttacctccgagtcaaaccttccgaagttgatgaggcctgggctggacaggtcccacatgttcccgtggtaaatgctcagaacaaaattcagggtgaacgtggagatcatggaagcaaagaactgcggcagagggcaggaaaccagcgccctcagagccacgctcccagcccagggctcacggaccagcagggaccatcgcccctcctgtcagccccggggccaggagtctgcagaccccrcccaaggcagaagggaaggggctggagccaggggtgggcgcactgtgcgggcaaggaggggcccagccctctctggacttgccagtggagagcaagaggggaaggtggggcagggctgggttcccggctgtttgatcccctacccgggagccacccagggctggcaatggtgcccaggaccaagggcaaactgggcagcaaaggcaggaccgctgctttgggcaggaccaaggcctgacagacccacagggggtccagctccagccgcagctcgatgggtggccccaaggtggaccccat

SEQ ID NO: 178678 - DNA, 601 bp, Human
tgggagcaattctatctcttacaggaaatcccatccatccctgcagccctgtggtttttgccaacagagataaacaacaggaagccacagaagcgaagctttgggctccccactccccacgtgtactgcccatggaagaatctggaggcccccgggtggccctgggatgagggcaggctccagggagccacagcctccagtcctcgtctctatggccacgtcacagctgagccaggcccgcaggccgtccctgcggtgctgggagaagcccttacccaccacgcccatggcgatgaagacygggatctcgtggatcgtgtaggccattttctgtgcagagagagggagaaggcagaggatgtgagggaaaaggcccacagctcctttctgctgaaactcaaggaccaccatcttaagagagctgtccccacagagagccttcccgcccttccacgcaggctgcggaagtccacaggggagaaacacactgggtgttctgagcaggcctggcccctgcctggcggggtggccagcgaggctctcagagaccctgccaccctcagcacccggggcggggagggccccaagcactgggaacata

SEQ ID NO: 178679 - DNA, 601 bp, Human
cagtcagcgacaccggaggaaaagtgcgggcctccgcccgccggctcccagatggcaggagaagctggagggtttgcagagggaaggggacggcagggggctggggggtcctggtaagatgcttcctccacatcatcacaccctgagggctgggggagctgtttctcaaaggctctgccttccttccagggcaaaggtgtccagcagagcaataaatactggtgggagcaattctatctcttacaggaaatcccatccatccctgcagccctgtggtttttgccaacagagataaacaacrggaagccacagaagcgaagctttgggctccccactccccacgtgtactgcccatggaagaatctggaggcccccgggtggccctgggatgagggcaggctccagggagccacagcctccagtcctcgtctctatggccacgtcacagctgagccaggcccgcaggccgtccctgcggtgctgggagaagcccttacccaccacgcccatggcgatgaagaccgggatctcgtggatcgtgtaggccattttctgtgcagagagagggagaaggcagaggatgtgagggaaaaggcccaca

SEQ ID NO: 178680 - DNA, 601 bp, Human
ggtcagccagtagttcaaggcattgaacactgctccaagcacaccgcctgcgaacaggggaaaggccagtcagcgacaccggaggaaaagtgcgggcctccgcccgccggctcccagatggcaggagaagctggagggtttgcagagggaaggggacggcagggggctggggggtcctggtaagatgcttcctccacatcatcacaccctgagggctgggggagctgtttctcaaaggctctgccttccttccagggcaaaggtgtccagcagagcaataaatactggtgggagcaattcyatctcttacaggaaatcccatccatccctgcagccctgtggtttttgccaacagagataaacaacaggaagccacagaagcgaagctttgggctccccactccccacgtgtactgcccatggaagaatctggaggcccccgggtggccctgggatgagggcaggctccagggagccacagcctccagtcctcgtctctatggccacgtcacagctgagccaggcccgcaggccgtccctgcggtgctgggagaagcccttacccaccacgcccatggcgatgaagaccgggatctcgtgg

SEQ ID NO: 178681 - DNA, 601 bp, Human
acacagcctttctttcggctgtggcctaggagtgtaaaccccattccaccacgtccgctttcaaagggcctgtgtggccacgcctgccaacgcgatatgcaatgcggtttctcctcacctgattcgaaacatggtcagccagtagttcaaggcattgaacactgctccaagcacaccgcctgcgaacaggggaaaggccagtcagcgacaccggaggaaaagtgcgggcctccgcccgccggctcccagatggcaggagaagctggagggtttgcagagggaaggggacggcagggggctrgggggtcctggtaagatgcttcctccacatcatcacaccctgagggctgggggagctgtttctcaaaggctctgccttccttccagggcaaaggtgtccagcagagcaataaatactggtgggagcaattctatctcttacaggaaatcccatccatccctgcagccctgtggtttttgccaacagagataaacaacaggaagccacagaagcgaagctttgggctccccactccccacgtgtactgcccatggaagaatctggaggcccccgggtggccctgggatgagggcaggctcc

SEQ ID NO: 178682 - DNA, 601 bp, Human
agggcctcacttcctacccaggggccgtcctccaggagccctcgcactcctagccttgggctagtccgtcaccctccaggccccgggacacatctctgaccagctccaccggggaaaccatcaggaaggacgctgcatacacagcctttctttcggctgtggcctaggagtgtaaaccccattccaccacgtccgctttcaaagggcctgtgtggccacgcctgccaacgcgatatgcaatgcggtttctcctcacctgattcgaaacatggtcagccagtagttcaaggcattgaacacwgctccaagcacaccgcctgcgaacaggggaaaggccagtcagcgacaccggaggaaaagtgcgggcctccgcccgccggctcccagatggcaggagaagctggagggtttgcagagggaaggggacggcagggggctggggggtcctggtaagatgcttcctccacatcatcacaccctgagggctgggggagctgtttctcaaaggctctgccttccttccagggcaaaggtgtccagcagagcaataaatactggtgggagcaattctatctcttacaggaaatcccatccatccctg

SEQ ID NO: 178683 - DNA, 601 bp, Human
ctcccgagtagctgggattacaggcgcccggctctacatctggctaatttttttttgaattttttagtagagacggggtttctccatgttggtcaagctggtctagaactcccgacctcaggtgatccacccgcctcggcctcccaaagtgctgggattatagtcgtgaggcaccgcgcccggccaggcctgtgtttaatcatcaatcaggcacccaaatgtcctggggtcgtcctcttccctggggtaaagactcctcggcagcaacttctccagatgtgtgggaagtggcgctacccgygccccggctgtacccgacagtattgaaatcagcacagaccaagaaggaagaagccggggggccccggtgtcccaggacagctgcggttgctaccaggcagagccaggcggtgaaggttgggcatgcctcgcccaggcccgatcccacgcagggcctcacttcctacccaggggccgtcctccaggagccctcgcactcctagccttgggctagtccgtcaccctccaggccccgggacacatctctgaccagctccaccggggaaaccatcaggaaggacgctgcatacacagcctttct

SEQ ID NO: 178684 - DNA, 601 bp, Human
gtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgcccggctctacatctggctaatttttttttgaattttttagtagagacggggtttctccatgttggtcaagctggtctagaactcccgacctcaggtgatccacccgcctcggcctcccaaagtgctgggattatagtcgtgaggcaccgcgcccrgccaggcctgtgtttaatcatcaatcaggcacccaaatgtcctggggtcgtcctcttccctggggtaaagactcctcggcagcaacttctccagatgtgtgggaagtggcgctacccgtgccccggctgtacccgacagtattgaaatcagcacagaccaagaaggaagaagccggggggccccggtgtcccaggacagctgcggttgctaccaggcagagccaggcggtgaaggttgggcatgcctcgcccaggcccgatcccacgcagggcctcacttcctacccaggggccgtcctc

SEQ ID NO: 178685 - DNA, 601 bp, Human
ggcccgtggtgctttttgtttgtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgcccggctctacatctggctaatttttttttgaattttttagtagagacggggtttctccatgttggtcaagctggtctagaactcccgacctcaggtgatccacccgcctcggcctcccaaagtgctgggattayagtcgtgaggcaccgcgcccggccaggcctgtgtttaatcatcaatcaggcacccaaatgtcctggggtcgtcctcttccctggggtaaagactcctcggcagcaacttctccagatgtgtgggaagtggcgctacccgtgccccggctgtacccgacagtattgaaatcagcacagaccaagaaggaagaagccggggggccccggtgtcccaggacagctgcggttgctaccaggcagagccaggcggtgaaggttgggcatgcctcgcccaggcccgatcccacgcagggcctcact

SEQ ID NO: 178686 - DNA, 601 bp, Human
gcacctcagcagacacctggcctcctctgagatctgggtggacaggactaaccctctttgagacacgccagcccatgcgcttctggaactcggcggggtgggcagccctcctcccgtagcctaagcgagcctcctggaggccgccctgtggctgccctgcctgctggaccccgcccgggcccagcctcccacctgcagcgggtaggacatggagcccccctgcaggggctggcaatcccgcgacgagtagatcagcacgaaggcaactgtggccgtgacggcggccaccagcacggcctcratcacctgcaggcagggccggtggatgtacctggaaccaagaatcaggctgcatggcaggcaggacggcagcgcggcccctccgcaggccccatggcaactcgagtccctgatggaggacactgggcccgtggtgctttttgtttgtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgcccggctcta

SEQ ID NO: 178687 - DNA, 601 bp, Human
tcccctggcacctcagcagacacctggcctcctctgagatctgggtggacaggactaaccctctttgagacacgccagcccatgcgcttctggaactcggcggggtgggcagccctcctcccgtagcctaagcgagcctcctggaggccgccctgtggctgccctgcctgctggaccccgcccgggcccagcctcccacctgcagcgggtaggacatggagcccccctgcaggggctggcaatcccgcgacgagtagatcagcacgaaggcaactgtggccgtgacggcggccaccagcayggcctcaatcacctgcaggcagggccggtggatgtacctggaaccaagaatcaggctgcatggcaggcaggacggcagcgcggcccctccgcaggccccatggcaactcgagtccctgatggaggacactgggcccgtggtgctttttgtttgtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgccc

SEQ ID NO: 178688 - DNA, 601 bp, Human
ggtgccacaggcccagagcctcctgggctccagcagcacagggggtgttatccacggggctggagcagagtgtagcaaggctggtcaaccccatggccccgggcctcccacgtctctaacggttcacacctgacccgtcccatcctgcccactcccgccgtggcacccactggtctgctgggcctctaggctctccctgttctggatgtttcatgttaatggggctacgtcgcgtgacctcacgtgtggttcctctgagcgtagtgctttccagggcaaccgtgtcacagtgcagatggaygcacggacggcggtgagccgtgagcgccaggcacaggtccagttgtggacggaggtttgcatttctcctgggtccacatctatggtgcccccatagggcgcctgaggctcgccccgtcaggctgccattctgggaagaggactggggggagcctctggcccccataccaccgcccattcccctggcacctcagcagacacctggcctcctctgagatctgggtggacaggactaaccctctttgagacacgccagcccatgcgcttctggaactcggcggggtgggcagccctcctcccg

SEQ ID NO: 178689 - DNA, 601 bp, Human
aggcgctcacatgagctcctagaagaggctgttggcgccccggtgccacaggcccagagcctcctgggctccagcagcacagggggtgttatccacggggctggagcagagtgtagcaaggctggtcaaccccatggccccgggcctcccacgtctctaacggttcacacctgacccgtcccatcctgcccactcccgccgtggcacccactggtctgctgggcctctaggctctccctgttctggatgtttcatgttaatggggctacgtcgcgtgacctcacgtgtggttcctctgagygtagtgctttccagggcaaccgtgtcacagtgcagatggacgcacggacggcggtgagccgtgagcgccaggcacaggtccagttgtggacggaggtttgcatttctcctgggtccacatctatggtgcccccatagggcgcctgaggctcgccccgtcaggctgccattctgggaagaggactggggggagcctctggcccccataccaccgcccattcccctggcacctcagcagacacctggcctcctctgagatctgggtggacaggactaaccctctttgagacacgccagccca

SEQ ID NO: 178690 - DNA, 601 bp, Human
ttctcaagaataaggacacgagcctccgccccctaccttcgcctggtccagactccacacatgggctgcgctgccacagtacacgctgccaccacagcaggacaacgcccacggcccgtgaaccacgcgaggacaacgcccacggcccgtgaaccacgcgaggacaacgcccacggcccgtgaaccacgtgaggtgcgacacttttgtcctgccctgggacttctgctccggcccgcgatgccgcaagacctggctcagctgcagggccccacagcctcccctccggccccactcaccgcygcccccgtgaggtaggacagggagatcccaaagagccggccccaggcagccccgatgagcagggacgggatgaagaccccggcagacaccgtgagcccgtaggtccagcaggccaggaagaagtagaccagcgtgaacaggccgagggtcagggggttgtaggagcctaggagagaagaggggctgacggggcctccacgactcccgcctccgcaggactgccctgccccgctgcccagtctcgggcctcacagtcaccttccaggagcccagcaacctgagctcccgagcccagcggtc

SEQ ID NO: 178691 - DNA, 601 bp, Human
gggatgacggaacattctagaagtggtagtgacggccgcactgcctcgtgaacgtgagaaacgccgctgaactgccctctttaaaacgatgagttttacggtatttgaatcatgtttcaattttaaaaaccaaaccaaacccttgtgcggagggagatgggcagagcacacgggcctggggagcaggagtgggcgcttcctgccggggatgagaagcatggccgggggcttcctgccagggcctcttacaggttttcagtcttatttaagcgactgaaatgagaaacagaagacacataasagaacccagtcccagcagaggcaggcagagaaggaaggcctgcgggggctgaggtctggagggcagtgtatgccgctctggcccccggcctcacagagagcagccctggccggacatccaccccatggagtctagaaacagctctgcagcagcccacaatcacctctgcttttcatcacattctcaagaataaggacacgagcctccgccccctaccttcgcctggtccagactccacacatgggctgcgctgccacagtacacgctgccaccacagcaggacaacgcccacggcccgtg

SEQ ID NO: 178692 - DNA, 601 bp, Human
ggagcaccgtccagcatgaggagtgaaaccccggcacacacgacacagagagccccgggaacatcaggctgggccacagaacccaggcatggaggctgcagaaagcggggcacgagggtcggtgggcacagggtttccattctgggatgacggaacattctagaagtggtagtgacggccgcactgcctcgtgaacgtgagaaacgccgctgaactgccctctttaaaacgatgagttttacggtatttgaatcatgtttcaattttaaaaaccaaaccaaacccttgtgcggagggagaygggcagagcacacgggcctggggagcaggagtgggcgcttcctgccggggatgagaagcatggccgggggcttcctgccagggcctcttacaggttttcagtcttatttaagcgactgaaatgagaaacagaagacacataagagaacccagtcccagcagaggcaggcagagaaggaaggcctgcgggggctgaggtctggagggcagtgtatgccgctctggcccccggcctcacagagagcagccctggccggacatccaccccatggagtctagaaacagctctgcagcagcccac

SEQ ID NO: 178693 - DNA, 601 bp, Human
catgaaccccagcacgtccaccctcctggctcagggtcacgtggccactgccttctctgcagcacccatcccatccacctgctcccagaccctagccccgcaaggacagccatggccccctccagaccccgtggagctccccacccatcgggcaagagctgggacatacccagctgggcagcagctcccatcagggcgtatttgccggggtccgcccagatctgtgggaggtgacacggaggaggtgtcagtgtggtggcaggcccaaacccaccaagatacacagacggaggaggccctrcccaggcccagcagccccacagccaggaacaaacctcgtggccgcgtacatacacacagaacaacctagcacagtacaccctgctgcggaggctgcatccttggcctgaaccaggcgctcagcacccgagcaacaggggagtggcaggcatggaggatgcagagggcacagtcaccacgcagcagcccaggccaactagggagcaccgtccagcatgaggagtgaaaccccggcacacacgacacagagagccccgggaacatcaggctgggccacagaacccaggcatggaggctgcag

SEQ ID NO: 178694 - DNA, 601 bp, Human
tccccacccacaggtgtcctgggcgctgtacctggcagtgagtgagtgtgaggtgaccggggcctcccagtgcaggaagggcacactctgcagctgaatgtgcatgtcgtacaggccctgcgggcggggcgggaacacagggcttgaggagtccacacccacccctggagccccgagcctacccctgggagcccagaggccgcccccagaaaccctgagcctaccccccgggaccggctgtttggaggctcacaggggcccctcccctatggcagcacccacgctctcagggtgaggcttygaggccctggcgcacctcaatgaagacgtcgcccacgatcttggcggtcatgagcaccagcatgatggggaagccgtaggtcacgttgctggtggcctccatcatgatgacggtcaggctcagtgtcatccgcacaatcccgcctgcgggagccatcatgaaccccagcacgtccaccctcctggctcagggtcacgtggccactgccttctctgcagcacccatcccatccacctgctcccagaccctagccccgcaaggacagccatggccccctccagaccccgtggagctccccac

SEQ ID NO: 178695 - DNA, 601 bp, Human
atcacctccctgccggaggagcccggccacacatgcccgtcacacgccaccaactcccacagttacctctgcgggctggtgaggtgtgaagccgctggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggcgrggcgggaacacagggcttgaggagtccacacccacccctggagccccgagcctacccctgggagcccagaggccgcccccagaaaccctgagcctaccccccgggaccggctgtttggaggctcacaggggcccctcccctatggcagcacccacgctctcagggtgaggcttcgaggccctggcgcacctcaatgaagacgtcgcccacgatcttggcggtcatgagcaccagcatgatggggaagccgtaggtcacgttgctggtggcctccatcatgatgacggtcaggctcagtgt

SEQ ID NO: 178696 - DNA, 601 bp, Human
tcatcacctccctgccggaggagcccggccacacatgcccgtcacacgccaccaactcccacagttacctctgcgggctggtgaggtgtgaagccgctggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggyggggcgggaacacagggcttgaggagtccacacccacccctggagccccgagcctacccctgggagcccagaggccgcccccagaaaccctgagcctaccccccgggaccggctgtttggaggctcacaggggcccctcccctatggcagcacccacgctctcagggtgaggcttcgaggccctggcgcacctcaatgaagacgtcgcccacgatcttggcggtcatgagcaccagcatgatggggaagccgtaggtcacgttgctggtggcctccatcatgatgacggtcaggctcagt

SEQ ID NO: 178697 - DNA, 601 bp, Human
cctgcaaaccttgccgtgtgcttcccaccaatggactcgacagaggtcacataggcaggaccctgtctatggggtgcccggtacctgggtgtcatcggcatgctccaccacggggaagccgttgtgattggacgccgtgtcgctcagcacgtccacaatgacgccgaccttctcacgccgcctcaggcaggtcactggtgtgctcatcacctccctgccggaggagcccggccacacatgcccgtcacacgccaccaactcccacagttacctctgcgggctggtgaggtgtgaagccgcyggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggcggggcgggaacacagggcttgaggagtccacacccacccctggagccccgagcctacccctgggagcccagaggccgcccccagaaaccctgagcct

SEQ ID NO: 178698 - DNA, 601 bp, Human
gcttccggcactcctggaactgccagtgcacccaaacgtgcagcttccccatcctgcaaaccttgccgtgtgcttcccaccaatggactcgacagaggtcacataggcaggaccctgtctatggggtgcccggtacctgggtgtcatcggcatgctccaccacggggaagccgttgtgattggacgccgtgtcgctcagcacgtccacaatgacgccgaccttctcacgccgcctcaggcaggtcactggtgtgctcatcacctccctgccggaggagcccggccacacatgcccgtcacrcgccaccaactcccacagttacctctgcgggctggtgaggtgtgaagccgctggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggcggggcgggaacacagggcttgaggagtccacacccacccctggag

SEQ ID NO: 178699 - DNA, 601 bp, Human
tgcacactcagcttccggcactcctggaactgccagtgcacccaaacgtgcagcttccccatcctgcaaaccttgccgtgtgcttcccaccaatggactcgacagaggtcacataggcaggaccctgtctatggggtgcccggtacctgggtgtcatcggcatgctccaccacggggaagccgttgtgattggacgccgtgtcgctcagcacgtccacaatgacgccgaccttctcacgccgcctcaggcaggtcactggtgtgctcatcacctccctgccggaggagcccggccacacaygcccgtcacacgccaccaactcccacagttacctctgcgggctggtgaggtgtgaagccgctggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggcggggcgggaacacagggcttgaggagtccacaccc

SEQ ID NO: 178700 - DNA, 601 bp, Human
gctttgctgcagggcagatgcagccccactgggtcccaataaaaaccaacctccaaacacccagtgtccacgtctaaaagacacacagcagtggccgagctgtgtgtcctgtcagggcctcctgacaaagtcacggcccccagtgccacggctctcagcccagcctgggtgccaaccccaagaccctgccaggccgcagccccccccaccagcctcagcgtccacacagccctccatggctgcacactcagcttccggcactcctggaactgccagtgcacccaaacgtgcagcttccccrtcctgcaaaccttgccgtgtgcttcccaccaatggactcgacagaggtcacataggcaggaccctgtctatggggtgcccggtacctgggtgtcatcggcatgctccaccacggggaagccgttgtgattggacgccgtgtcgctcagcacgtccacaatgacgccgaccttctcacgccgcctcaggcaggtcactggtgtgctcatcacctccctgccggaggagcccggccacacatgcccgtcacacgccaccaactcccacagttacctctgcgggctggtgaggtgtgaagccg

SEQ ID NO: 178701 - DNA, 601 bp, Human
ccccctgctgttcagtcccaggccccacgcccatgcccatgccctgcacatgcctggggcaccgtgtagggggaggggttcatgaactcggagaggtccatggtgcactcccgctcgtcctgggacacgtggatggactggatgggtgggaagcgcgggtaggcgtctcggaagtccttcagcctcaggcgccgctgtaccaggcccaggttggaccgctccacaaacacctgcgggcggcagagccctgtgtcaggcacccaggcagcacccccggggcccccacccgcccaatggcccrgagcctggcacgcaccttgtgctttaggagaacgatgagctgggagcgcaggatcaggccctggagccgggcaggctgcaagacaggcccgcggtcagggccacgggcccgagggtgggaggctgcgctggaatgctgtgtcgggccccgctctgaccctgttccggccagatttcccatctgggcatgggccccgtgtcggtggctacctgctcacaccagcctcgccatggcatcccacacgcacaatgccacgggacccaaggatcggcgacagggtagcggggcctgaccgcgcac

SEQ ID NO: 178702 - DNA, 601 bp, Human
gcccccgagctgagcacggggctggggaggggtgcagccatggggcatgggccgactcggtgctgggtcctgtgcttccgtgtcccctgccgggagctgagagtaagcacgggcaggaggcagaggggagccctgcacggcatgcctgcacccccaccgcccccgctcacctgattgcggttgtccaccaccaccaggtgccgcaggcccagggcccggaacagcttgaacacccgtgggagcgacgcctcctgcagcaggggcacagctgtcagtgcccgcccacacagcagaggcaggygggaccctcacccaagctggctccctgcaccccccaccacggcgtccaggcacgtcctgagcccccacgcccgtctggccagccccctcagccccttgacttcagctctaaagcctgccaggcccttcacaggagacagagtcaccgagtcctctccgctgtggccccccccggctgcccctccccgaggctctggaccccaccccctgctgttcagtcccaggccccacgcccatgcccatgccctgcacatgcctggggcaccgtgtagggggaggggttcatgaactcggagaggtc

SEQ ID NO: 178703 - DNA, 601 bp, Human
gctggctcccaagaggccgatagcccggtagggaggtcacacacacacagctgatccctggaggtaaagaaacctagacgaggagagtggaggctgggcctgcgcaaggaggcgccaaggggggagaccactgcccacaacagggtcagtcccgcgagagggtcagttccgcgcctgccgcctgcccgcccagctgcagggtgctcgccattgccactgctggggagcatggtttgggccgagaaaccagtgactccgggaggaaatgcagaagggccggggtgccagcgccagtgcccaytatgggcagggctgggcctcacgtctgggccagcgagagctcctccaagcctctctttcccaggcggtacctggcgaggtccttcctggtcaccaacccgacaacctgcaggacaagtccaggccacagtgacacacgggtcggctcccgcctgcctgtggagctccctgccttgtgtgtggctggggcagcacaggcagggggccctgggggcttcagcacagcccccgagctgagcacggggctggggaggggtgcagccatggggcatgggccgactcggtgctgggtcctgtgctt

SEQ ID NO: 178704 - DNA, 601 bp, Human
ctggcccccgctgcacctgcgcttggtggctggcaggggcggggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctgggggttgggggaccaaggcagggctgggcatggggctcagggccttggaggtttttctcagctctcaacatcacagcacagggcccgtgagtcaccccagtcctctgggccygtgtacccaagccggatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactccactggtgtggaggcagaggggcccttccagggcagggcagccctcggggcagcagcaggggcaagggctctgtctcacgcacacgggcacaggcacgcaggtgccgg

SEQ ID NO: 178705 - DNA, 601 bp, Human
cctcccaggggccctcaggtggtgaggtgggggcttcccggccccggtgcccaccggcccttctagctgcctgtgctgggccaggtgtcctctgaggccggcaggagtctggcccccgctgcacctgcgcttggtggctggcaggggcggggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctggggrttgggggaccaaggcagggctgggcatggggctcagggccttggaggtttttctcagctctcaacatcacagcacagggcccgtgagtcaccccagtcctctgggcctgtgtacccaagccggatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactc

SEQ ID NO: 178706 - DNA, 601 bp, Human
cactccctggggaggaaatacacggcagggggccgcacccagccccccacggagggacccgtgttgctctaacagggacactgaagttgcctctgccgccccgtgaggggcctgtggcggccccagacccagcccagccaggccagaggagcctcccaggggccctcaggtggtgaggtgggggcttcccggccccggtgcccaccggcccttctagctgcctgtgctgggccaggtgtcctctgaggccggcaggagtctggcccccgctgcacctgcgcttggtggctggcaggggcgrggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctgggggttgggggaccaaggcagggctgggcatggggctcagggccttggaggtttttctcagctctcaacatcacagcacagggcccgtgagtcaccccagtcctctgggcctgtgtacccaagccggatgcaggccggggagtgcacgtgggg

SEQ ID NO: 178707 - DNA, 601 bp, Human
ccactccctggggaggaaatacacggcagggggccgcacccagccccccacggagggacccgtgttgctctaacagggacactgaagttgcctctgccgccccgtgaggggcctgtggcggccccagacccagcccagccaggccagaggagcctcccaggggccctcaggtggtgaggtgggggcttcccggccccggtgcccaccggcccttctagctgcctgtgctgggccaggtgtcctctgaggccggcaggagtctggcccccgctgcacctgcgcttggtggctggcaggggcrgggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctgggggttgggggaccaaggcagggctgggcatggggctcagggccttggaggtttttctcagctctcaacatcacagcacagggcccgtgagtcaccccagtcctctgggcctgtgtacccaagccggatgcaggccggggagtgcacgtggg

SEQ ID NO: 178708 - DNA, 601 bp, Human
cttcttcagctgccgagggaggggaaggaggccctgacgaggcctgggcacgccgggagggacgctgggagcagggaggccgagagccccaggacaccccggacacagccaggcccacgtccgagcggagcccgaggcctgggcagcgccatcggggtgaggggcacagccgggctccacgggaacccatcttgctcagcagccccattaaaaggcaagaagcagcgatgtgaatcctaaccgctgattttatttaaccgaatatatccaaaatatgatcacttccaggtcctcagtacasaaccaccacgagggaaacccagacctaggtttccggcgccgactctgaggcccgggagttttcttcttgcgtcaccccagcgtgggcaccccggcccgcccccctccacctggagcgcctctgccttgccccccagacccaccagccaggagccagaggagggaggctgaggggcggggacgaggaagaggatgtggctggtgccctgggtggccgcagccgctgtctttcacgcctgtctcactccacacggtgccccgaccccagggtcccgaaagtcccaggctgttggacgtggtc

SEQ ID NO: 178709 - DNA, 601 bp, Human
aaaaaaaagccaggcacagtggctcaagcccgtagtttcagcacttcgacagctgaaggcaagaggatcagctcagcccaggagtttgaaatatggcccagaaagacagttcctgtgagatacacacacagagacggaagaggtgaatttgggtcggggttggggggtggggataggaggggtgcttgggtcccgttgtcctttctctaaccttggtagatgtcctggagagaaccagccccacagaattccatgcagatccagagtttctgcaacctgcagtggttcaagagtaagaatrataatagcagtaaatacattattatttgcaggaaagcccctggtttgcttctgtcttgttctagttcaataagaactttaacgtaacagctctcatcactccacctctccttgtctaccagagtgaggttgtttcattcccattttacagacaaggaagttaaggctcagagaggaaatgtgagttccggggcaagtcaactcaaacctaggcctttgggcgggaccccactgccgtcccacgccaacctaggaggcagggcagagatctcacgggttgtggagatttggaggggacaga

SEQ ID NO: 178710 - DNA, 601 bp, Human
ggggagacgcagcacacagagagtcagatggagagacagagggacaggagtaaagacagacacaggcagatgaagacagagatgcagacggggcgcgatggctcacgcctgtaatcccagcactttgggaggctgagcaaggagaatggcttaggcccaggagtttgagaccagcctgggcaacttatcaagaccctatctcggctgggcacggtggcttttgcctgtaattccagcactttgggaggtcaaggcggacagatcacctgaggtgaggagttcgagaccagcctgaccaacmtggtgaaagcccgtctctactaaaagtacaaaaattagccgggcgtggtggcaggcgtctgtaatcccagctacttggtggctgaggcaggagaattgcttgaacctgggaggtgaaggttgcagtgagctgagaccatgccactgcactccagcctgggcaacagagcaaaactccgtctcaagaaaaaaaaaaagaacgaaaaagaaaaaaaaaaaaaaacaacaccatctctacacaaattttaaaaattagccaggtgtcatggtgcacacctgtggtcccagctacttgggaggc

SEQ ID NO: 178711 - DNA, 601 bp, Human
aggcactagggactttggaaaggccacggggactccatggaacaaagttatccatgtcctcgggagttgtggaaggccccagggaatcctaggctgaggatcttggggaagggagggttacactgagcatcttggtggcgctgggtcgtttcttgggactcttagtcagagtgactttgatgaagttgtggaaggcagccgaccttgggaagaagaagccaggttctggatgaggggaccagaaaccctcccatcaggccacccagccccagccctgccctctctcaccctccctcctgtyactctctcgtaccatttgcctttttccttcagtcggggaggctggtagccactcttggtcatgaggaagagaactctagaatagtagggaaaggacatggggttcagaccctcaagggggccagacctcatggcttgaggggttcctagtagcattgtggtcagcagagggcaaagtgagaaacagcatggaagtgaggttcaggttttacagtgcaccagggtgcctctcctaagggaagccatttatgaagtgatagagctatggcaaggccaggtgtggtggttcacgcccgtaatc

SEQ ID NO: 178712 - DNA, 601 bp, Human
ctccctccctgttttccccctaagagaggcagcaggaaggcactgctggcagcaggcacagcctgagaaagaccgagaggtccccagtgctcttgtcagccaaggctctcacctcgggctcctcatcctcaatgtccccaatggagggtcctttcccgggattcttcagtttgtcaagaagatccaggatcaggcctcgattcagcccaggctgggataccagttgatgctggcggagggaagaggtgtccgtatccagagggatggtgtggacagagagggctggtgtggacagagaggrctggtacagggccttggggactggactaaaggaatctagctggggagaaggtgccagtgaaggcagagggcggggaaatccagggaactcagaggcctggggtattcttttttgtttgtttgttttaagacagagtctcactctgtcacccaggctggagtgcagtggcacaatccaggctcactgcaacctccacctcctgggcttaattgattctcgtgcctcagcctcccgagtggctgtgattacaggctcgtgccaccacgcccagctaattttttttttttttttttttttttt

SEQ ID NO: 178713 - DNA, 601 bp, Human
tccccatcctccctggggtccctgacctggggctgctgctcctgaggtctcgaggaggctgtaggcgagcctgtggggtaggaaaagggtcagcagtggcctcagggaagcaggcggtgtggtggggagtggggggacagcatctcacggtgttggctgggggtctggtctccattcctcggagcttcctgaactccatgtgccgccctagggtgggtgggggaagataacctgctgtgagctgggggcaaggggtaacgagatgggtttaagaacagaaagagtagaattggcgggggggttgcagtcaggatcttggggactgcaaatgatctcagggaactgtcccttggggaaaggggtcttggattacagggacttcatttgggggtcaagtttgggatcaagaccaggtgcagtggctcacgcctataatcccagtactttggaaggctgaggtgggcagatcgctggaacccagagtttgagacctgcctggacaactgggcaagaacccatccctacaaaaaatgattaaaaattagccaagtgactgggcacagtggctcacgcctgtaatcccagcactttgggaggtgag

SEQ ID NO: 178714 - DNA, 601 bp, Human
catatacatatatacacatgtacatatatacttatatacacatgtacatatatacacacatgtacacatatacgcatatacatatatacacatacatatatacacacatatacacatgcacatatatacgcatatacatatatacatatacatatatacacacatatacatgtatacatatatacacatgtacatatatacgcatatacatatacacatatacatatatacacatgtacatatatacacatgtacatatatacacatgtacatatatacacatatacatatatacacacayatacatgtatacatatatacacatgtacatatatacgcatatacatatatacacatatacatatatacacacatatacatatatacacatgtacatatatatgcatatacatatatatacacgtatacatatatacacacatatacatgtatatgtgtgtgtatatatgtatatgtatatatgtatgattaattatgctatgcatttcatctttgaatcatttccagtgctggaggtataaattatacatacttttagccggtagccaaccaggcacggctgtaatcccaccagtttggg

SEQ ID NO: 178715 - DNA, 601 bp, Human
tatatacacatatacatatatacacatgtacatatatacttatatacacatgtacatatatacacacatgtacacatatacgcatatacatatatacacatacatatatacacacatatacacatgcacatatatacgcatatacatatatacatatacatatatacacacatatacatgtatacatatatacacatgtacatatatacgcatatacatatacacatatacatatatacacatgtacatatatacacatgtacatatatacacatgtacatatatacacatatacatatayacacacacatacatgtatacatatatacacatgtacatatatacgcatatacatatatacacatatacatatatacacacatatacatatatacacatgtacatatatatgcatatacatatatatacacgtatacatatatacacacatatacatgtatatgtgtgtgtatatatgtatatgtatatatgtatgattaattatgctatgcatttcatctttgaatcatttccagtgctggaggtataaattatacatacttttagccggtagccaaccaggcacggctgtaatcccacc

SEQ ID NO: 178716 - DNA, 601 bp, Human
atacgcatatacatatatacacatatacatatatacacatgtacatatatacttatatacacatgtacatatatacacacatgtacacatatacgcatatacatatatacacatacatatatacacacatatacacatgcacatatatacgcatatacatatatacatatacatatatacacacatatacatgtatacatatatacacatgtacatatatacgcatatacatatacacatatacatatatacacatgtacatatatacacatgtacatatatacacatgtacatatatacrcatatacatatatacacacacatacatgtatacatatatacacatgtacatatatacgcatatacatatatacacatatacatatatacacacatatacatatatacacatgtacatatatatgcatatacatatatatacacgtatacatatatacacacatatacatgtatatgtgtgtgtatatatgtatatgtatatatgtatgattaattatgctatgcatttcatctttgaatcatttccagtgctggaggtataaattatacatacttttagccggtagccaaccaggcacgg

SEQ ID NO: 178717 - DNA, 601 bp, Human
acatgtacatatatacgcatatacatatatacacatatacatatatacacatgtacatatatacttatatacacatgtacatatatacacacatgtacacatatacgcatatacatatatacacatacatatatacacacatatacacatgcacatatatacgcatatacatatatacatatacatatatacacacatatacatgtatacatatatacacatgtacatatatacgcatatacatatacacatatacatatatacacatgtacatatatacacatgtacatatatacacatrtacatatatacacatatacatatatacacacacatacatgtatacatatatacacatgtacatatatacgcatatacatatatacacatatacatatatacacacatatacatatatacacatgtacatatatatgcatatacatatatatacacgtatacatatatacacacatatacatgtatatgtgtgtgtatatatgtatatgtatatatgtatgattaattatgctatgcatttcatctttgaatcatttccagtgctggaggtataaattatacatacttttagccggtagcc

SEQ ID NO: 178718 - DNA, 601 bp, Human
atacacatgtacatatatacgcatatacatatatacacatatacatatatacacatgtacatatatacttatatacacatgtacatatatacacacatgtacacatatacgcatatacatatatacacatacatatatacacacatatacacatgcacatatatacgcatatacatatatacatatacatatatacacacatatacatgtatacatatatacacatgtacatatatacgcatatacatatacacatatacatatatacacatgtacatatatacacatgtacatatatacrcatgtacatatatacacatatacatatatacacacacatacatgtatacatatatacacatgtacatatatacgcatatacatatatacacatatacatatatacacacatatacatatatacacatgtacatatatatgcatatacatatatatacacgtatacatatatacacacatatacatgtatatgtgtgtgtatatatgtatatgtatatatgtatgattaattatgctatgcatttcatctttgaatcatttccagtgctggaggtataaattatacatacttttagccggt

SEQ ID NO: 178719 - DNA, 601 bp, Human
tcctggtcattccggttcaggatgaagatgccttcctctgcccccaggagcaggtgctggtctggaggcacagacaaggacgctgggaccgacttcatcctcagggacctcccagatccccacctgtctgacctcaaacactgacactctgtccccagctctgaccctctattctttctccaaaccaatactcccagcctctgtttccccaaacaaagccagagcggacggtcccgcaagccagtctcactctccctccttttgactacccatattctggtggttctttcttctctgcccractgtcttctgaaccaaactgaccccaaccttagacctgtcccccaaaatagtcctctgatttcctcccctctttctccccagttctgataccctaatgccaatcctaacattgaccttcaaactcagacacccccaaacaggactttttctgtccagtgtgacctgttcctttaacactgaccttgtcttcatctctttgatctctagattctgtccctttctggctgcatcctaatctctaaaattcctcaccccaaaatgctgctcccagtctccctatcattaacctccagctgtc

SEQ ID NO: 178720 - DNA, 601 bp, Human
cgaacacggacagaggcgtcggcagtgggaacagcacctgctgcgggccgcacagggaggggcgggctagggggtggttcaggacggggcctcagggggcgtggcttgtagctggcctgggacttccgaaccagggccctaagtcttgggggatgccgtctagaaatgtcaggggataaggcctggtgcctccgcgggaacgggggtcgtgacctccgagtgggtgtggcttccatgtgggggcatgccaccttggcggcagacgggcagggccccaaagatagcaaaacctgcttagacrctcaaagagacaggctctaaatgggctctactaggacacccagggagtggcagcattgagcctgaggaataattaggcccaggtgtgaggggcggcgcttaaggatcaggatggcttcagaaggacgaggctccaagcgcagaccgcaggtgggcggggcctcgggagattggggcggggcctcgacggaggtggggcttcatggagctcttgatagaagcgcaaagggtgcaaggccttagccacccactcctcagagttcccagcaccctcccaagccccttacccggacaagcagga

SEQ ID NO: 178721 - DNA, 601 bp, Human
ggagtgtacctgtaatcccagctactcgggaggctgaggcaggagaatcacttggacccaggaggcagaggttgcagtgagctcggatcatgccactgcactctgccctgggtgacagagcgagactctgtctcaaaaaatatataaaaatggccaggagtggtggctcacacctgtaatcctagcactttgtgaggccaaggaaggcagattggctgagctcaggagtttgagactagcctgggcaacatggtgaaaccctgtctctactaaaaatacaaaaaaattagctaagcatggmggcatgcacctgtagtctcagctactcaggaggctgaggcaggagaattctttgaacctgggaggcagaggctgcagtgagccgagatcgcgccactacactccagcctgggtgacagagcaagaatccatctccaaaaataaataaattttatctatctatctatctatctatctatctatctatctataaaataggccgggtgtggtggctgacagctgtaatcccagcactttgggaggccaaggcgggtgaatcaccccaggtcaagagttcaagaccatccagcctgatgaacat

SEQ ID NO: 178722 - DNA, 601 bp, Human
cagggctgggcacggtggctcatgcctgtagtcccagcactttgggaggccgaggcgggcagatcacctgagatcaggggttcaagagcagcctggacaacatggcgaaagcctgtctctactaaaaatacaaaaattagccgggcacagtggcacatgcctgtaatcccagttactcgggaggctgaggcaggagaatcgcgtgaacccagtgggtggaggttgtggtgagctgaaatcacgccaccgcattccaggctgggcaacagagcaagaatccgtctcaaaaaaaaaaaaaaaatgcagccaggtgtggtggctcatgccagtaatcctaacattttgggaggccaaggtaggaagattgcttgaggccagcagttcaaggacagccagggcaacatggcaagaccccgtctctacaaaaaaattttaaaaattagccagttgtggtggtgtatgcctgtggacctagctacttgggaggctgaggtgggaggatcagttgagctcagaaggtcaagactgcagtgagctgtgtgtgtaacactgcacttcagcctgcgcaacagaatgagaccttgtctcaaaaatgaaataa

SEQ ID NO: 178723 - DNA, 601 bp, Human
gttatttttaatagttaaaaatttttaataagataaaaatctaaaataaaaatgcagccagggctgggcacggtggctcatgcctgtagtcccagcactttgggaggccgaggcgggcagatcacctgagatcaggggttcaagagcagcctggacaacatggcgaaagcctgtctctactaaaaatacaaaaattagccgggcacagtggcacatgcctgtaatcccagttactcgggaggctgaggcaggagaatcgcgtgaacccagtgggtggaggttgtggtgagctgaaatcacrccaccgcattccaggctgggcaacagagcaagaatccgtctcaaaaaaaaaaaaaaaatgcagccaggtgtggtggctcatgccagtaatcctaacattttgggaggccaaggtaggaagattgcttgaggccagcagttcaaggacagccagggcaacatggcaagaccccgtctctacaaaaaaattttaaaaattagccagttgtggtggtgtatgcctgtggacctagctacttgggaggctgaggtgggaggatcagttgagctcagaaggtcaagactgcagtgagctgtgtgt

SEQ ID NO: 178724 - DNA, 601 bp, Human
ctggccaggtacagtggctcacgcctgtaatcccagcactttgggaggcagaggtgggtggatcacctgaggtcaagagttcgagaccagcctaaccaccatgatgaaagcccacatctactaaaaaaacaaaaaaattagctgggcgtggtggtgtgcaactgtagtcccagctactcaggaggttgagacaggagacttgcctgaacccgggaggcagaggttgcagtgagtggagatccactgcactccagcctgggccacacagcaagactccatctcaaaaaaaaaaaaaaaaaaagatctggttaatctggataaaagggatttttgcaacttctctgggagtgtgagttttaaattatgtcaaaatagttaaaatagttatttttaatagttaaaaatttttaataagataaaaatctaaaataaaaatgcagccagggctgggcacggtggctcatgcctgtagtcccagcactttgggaggccgaggcgggcagatcacctgagatcaggggttcaagagcagcctggacaacatggcgaaagcctgtctctactaaaaatacaaaaattagccgggcacagtggcacatgc

SEQ ID NO: 178725 - DNA, 601 bp, Human
gggaagcctacacaggtgaatctcttgagtccaggagttccagaccaggctaagtaacatggcgaaaccctgtctgtacaaaaaatacgaaaataagccaggtgtagtggtacgcgcctgtcatcccagctacccgggaggttgaggtgggaggactgattgaacccaggaggtcgaggctgcagtgagccatgatcgcgtcactgcactccagccagggtgacagagagagaatctatctttaaaaaaaaagaaaaagggagaaaaaagcaacttcacagtggagagaactggctgattstaccttaaccaaatgaccgaagttaatatcaccagtaatgggacaaactagcattgtgtacttcctgaaatgatgcactgagaaagacatctttctgcagtattcctgcccaaaatgcagaacgtggaaacctcaaacacagtcaaggaacattctagaaaacaactttcctttactcttgaaaaaggtcaaagctcattaaagacaaaagaagtctaaataattgttccaggctaaataataaagaaacatgactcctaagtgcaacctatgatcttggaccagaaaaaaaaaaaaaaa

SEQ ID NO: 178726 - DNA, 601 bp, Human
tcaaaaggacacaggggctacttaaagtggttcccactggctaaatttaagaccatttgtgcctcaaaataaataatgacaaggccgggcatggtggctcatgcttgtaatcccagcactttgggaggccaaggggggcagatcacttgaggtcaggagttcaagaccagcctggccaatatggtgaatcccatctctactaaaactacaaaaattatccaggtccatcctggctaacacggtgaaaccccatctctactaaaaatacaaaaaaaaattagccaggtgtggtggcaggcactatagtcccagctactcgggaggctgaggcaggagaatggcgtgaacctgggagccagagcttgcagtgagccgagatagcgccagtgcactccagcctgggcgacagagcgagcctctgtctcaaaaaaaaaaaaaaaaatttatccaggcatggtggtgcacgcctgtaatcccagctattcgggaggctgaggcaggaggatcgattgaacctgggaggcagaggttgcagtgagctgagatcacaccactgcactccagcctgggtgacagagcgagactccatctcataaataaa

SEQ ID NO: 178727 - DNA, 601 bp, Human
cgaaccagaatttggcagctctgctggactttttcagtttaagtaattacgttaggatgtacctcccagttacctggcctcttgctacctctggtgcttactctgagctgggacatggcctcttgctacctctggtgcttactctgagctgggatgtgccatttaacctttgaaacagccgggtgcggtggtgaagttacttgccttgcccgaggtcactcggtagtagtaattgacaaagccaggtctcactgcagaggccttctctgttcagagtggcctacctgactgctgctgccgrctggacctactgacctttcagaagtactagtgtctgactgggtgaactcatgccctcactcatcgtaagttctgtttgtttgaaagcttgaacagcttaatcggaggcagaaggcagttttgacttttttttcctcgctccttcctgattgcttctgttttctccggaagcgagtcatccactgggagtgtggtgttgctgaagctccatgcagtggctcaggtgctgctggatgagtgtggtggtgagggaggagtgaacagagaatgtgtgagggagggaggatgggggttggtcaag

SEQ ID NO: 178728 - DNA, 601 bp, Human
tgaagctccatgcagtggctcaggtgctgctggatgagtgtggtggtgagggaggagtgaacagagaatgtgtgagggagggaggatgggggttggtcaaggaatttattctgtatgaaaacatgagggggcggagggccgaggtagatggtagggccagcagattgttggagttgaggttctgaagggaatgaaccagacagataggatgcagtgggtagtgagtgagatgcatgagagggaggttctgaagaggtggcagttactgagacaggtctaggtgtgaccctgagaggaagcgggggggcgagggtgggaggagatcaggtggaggtcttgggacctagaggtcagaggaccatctacctggatatagaaatctccaagaatgatcataagagcagcgggagaggtggcaggcccggagctaaagttgggaaggaagaagtagttgtctgggttggcagataacgtgccaggcggggtagtgaatgatttactctaataatggaagtctcccagctggggattttggggagggtggagggagaacagtccagaagcagctcccaggagcaaggagacctccccacttggaagg

SEQ ID NO: 178729 - DNA, 601 bp, Human
acaaagagtgtcctgactccaacctctgcagacagaggtggggggaaagctgagcttatgccaggtgagaaagctcccctatctagcgttagggacagttaccgtctggagtggaaagcacgcagagattataaactgtccactcccaggaagcttcacacagcctttatgtgacttgtactttttccagaattgggattttttaaacgtaaaaatgtagtttttggctttgcctgaaagacatgaagatgtaatggaaccaaaccagaacacaggcctgttttcctgcccagcagtcccyggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgcgcgtgtgtgtgtgtgtgtgtgtgtgttacggctggctgttggggaaatccttatatcaggtagctgcagatatgca

SEQ ID NO: 178730 - DNA, 601 bp, Human
ttggctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgctcgcgtgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggct

SEQ ID NO: 178731 - DNA, 601 bp, Human
tggctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgygcgtgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggctt

SEQ ID NO: 178732 - DNA, 601 bp, Human
gctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgcgygtgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggcttaa

SEQ ID NO: 178733 - DNA, 601 bp, Human
ctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgcgcttgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggcttaag

SEQ ID NO: 178734 - DNA, 601 bp, Human
ggcacctgccgccacgcccggctaattttttgtatttttagtagagacggggtttcaccgtgttagccaggatggtcttgatctcctgaccttgtgatctgcccgcctcggcctcccaaagtgctgggattacaggcgtgagccaccgcgcccggcctgagatgggatttcaacatgtgggccaggctggtctcgaactcccgacctcaggtgatctgcccacctcagcctctcaaagtgctgggattacaggctcgagccacgtggcccagccctctcctgcacttccaagggattttcraaatgcatggacctctcaggttaattatagtgtctgtagaaccttaactgctgtaagctttccagcagactccacagacgtgttattagttgccaccctttctttactttcctcctcacccccatggatagtcgtgaccctggtggtcagagataagatgacagaagagctaaagtaaagctggtgttggcgatcagctgggaattctctaaaacagcttctcacattattcttatcctccatagaaggagtgcttgtcctacttgcaggcaaggcagtttggttccagggtagttcgaa

SEQ ID NO: 178735 - DNA, 601 bp, Human
ctgccgccacgcccggctaattttttgtatttttagtagagacggggtttcaccgtgttagccaggatggtcttgatctcctgaccttgtgatctgcccgcctcggcctcccaaagtgctgggattacaggcgtgagccaccgcgcccggcctgagatgggatttcaacatgtgggccaggctggtctcgaactcccgacctcaggtgatctgcccacctcagcctctcaaagtgctgggattacaggctcgagccacgtggcccagccctctcctgcacttccaagggattttcgaaatscatggacctctcaggttaattatagtgtctgtagaaccttaactgctgtaagctttccagcagactccacagacgtgttattagttgccaccctttctttactttcctcctcacccccatggatagtcgtgaccctggtggtcagagataagatgacagaagagctaaagtaaagctggtgttggcgatcagctgggaattctctaaaacagcttctcacattattcttatcctccatagaaggagtgcttgtcctacttgcaggcaaggcagtttggttccagggtagttcgaaatctt

SEQ ID NO: 178736 - DNA, 601 bp, Human
taaagtaaagctggtgttggcgatcagctgggaattctctaaaacagcttctcacattattcttatcctccatagaaggagtgcttgtcctacttgcaggcaaggcagtttggttccagggtagttcgaaatcttattcactgatatagtcagcaaatgtttattgagcacccaccaattgccaggcactgactcactcaaattagagcactgaacaaaatagaccccctcccccatccgtggcagacgtgtcataatgagaggaagacagtacaataaatgaacagatgaatgtatgtcyggtgatgagtgtcagggttggtgtgcttagcactgaaaatgggggcttctgaggttcaaatggttgcagttcctaaagaaggttgagggccttgccttcaggtcaccgcgggagactggcccctttccactggaaacattgctttgcccagtcagtatttgagagctcagcctgcaatggagaaatcacacttctcctctttcaccctgctccccaccctgtttctcattttacccatccccagccatttgcagaatgcatgcagagcttctgtttgccatgtctggaggctacagggga

SEQ ID NO: 178737 - DNA, 601 bp, Human
tctgtttgccatgtctggaggctacaggggaggctgaataaggggtgataagcctgtggctcatgtgaggcgggagagagcccagcaggagtcacactgaaatgactccattagccccaggaggccttggcccaccggccatgactaatgtggacattagagtgtggattccgatgtcctgcaagatcctcctcacaagtgtcatttcatggtttttttctggcaacatctttttgaaaactccctgtaaagaagtgctgatgttgatgctgaggcccaggaactttggagtttatttacytttttttgttgttttattttccttggcaggtgaagtaggagctagagtttacttattttgaagtttatttgaaatatgctttttatgattagaagccattttagaaatgagggcgaggccgggcgcggtggctcatgcctgtaaccccagcactttgggaggccgaggcaggcgggtcacgagatcaggagatcgagaccatcctggctaacacggtgaaaacccgtttctactaaaaatacaaaaaaattagcctcgcgtggtggcgggcgcctatagtcccagctatctgggaggcta

SEQ ID NO: 178738 - DNA, 601 bp, Human
tttgccatgtctggaggctacaggggaggctgaataaggggtgataagcctgtggctcatgtgaggcgggagagagcccagcaggagtcacactgaaatgactccattagccccaggaggccttggcccaccggccatgactaatgtggacattagagtgtggattccgatgtcctgcaagatcctcctcacaagtgtcatttcatggtttttttctggcaacatctttttgaaaactccctgtaaagaagtgctgatgttgatgctgaggcccaggaactttggagtttatttacttttytttgttgttttattttccttggcaggtgaagtaggagctagagtttacttattttgaagtttatttgaaatatgctttttatgattagaagccattttagaaatgagggcgaggccgggcgcggtggctcatgcctgtaaccccagcactttgggaggccgaggcaggcgggtcacgagatcaggagatcgagaccatcctggctaacacggtgaaaacccgtttctactaaaaatacaaaaaaattagcctcgcgtggtggcgggcgcctatagtcccagctatctgggaggctaaggc

SEQ ID NO: 178739 - DNA, 601 bp, Human
ggtgggtgggtcactgagcacaggtcaaggctactgtgagccaagattgtaccactgtactccagcctgggtgacagggcaagtccctgtctcaaaaaaaaaaaagaaagctgtgtgctaaatactattttaagcaattataatggattaaaaactcctttaatcttcacaacaatgttttttctttctttttttttgagatggagttctttgaaactcttggattaaatgactcttcagagctttctttgctttttgatactaaggagtggcatgtctggggatttttatagcaaataayttctccttggctactatccttagaattccaagtgtttttaatgaaaagaggagacttgtttttagtgatgttagttgtttttaggaaaggtgttctgcagtgtttttcgctaaggtggctcacgcctgtaatcccagcactttgggaggccgaggtaggcagatcacttgaggttaggagtttgaggccagcctggccagcacagcaaaaccctatctactgaaaatacacaaagtagccaggtgtggtagtacactcctggagtcctagctactcaggaggctgaggcaggagatgact

SEQ ID NO: 178740 - DNA, 601 bp, Human
ctggagagactctggatctgcagccagggagcttgtgaaggcttcttgtccacggaaatgagggcggcagttgtgactttctggatggtggcccagaggaagcaacactggcagagcctcttctgtgaagcagctctgagagcaattttgtgacattgaaagagcaaaggataaaacgttgaaagctgatccagatctagaaaagtgtttggcaattgctggaaaaggtgtagaaatgatgcttgctctgtatcgtaagttatatggtgagaagaccacaagcacggttcaaactcccctyagaaattcttttgcacagaaattaacactttaatcctaaatgtttccaatgttttaacttacagtatgctaaataaacattctttctgtttgtttgttttgttttgttttgttactctgtgcatttatagccaatagagtttttctttccttatttttttgacacagggtcttgctctgtcgcccaggctagagtgcagtggtgcgatctcagctcactgcaacctccgcctcctgagttcaagtgattgtcccgcctcagcctcccgagtagctgggactacaggcgcgcgccactgtg

SEQ ID NO: 178741 - DNA, 601 bp, Human
atgatgcttgctctgtatcgtaagttatatggtgagaagaccacaagcacggttcaaactccccttagaaattcttttgcacagaaattaacactttaatcctaaatgtttccaatgttttaacttacagtatgctaaataaacattctttctgtttgtttgttttgttttgttttgttactctgtgcatttatagccaatagagtttttctttccttatttttttgacacagggtcttgctctgtcgcccaggctagagtgcagtggtgcgatctcagctcactgcaacctccgcctccygagttcaagtgattgtcccgcctcagcctcccgagtagctgggactacaggcgcgcgccactgtgccgggctaagttttatatttttagtagagatggggtttcgccatgatagccagggtggtcttgaaatcctgaccacaggtgtgagccactgtatctggccaaaaaaatttttttattttttgtagagacagggtctcactatgttgcccaggctggtcttgaactcgtgacctcaaatgatcctcctgcctcggcctcccaaagtgctgggattataggtatgagccaccatgcc

SEQ ID NO: 178742 - DNA, 601 bp, Human
gtcccgcctcagcctcccgagtagctgggactacaggcgcgcgccactgtgccgggctaagttttatatttttagtagagatggggtttcgccatgatagccagggtggtcttgaaatcctgaccacaggtgtgagccactgtatctggccaaaaaaatttttttattttttgtagagacagggtctcactatgttgcccaggctggtcttgaactcgtgacctcaaatgatcctcctgcctcggcctcccaaagtgctgggattataggtatgagccaccatgcccagcttgacaaaaawatttttttttttttttgagagatgaagtttcactcttgttgcccaggctggagtgcaatggatcagctcactgcaacctgtgcctcctgggttcaaacgattctcctgcctcagcctccagaatagctgggattacaggcatgcaccaccacgcccggctaattttgtatttttagtacagacggggtttctccatattggtcaggctggtctcgaactcctgacctcaagtgatccacctgcctcggcctcccaaagtgctgggattacaggtgtgagccaccacgcccagctgacaaa

SEQ ID NO: 178743 - DNA, 601 bp, Human
tcccgcctcagcctcccgagtagctgggactacaggcgcgcgccactgtgccgggctaagttttatatttttagtagagatggggtttcgccatgatagccagggtggtcttgaaatcctgaccacaggtgtgagccactgtatctggccaaaaaaatttttttattttttgtagagacagggtctcactatgttgcccaggctggtcttgaactcgtgacctcaaatgatcctcctgcctcggcctcccaaagtgctgggattataggtatgagccaccatgcccagcttgacaaaaaawtttttttttttttttgagagatgaagtttcactcttgttgcccaggctggagtgcaatggatcagctcactgcaacctgtgcctcctgggttcaaacgattctcctgcctcagcctccagaatagctgggattacaggcatgcaccaccacgcccggctaattttgtatttttagtacagacggggtttctccatattggtcaggctggtctcgaactcctgacctcaagtgatccacctgcctcggcctcccaaagtgctgggattacaggtgtgagccaccacgcccagctgacaaaa

SEQ ID NO: 178744 - DNA, 601 bp, Human
aagttcttactttgcaaagtagacacagctgcaattatgcatttttggaaaatgattaggtactatctcatctgttttgtttttttgtttttttgtttttgagatgaggtctctgtcacccaggcctgagtgcagtggcgcaatctcagctcactgcatcctctgcctcccggtacaggtgatcctcctaccttagcctctcaagtagctgggactgcaggtgcacaccaccacacccggctcattttttttgtatttttgagctcaagcaatttgctcgtctcagcctcccaaagtgctsggattacagatgtgagccactggcccagtactatcttgctaagcctataaaattagattagattggtagtacttgggacccctcagaattctataatgtccttcttagaaggtgacagcagatctatccagcagactgtagattgttgtcttagtcaccggctgattgtcttggttaaagctctagtgacttcagaaccagagaaacttgttttccaacacattcaaagaccagtttgctttgcaattttgcaatagctgacattcagaatgcctgcgaggattttgtaagtgaggttca

SEQ ID NO: 178745 - DNA, 601 bp, Human
actgcctccattaaaacaaatgagcaaacaaaatcccttttcatgacttcagttctctcaggcctgagagtaaagtttacatcatagatgcttaaaaacaattcagttagtgaaagcatgtgacaagatgagacgatttgtcttcaacgaggagcttccttccatactcacaaaaagatgtgtgtcttaacatagtaaggacatggttaaatttagtcttatttggacctaacttcagccaattaatctgctacttagaactcttttactcaaatgaaatttgagtaaaaaaaaaaaaaattttttttttggccaggtgcggtggctcgtgcctgtaaacccagcactttgggaacccgaggcaggtggatcacctgaggtcaggagttcgagaccagcctcaccaacattgagaaaccgcgtctctcctaaaaatacgaaattagctggtgtgatggcgcagtcctataatcccagctactcaggaggctgaggcaggagaatcacttgaacctgggaggtggaggttgcagtgagccgagatcgcaccattgcattccagcctgggcaacaagagcaaaactccatcttaaaaaaaaat

SEQ ID NO: 178746 - DNA, 601 bp, Human
gcttaaaaacaattcagttagtgaaagcatgtgacaagatgagacgatttgtcttcaacgaggagcttccttccatactcacaaaaagatgtgtgtcttaacatagtaaggacatggttaaatttagtcttatttggacctaacttcagccaattaatctgctacttagaactcttttactcaaatgaaatttgagtaaaaaaaaaaaaaattttttttttggccaggtgcggtggctcgtgcctgtaaacccagcactttgggaacccgaggcaggtggatcacctgaggtcaggagttsgagaccagcctcaccaacattgagaaaccgcgtctctcctaaaaatacgaaattagctggtgtgatggcgcagtcctataatcccagctactcaggaggctgaggcaggagaatcacttgaacctgggaggtggaggttgcagtgagccgagatcgcaccattgcattccagcctgggcaacaagagcaaaactccatcttaaaaaaaaattattataataattttcaagtatatacaaagcagtgacacattttgtaaacccccatgcaccatcacacagcttcaacaactaccaacat

SEQ ID NO: 178747 - DNA, 601 bp, Human
cgaggagcttccttccatactcacaaaaagatgtgtgtcttaacatagtaaggacatggttaaatttagtcttatttggacctaacttcagccaattaatctgctacttagaactcttttactcaaatgaaatttgagtaaaaaaaaaaaaaattttttttttggccaggtgcggtggctcgtgcctgtaaacccagcactttgggaacccgaggcaggtggatcacctgaggtcaggagttcgagaccagcctcaccaacattgagaaaccgcgtctctcctaaaaatacgaaattagckggtgtgatggcgcagtcctataatcccagctactcaggaggctgaggcaggagaatcacttgaacctgggaggtggaggttgcagtgagccgagatcgcaccattgcattccagcctgggcaacaagagcaaaactccatcttaaaaaaaaattattataataattttcaagtatatacaaagcagtgacacattttgtaaacccccatgcaccatcacacagcttcaacaactaccaacatctgtctttcagacatgtttttagtccaagttttctcttaataaagagactttttcttt

SEQ ID NO: 178748 - DNA, 601 bp, Human
tgaccgtgctccggaagagctgtcctcagccgctactgtgagcatttggcctgcctgacagattctgttggtgagaatgttcttaggaatcatacagtaaactaactttattctgacttcaagcatcgtgttccattgatgcttgctttccaaggtgttttgctgattcacatcagcatgcaacctgcttgacagaatacagtgatgttctcactgtaaattcatcacctgctgctgtggtctcatgtatcatcccgtgcgctgttagctgaggccagtgctcctgtgtctcctcagcacragggcactggcaagagtgcatgtctgggcctataaagatgttggccaggttctaggcagggttgaattcaccaaggtaactgccatccatccctcaataggcattttttctcctacacaccctcaggcacatgccacgtgtacctggcacccttacttacgaagttaccgaattcctgccatgatactgtgggtcaccctgcttcattctcaggtgtggtgtcgggtggttcctgcctgggcgccgggtgttgttgggccctccctcaggttattggtttttgttttgagatgtaattca

SEQ ID NO: 178749 - DNA, 601 bp, Human
acctcctcctgctgttttctctggaccttgttgattatgtgttttgtgacctttggcatattgtacctgttccaggtgtacagccagctggttttggttgatgtgtaatggacaaaaggtgcccctatttaaaaaaaaaattttttttctgcttgtagtcccagctactcaggaggctgaggtgggaggatcacttgagcctaggaggcaaggcttcagtgagccatggtcctgccactgcactccagcttaggtgacagaggaagaccctatctcaaaaacaattatataggccgggcgyggtggctcatacctgtaatcccaacactttgggaggctgagatgggcggatcacctgaggtcagaagttcgagaccagcctggccaacatggtgacaccccatctctactaaaaatacaaaattagccaggtgtggtggtgcatgcctgtaatcccagctacttgggaggctgaggcaggagaacagcttgaacctgggaggtggaggttgcagttagcggagatcacgcctctgcactccagcctgggcaacaagagtgaaactctgtctcaaaaaaaaaaaaattatcataaaatcac

SEQ ID NO: 178750 - DNA, 601 bp, Human
ctctactaaaaatacaaaattagccaggtgtggtggtgcatgcctgtaatcccagctacttgggaggctgaggcaggagaacagcttgaacctgggaggtggaggttgcagttagcggagatcacgcctctgcactccagcctgggcaacaagagtgaaactctgtctcaaaaaaaaaaaaattatcataaaatcactcgttttaagtatatcatccaaggattttagcaccttctacagagctgtgcagctattgccacaatccaattttagaacattttcatcatcccctaaagatccytttacccatcactccccattcccacccccagtaccaagcagccactcatctacttcctgtgtctattgatttgccttttatggacatactgtacactttcattcatatgaagtgtctagataaggtaccctctaacgggtgacttttcatggttagcttttttcaaatgatagggaatttcctgcttcagaagatgctttttctgctgtgctacttacctgtgatctattgtgtgggtgggatttccttggaggcatgtatgtgtttgtttgttttgcagagtagcaaccttttttgtcc

SEQ ID NO: 178751 - DNA, 601 bp, Human
ctttttctgctgtgctacttacctgtgatctattgtgtgggtgggatttccttggaggcatgtatgtgtttgtttgttttgcagagtagcaaccttttttgtccgttgattagtgttctgtggaacatctggtttcatgcccatcactgtgacatatttggggagacacaacagaagatatatccctagtgggtgaaacaaacctaacaaacatgaaaacaactagcgaggagtcaatgacaacatctaagcaagcgtttggctgtgggatgcttttattggagacatgtttatcaagcaycctgtgccaggccctgtgcaggttggaatgcccttgtgctgagcaggcagaggtgggtgaaggccagggttagggaggggtgataaccgtgatacaggagcagacatggagccacacagccaggctgttttcttttcaggtcgccttcaatccttccagtggaaaggcttattttggtgcaggtgttgcttctagcaattgtttctctctccctttcaagagagcgtaccgaccttttgcaagaagtgtttctggctggaattttataacattggcttttgtttcccttttactaaagta

SEQ ID NO: 178752 - DNA, 601 bp, Human
aagtgtttctggctggaattttataacattggcttttgtttcccttttactaaagtagggccagatttgagggtgccttgaaacccaggcccatcttggtgtgcccaaataggagctgtaacaagccgtggtgcaggggtaggacctgtgttgtctttggagccatgggctgggctgcaggcactcgagttaagaagcttccttctgaggctcttccagtaatttgagtgtcctgtggcctgcctgggcagagagtggacaggaaagatcaggaaaagcacgtgtgaggactaccgagggygctgatagcgcctctccttcccaacttcacttctctggctctgacctttcagccctaagctccccttggccctgtgggatggggcagcatccagaagggtcttggagtcaggttttgttttgtttttttttttttaagtcatgtttccattgggcgtagtggctcgtgcctgtgatcccagcactttgggaggccgaggcaggcggattgcttgatctcaggagttgaagaccctcctgggcaacatggtgaaactccatctgtactaaaagttcagaaaaaaaaagcccagcatggtgg

SEQ ID NO: 178753 - DNA, 601 bp, Human
tttccattgggcgtagtggctcgtgcctgtgatcccagcactttgggaggccgaggcaggcggattgcttgatctcaggagttgaagaccctcctgggcaacatggtgaaactccatctgtactaaaagttcagaaaaaaaaagcccagcatggtggcgcacgcctgtagttccagttgcttaggagggtgaggcaaaagaatcgtttgaacctgggaggcagaggttgcagtgagctgagatcgagtcaccacactccagcctggcgatggagtgagactctctctccaaaataaataartaaagttatgtttctacactggatgtgcatgtcttcaataatggggacaggggacaaaacacacaactgaaatacagttcagtgggtgggttgctgtctttattgttgggtgatgtgtttatacaaggaaggaagcactgagtgggcctgttgacgatctgggcttgggaaacagctcacaggggaactgctggaactcaaggctctggttctcctgggggatccatgtacaggtctgtgcgtgtcctttgttgccaggattgccctgccaagctaaccgggttgtgcttcgcgtttcag

SEQ ID NO: 178754 - DNA, 601 bp, Human; identical to SEQ ID NO: 40057

SEQ ID NO: 178755 - DNA, 601 bp, Human; identical to SEQ ID NO: 40058

SEQ ID NO: 178756 - DNA, 601 bp, Human; identical to SEQ ID NO: 40059

SEQ ID NO: 178757 - DNA, 601 bp, Human; identical to SEQ ID NO: 40060

SEQ ID NO: 178758 - DNA, 601 bp, Human; identical to SEQ ID NO: 40061

SEQ ID NO: 178759 - DNA, 601 bp, Human; identical to SEQ ID NO: 40062

SEQ ID NO: 178760 - DNA, 601 bp, Human; identical to SEQ ID NO: 40063

SEQ ID NO: 178761 - DNA, 601 bp, Human; identical to SEQ ID NO: 40064

SEQ ID NO: 178762 - DNA, 601 bp, Human
cttgtccaggctggagtgcaatggcatgatctcggctcactgcaacctccacctcccaggttcacacgattctcctgtctcagcctcccaagtagctgggattacaggcatggaccaccaagtctggctaatttttgtattattagtagagacagggtttcaccatgttggccagtctggtcttgaactcctgacctcaggcgatccacccgcctcaccctccgaaagtgttgggattacaggcctgagccccactgcacctggccagaaatgtattttacattgtgattatctgtatctrtctcttactttttagatagatgtgtaaaacataagtttcaccatgaaatatttagccttactaggtgtggtatatgctgatgttttctatcctattctagtctgttttgctttaaacacagttctggtcatgaccttccaaattgatttcacaactactactggtttggggcctgcagtttgaaacgatgagtaggagtgttaagagattgggctctgaggccaggcatggtgcctcacacgtataatcccagtactttgggagactcaggtgggcagatcacttgaggccagaagtttg

SEQ ID NO: 178763 - DNA, 601 bp, Human
cacgattctcctgtctcagcctcccaagtagctgggattacaggcatggaccaccaagtctggctaatttttgtattattagtagagacagggtttcaccatgttggccagtctggtcttgaactcctgacctcaggcgatccacccgcctcaccctccgaaagtgttgggattacaggcctgagccccactgcacctggccagaaatgtattttacattgtgattatctgtatctgtctcttactttttagatagatgtgtaaaacataagtttcaccatgaaatatttagccttactakgtgtggtatatgctgatgttttctatcctattctagtctgttttgctttaaacacagttctggtcatgaccttccaaattgatttcacaactactactggtttggggcctgcagtttgaaacgatgagtaggagtgttaagagattgggctctgaggccaggcatggtgcctcacacgtataatcccagtactttgggagactcaggtgggcagatcacttgaggccagaagtttgagaccaggctgggcaacatggcaaaaccccgtctctactgaaaatataaaaattagctgggtgt

SEQ ID NO: 178764 - DNA, 601 bp, Human
ggcagcatgcctgttttcttgctgattttgcaagtgctccagaaatgtagactggtttttttctttcttattttagtatttcatatcctgatttttaaatgttgggccaaaaaaatgacacatctggctggacatggtggctcatgcctgtaatcccagaactttgggaggctaaggcgggcagatcacttgaggtcaagagttcaagaccagcttggccaacatggtgaaacctcgtctctactaaaaatacaaaaattagcttggcatggcagtgcacgcctgtaattccagctactcrggaggctgaagcaggagaatcacttgaaccctgaaggcagaagttgtggtgagccgagattgtgctactgcactccagcctgggcgacagagcaagactctgtctccaaaaaaaaaaaaaaagtgacacatttgtaaggatgattcatgatttaggccactgggtcactgtggggtacaagtagatggctattcctcagggctggatgtggggctcacccttgggcatgagggaatgacacaactactaggtatgggtatccaaggaaaaggatgtcttcaaggaattcgcagtttctgt

SEQ ID NO: 178765 - DNA, 601 bp, Human
gccactcactgagtcacacacacctgctcactgtgcatataaagatgctcatgcactggtccggctgtgctcacacacacactcacatcacagtcatgaagacaaaacacagtcacctgattacaatcacttacacacccacccatatcctggagggccatacacatcccgtctaaagtcacatcatttttagcagagtttactctcatcagataccatcacatgctcacagagggtcacaatgttccagcatccacaccccctacccccctaccccaggagcatctcagataccatagcyctagggtctctcttccacacacccacaactctcagtaaagcattcacagtagaaattttcatattttcatcccataaaatctccctcttcccttttctgtgtgacctgagattattgaaggctgtgcctttttaactcacgggtagcagggacattgttgtctccttctgggtggctcttctgaattgtgtccagacttctgtgtgaatctctgagctgcagaatttaaatggcccctatcagccctgcctctggctttattcctgattccaagcccctcccaggaaggtttcctcacac

SEQ ID NO: 178766 - DNA, 601 bp, Human
tgccactcactgagtcacacacacctgctcactgtgcatataaagatgctcatgcactggtccggctgtgctcacacacacactcacatcacagtcatgaagacaaaacacagtcacctgattacaatcacttacacacccacccatatcctggagggccatacacatcccgtctaaagtcacatcatttttagcagagtttactctcatcagataccatcacatgctcacagagggtcacaatgttccagcatccacaccccctacccccctaccccaggagcatctcagataccatagscctagggtctctcttccacacacccacaactctcagtaaagcattcacagtagaaattttcatattttcatcccataaaatctccctcttcccttttctgtgtgacctgagattattgaaggctgtgcctttttaactcacgggtagcagggacattgttgtctccttctgggtggctcttctgaattgtgtccagacttctgtgtgaatctctgagctgcagaatttaaatggcccctatcagccctgcctctggctttattcctgattccaagcccctcccaggaaggtttcctcaca

SEQ ID NO: 178767 - DNA, 601 bp, Human
ttcacatgcacagaaggccacatgcatgttcccagttcaacacccagtcacattccagcacacacactcacagtcacacagagccgtgccactcactgagtcacacacacctgctcactgtgcatataaagatgctcatgcactggtccggctgtgctcacacacacactcacatcacagtcatgaagacaaaacacagtcacctgattacaatcacttacacacccacccatatcctggagggccatacacatcccgtctaaagtcacatcatttttagcagagtttactctcatcagayaccatcacatgctcacagagggtcacaatgttccagcatccacaccccctacccccctaccccaggagcatctcagataccatagccctagggtctctcttccacacacccacaactctcagtaaagcattcacagtagaaattttcatattttcatcccataaaatctccctcttcccttttctgtgtgacctgagattattgaaggctgtgcctttttaactcacgggtagcagggacattgttgtctccttctgggtggctcttctgaattgtgtccagacttctgtgtgaatctct

SEQ ID NO: 178768 - DNA, 601 bp, Human
tcccaggctggtctaccagtcctggcctgacatgggcctttcaattcggccacccaaagtgctgagactacaggcctcagcaaacatcttgatgaatatccactgtaagctctgccttgtaccttcctggttttgggtgattcagtctcttaaatcaagtccctcaatgtccttctctagcatcctggcactcaatgggaaggccaggctagggtaggagacagggagagacctgaggctggaggcaggagccagtggtcactgtgtgcagattccacctaaggaaccatcagccccatcrtctgtttctcacccccattctgcttgggaaaaggcacctgagaattcatgcattctgctctcataaatgctcagagataagtcctcggtaactcaagggccccaagatcccacaagttctgtcaccggggatccacagtgatgcacaagggaagttagacagagtactgctatgtggggaggaaccttcacatgcacagaaggccacatgcatgttcccagttcaacacccagtcacattccagcacacacactcacagtcacacagagccgtgccactcactgagtcacacacacctgc

SEQ ID NO: 178769 - DNA, 601 bp, Human
ggaatgcagtggcaccatcaaaactcactgcaggccgggcgtggtggctcacgcctgtaatctcagcactttgggaggccaaggtgggcgcatcacttgaggtcaggagttcgagaccagcctggccaacatggagaaaccccatctctactgaaaatacaaaaattagccaggagtggtggcacaagcctgtaatcccagctactcgggaagctgaggtatgagaatcgcttgaacccgggaggtggaggttgcagtgagctgagattgcaccactgcactccagcctgggaaacagagygagactctgtctcaaaaaaaaaaaaaaaattactgcaggtttgaaggcctgggcttcagtgaacctcttgcatatgccccccagcagctggaactacggtatgcaacaccacattcaataaatttttaaatttttggaaagatgaaatcttgctatgtctcccaggctggtctaccagtcctggcctgacatgggcctttcaattcggccacccaaagtgctgagactacaggcctcagcaaacatcttgatgaatatccactgtaagctctgccttgtaccttcctggttttgggtgat

SEQ ID NO: 178770 - DNA, 601 bp, Human
tgtcacccaggctggaatgcagtggcaccatcaaaactcactgcaggccgggcgtggtggctcacgcctgtaatctcagcactttgggaggccaaggtgggcgcatcacttgaggtcaggagttcgagaccagcctggccaacatggagaaaccccatctctactgaaaatacaaaaattagccaggagtggtggcacaagcctgtaatcccagctactcgggaagctgaggtatgagaatcgcttgaacccgggaggtggaggttgcagtgagctgagattgcaccactgcactccagcstgggaaacagagtgagactctgtctcaaaaaaaaaaaaaaaattactgcaggtttgaaggcctgggcttcagtgaacctcttgcatatgccccccagcagctggaactacggtatgcaacaccacattcaataaatttttaaatttttggaaagatgaaatcttgctatgtctcccaggctggtctaccagtcctggcctgacatgggcctttcaattcggccacccaaagtgctgagactacaggcctcagcaaacatcttgatgaatatccactgtaagctctgccttgtaccttcct

SEQ ID NO: 178771 - DNA, 601 bp, Human
tttcttttttgaaacagggtcacactgtcacccaggctggaatgcagtggcaccatcaaaactcactgcaggccgggcgtggtggctcacgcctgtaatctcagcactttgggaggccaaggtgggcgcatcacttgaggtcaggagttcgagaccagcctggccaacatggagaaaccccatctctactgaaaatacaaaaattagccaggagtggtggcacaagcctgtaatcccagctactcgggaagctgaggtatgagaatcgcttgaacccgggaggtggaggttgcagtgagcygagattgcaccactgcactccagcctgggaaacagagtgagactctgtctcaaaaaaaaaaaaaaaattactgcaggtttgaaggcctgggcttcagtgaacctcttgcatatgccccccagcagctggaactacggtatgcaacaccacattcaataaatttttaaatttttggaaagatgaaatcttgctatgtctcccaggctggtctaccagtcctggcctgacatgggcctttcaattcggccacccaaagtgctgagactacaggcctcagcaaacatcttgatgaatatccac

SEQ ID NO: 178772 - DNA, 601 bp, Human
ggaaagaacaggaaacccctgtgcgtgggaggcacatacatcacaatcatcatgggcaatggacatctttcccagaaggggcacacattgctgagagcacaaccgcagtacttgcacaaatgaagattgtgggtcagggaagttattggctagaatctataaatggatggtatttttcttttttgaaacagggtcacactgtcacccaggctggaatgcagtggcaccatcaaaactcactgcaggccgggcgtggtggctcacgcctgtaatctcagcactttgggaggccaaggtgggygcatcacttgaggtcaggagttcgagaccagcctggccaacatggagaaaccccatctctactgaaaatacaaaaattagccaggagtggtggcacaagcctgtaatcccagctactcgggaagctgaggtatgagaatcgcttgaacccgggaggtggaggttgcagtgagctgagattgcaccactgcactccagcctgggaaacagagtgagactctgtctcaaaaaaaaaaaaaaaattactgcaggtttgaaggcctgggcttcagtgaacctcttgcatatgccccccagcagc

SEQ ID NO: 178773 - DNA, 601 bp, Human
gattgtgagttttattttttattatcattttaaccaccaaaaaaaaaaaaaaagaaagaaacaacacttgttgaaagagagagggaaacgaacaggaaagaacaggaaacccctgtgcgtgggaggcacatacatcacaatcatcatgggcaatggacatctttcccagaaggggcacacattgctgagagcacaaccgcagtacttgcacaaatgaagattgtgggtcagggaagttattggctagaatctataaatggatggtatttttcttttttgaaacagggtcacactgtcaccyaggctggaatgcagtggcaccatcaaaactcactgcaggccgggcgtggtggctcacgcctgtaatctcagcactttgggaggccaaggtgggcgcatcacttgaggtcaggagttcgagaccagcctggccaacatggagaaaccccatctctactgaaaatacaaaaattagccaggagtggtggcacaagcctgtaatcccagctactcgggaagctgaggtatgagaatcgcttgaacccgggaggtggaggttgcagtgagctgagattgcaccactgcactccagcctgggaaa

SEQ ID NO: 178774 - DNA, 601 bp, Human
aaagtgtttctgtttgtttggtgattttatgtttaattttatgggaataccaaacgattttccaatgtagctgtatcattttacatccctccaagcatcgtttgactgtttcaggtactctgcatcttttctaacttgagattgtgagttttattttttattatcattttaaccaccaaaaaaaaaaaaaaagaaagaaacaacacttgttgaaagagagagggaaacgaacaggaaagaacaggaaacccctgtgcgtgggaggcacatacatcacaatcatcatgggcaatggacatcyttcccagaaggggcacacattgctgagagcacaaccgcagtacttgcacaaatgaagattgtgggtcagggaagttattggctagaatctataaatggatggtatttttcttttttgaaacagggtcacactgtcacccaggctggaatgcagtggcaccatcaaaactcactgcaggccgggcgtggtggctcacgcctgtaatctcagcactttgggaggccaaggtgggcgcatcacttgaggtcaggagttcgagaccagcctggccaacatggagaaaccccatctctactgaaa

SEQ ID NO: 178775 - DNA, 601 bp, Human
agtaaagtgtttctgtttgtttggtgattttatgtttaattttatgggaataccaaacgattttccaatgtagctgtatcattttacatccctccaagcatcgtttgactgtttcaggtactctgcatcttttctaacttgagattgtgagttttattttttattatcattttaaccaccaaaaaaaaaaaaaaagaaagaaacaacacttgttgaaagagagagggaaacgaacaggaaagaacaggaaacccctgtgcgtgggaggcacatacatcacaatcatcatgggcaatggacrtctttcccagaaggggcacacattgctgagagcacaaccgcagtacttgcacaaatgaagattgtgggtcagggaagttattggctagaatctataaatggatggtatttttcttttttgaaacagggtcacactgtcacccaggctggaatgcagtggcaccatcaaaactcactgcaggccgggcgtggtggctcacgcctgtaatctcagcactttgggaggccaaggtgggcgcatcacttgaggtcaggagttcgagaccagcctggccaacatggagaaaccccatctctactg

SEQ ID NO: 178776 - DNA, 601 bp, Human
caactttgggttagtttcaatttgagaacagctacacataatgacactataaacatttctgtataggattttccataaactaaagtgtttacttggctaaaatctggtgagtaaagtgtttctgtttgtttggtgattttatgtttaattttatgggaataccaaacgattttccaatgtagctgtatcattttacatccctccaagcatcgtttgactgtttcaggtactctgcatcttttctaacttgagattgtgagttttattttttattatcattttaaccaccaaaaaaaaaaaraaagaaagaaacaacacttgttgaaagagagagggaaacgaacaggaaagaacaggaaacccctgtgcgtgggaggcacatacatcacaatcatcatgggcaatggacatctttcccagaaggggcacacattgctgagagcacaaccgcagtacttgcacaaatgaagattgtgggtcagggaagttattggctagaatctataaatggatggtatttttcttttttgaaacagggtcacactgtcacccaggctggaatgcagtggcaccatcaaaactcactgcaggccgggcgtgg

SEQ ID NO: 178777 - DNA, 601 bp, Human
atctgaacaaggagggtccttgtggaacactgacctgcgatcatcttcaactctgaaactgtgaaaacaagatgtgaggatgtaacagtagagagattcactccagtaagaaacaacaactttgggttagtttcaatttgagaacagctacacataatgacactataaacatttctgtataggattttccataaactaaagtgtttacttggctaaaatctggtgagtaaagtgtttctgtttgtttggtgattttatgtttaattttatgggaataccaaacgattttccaatgtagctrtatcattttacatccctccaagcatcgtttgactgtttcaggtactctgcatcttttctaacttgagattgtgagttttattttttattatcattttaaccaccaaaaaaaaaaaaaaagaaagaaacaacacttgttgaaagagagagggaaacgaacaggaaagaacaggaaacccctgtgcgtgggaggcacatacatcacaatcatcatgggcaatggacatctttcccagaaggggcacacattgctgagagcacaaccgcagtacttgcacaaatgaagattgtgggtcaggga

SEQ ID NO: 178778 - DNA, 601 bp, Human
gcctgttgggggtcctctatctgaacaaggagggtccttgtggaacactgacctgcgatcatcttcaactctgaaactgtgaaaacaagatgtgaggatgtaacagtagagagattcactccagtaagaaacaacaactttgggttagtttcaatttgagaacagctacacataatgacactataaacatttctgtataggattttccataaactaaagtgtttacttggctaaaatctggtgagtaaagtgtttctgtttgtttggtgattttatgtttaattttatgggaataccaaasgattttccaatgtagctgtatcattttacatccctccaagcatcgtttgactgtttcaggtactctgcatcttttctaacttgagattgtgagttttattttttattatcattttaaccaccaaaaaaaaaaaaaaagaaagaaacaacacttgttgaaagagagagggaaacgaacaggaaagaacaggaaacccctgtgcgtgggaggcacatacatcacaatcatcatgggcaatggacatctttcccagaaggggcacacattgctgagagcacaaccgcagtacttgcacaaatg

SEQ ID NO: 178779 - DNA, 601 bp, Human
ttaaactctccctgcctcagttttcccaatacaaagatgataatccgaaatacctactttgtatcatgttttcagttatacagtagttaatagatgtaaaccctttagcctaaaccctggcacgtatagggcctgttgggggtcctctatctgaacaaggagggtccttgtggaacactgacctgcgatcatcttcaactctgaaactgtgaaaacaagatgtgaggatgtaacagtagagagattcactccagtaagaaacaacaactttgggttagtttcaatttgagaacagctacamataatgacactataaacatttctgtataggattttccataaactaaagtgtttacttggctaaaatctggtgagtaaagtgtttctgtttgtttggtgattttatgtttaattttatgggaataccaaacgattttccaatgtagctgtatcattttacatccctccaagcatcgtttgactgtttcaggtactctgcatcttttctaacttgagattgtgagttttattttttattatcattttaaccaccaaaaaaaaaaaaaaagaaagaaacaacacttgttgaaagagagaggga

SEQ ID NO: 178780 - DNA, 601 bp, Human
gcatctaggctcaagggatcctcttgtctcagcctcccaaactcctagattacaggggtgagccactttgcccaaccagcaaggggaccttagatctattgcttaaactctccctgcctcagttttcccaatacaaagatgataatccgaaatacctactttgtatcatgttttcagttatacagtagttaatagatgtaaaccctttagcctaaaccctggcacgtatagggcctgttgggggtcctctatctgaacaaggagggtccttgtggaacactgacctgcgatcatcttcaaytctgaaactgtgaaaacaagatgtgaggatgtaacagtagagagattcactccagtaagaaacaacaactttgggttagtttcaatttgagaacagctacacataatgacactataaacatttctgtataggattttccataaactaaagtgtttacttggctaaaatctggtgagtaaagtgtttctgtttgtttggtgattttatgtttaattttatgggaataccaaacgattttccaatgtagctgtatcattttacatccctccaagcatcgtttgactgtttcaggtactctgc

SEQ ID NO: 178781 - DNA, 601 bp, Human
tattggtccacacccagctaattttatatgtatttggagagttggggtttcacgatgttgcccaggctggtctggagcatctaggctcaagggatcctcttgtctcagcctcccaaactcctagattacaggggtgagccactttgcccaaccagcaaggggaccttagatctattgcttaaactctccctgcctcagttttcccaatacaaagatgataatccgaaatacctactttgtatcatgttttcagttatacagtagttaatagatgtaaaccctttagcctaaaccctggcamgtatagggcctgttgggggtcctctatctgaacaaggagggtccttgtggaacactgacctgcgatcatcttcaactctgaaactgtgaaaacaagatgtgaggatgtaacagtagagagattcactccagtaagaaacaacaactttgggttagtttcaatttgagaacagctacacataatgacactataaacatttctgtataggattttccataaactaaagtgtttacttggctaaaatctggtgagtaaagtgtttctgtttgtttggtgattttatgtttaattttatgggaa

SEQ ID NO: 178782 - DNA, 601 bp, Human
ttttttttagacagggtctaattgaatcacccaggctgtagtgaactggcacaatcacagcccacttcaacctcaacctcccaggctcaagccatcctctcaattcagtttcttgagtagctgagactattggtccacacccagctaattttatatgtatttggagagttggggtttcacgatgttgcccaggctggtctggagcatctaggctcaagggatcctcttgtctcagcctcccaaactcctagattacaggggtgagccactttgcccaaccagcaaggggaccttagatctrttgcttaaactctccctgcctcagttttcccaatacaaagatgataatccgaaatacctactttgtatcatgttttcagttatacagtagttaatagatgtaaaccctttagcctaaaccctggcacgtatagggcctgttgggggtcctctatctgaacaaggagggtccttgtggaacactgacctgcgatcatcttcaactctgaaactgtgaaaacaagatgtgaggatgtaacagtagagagattcactccagtaagaaacaacaactttgggttagtttcaatttgagaacagc

SEQ ID NO: 178783 - DNA, 601 bp, Human
tgattcacacatgaggtcacccccttagaaaatattcttcctcttctccacctcccatctttgcaccatggagtactcacaagaaacaggcaagtggtcgccctttgattgtcacagtagaaccagtagacaaagaggcagcctctgtgtatggcacctgccaggggattgagagtgggtgagagaggcagggccaggtgtggcctcccctcctgtaacagattcccatggtgcagccagttagagatcaagcagtagactcaggcctccctgctcccaccctacctcagtcaggaccccktatttttcaaaacaatggggcccatggttaagagcagagcttcagaaactgagctacctcaattagatcctttattgtgctgactactagcagtgagatgttaacatgttttgaaccttttttttagacagggtctaattgaatcacccaggctgtagtgaactggcacaatcacagcccacttcaacctcaacctcccaggctcaagccatcctctcaattcagtttcttgagtagctgagactattggtccacacccagctaattttatatgtatttggagagttggggtttcacgat

SEQ ID NO: 178784 - DNA, 601 bp, Human
tcatctcagtgtggaaatccacctgcagatatggttcattcctgagggcagagcacacagtgttgagcaggtcccattcttgtggggcacacacaagacacacacacaagtctctttgccccttccgtggtcgagcaaagacttgttggtattctaggccttgtcattgtggggctgcttcagctccttgtgttctccatgggtggaaagagatgctccagccctcatccacagatggaaactgagccatagtcactgacttggtcatatgaattgcccattttctgaatattctatgccytttaatagataaagtgtcacagccccaagccttgagtgtcctttactcctagacccatgactagcccccagtgcagctgctgtaggttttgttcctggtgctggagggtctccaggacctgcacattcatggcacttccatcctgccaactagactttccacatgattcacacatgaggtcacccccttagaaaatattcttcctcttctccacctcccatctttgcaccatggagtactcacaagaaacaggcaagtggtcgccctttgattgtcacagtagaaccagtagacaaagag

SEQ ID NO: 178785 - DNA, 601 bp, Human
atactcacggctgttcatgaccacacgacgaccaaagcacacttggaaatggaagacaatgtctgattcctccttcatctcagtgtggaaatccacctgcagatatggttcattcctgagggcagagcacacagtgttgagcaggtcccattcttgtggggcacacacaagacacacacacaagtctctttgccccttccgtggtcgagcaaagacttgttggtattctaggccttgtcattgtggggctgcttcagctccttgtgttctccatgggtggaaagagatgctccagccctcwtccacagatggaaactgagccatagtcactgacttggtcatatgaattgcccattttctgaatattctatgccttttaatagataaagtgtcacagccccaagccttgagtgtcctttactcctagacccatgactagcccccagtgcagctgctgtaggttttgttcctggtgctggagggtctccaggacctgcacattcatggcacttccatcctgccaactagactttccacatgattcacacatgaggtcacccccttagaaaatattcttcctcttctccacctcccatctttg

SEQ ID NO: 178786 - DNA, 601 bp, Human
ctcctgctctgagatcccatggaagccgggtgcggggagctcctggggtgctcacctggtacttatctggcagcactgagatgctcagttcaaattcttggccatcctgaaagggcatattcttggattccacctgctgcttccaggccccatactcacggctgttcatgaccacacgacgaccaaagcacacttggaaatggaagacaatgtctgattcctccttcatctcagtgtggaaatccacctgcagatatggttcattcctgagggcagagcacacagtgttgagcaggtcccwttcttgtggggcacacacaagacacacacacaagtctctttgccccttccgtggtcgagcaaagacttgttggtattctaggccttgtcattgtggggctgcttcagctccttgtgttctccatgggtggaaagagatgctccagccctcatccacagatggaaactgagccatagtcactgacttggtcatatgaattgcccattttctgaatattctatgccttttaatagataaagtgtcacagccccaagccttgagtgtcctttactcctagacccatgactagcccccagtgca

SEQ ID NO: 178787 - DNA, 601 bp, Human
gcaacaacacctgttgaatgagagagggaaatgataaaagtaaagggaacccctgtgtgtgtgataaaaagcctgggacagggggagttatgggtgatgaaaagcctgggataaggggagttgtgggtgatgaaaagccggggacagagggagttatctggagttagggcatgaagagctgcctcctgctctgagatcccatggaagccgggtgcggggagctcctggggtgctcacctggtacttatctggcagcactgagatgctcagttcaaattcttggccatcctgaaagggcatrttcttggattccacctgctgcttccaggccccatactcacggctgttcatgaccacacgacgaccaaagcacacttggaaatggaagacaatgtctgattcctccttcatctcagtgtggaaatccacctgcagatatggttcattcctgagggcagagcacacagtgttgagcaggtcccattcttgtggggcacacacaagacacacacacaagtctctttgccccttccgtggtcgagcaaagacttgttggtattctaggccttgtcattgtggggctgcttcagctccttgtgtt

SEQ ID NO: 178788 - DNA, 601 bp, Human
atggcaagtgaaccgacattgaccctggtcaggtatgggaaaagagctgaggatggcagtgcaaggagaggtgatggcagagcaagcaacaacacctgttgaatgagagagggaaatgataaaagtaaagggaacccctgtgtgtgtgataaaaagcctgggacagggggagttatgggtgatgaaaagcctgggataaggggagttgtgggtgatgaaaagccggggacagagggagttatctggagttagggcatgaagagctgcctcctgctctgagatcccatggaagccgggtgcrgggagctcctggggtgctcacctggtacttatctggcagcactgagatgctcagttcaaattcttggccatcctgaaagggcatattcttggattccacctgctgcttccaggccccatactcacggctgttcatgaccacacgacgaccaaagcacacttggaaatggaagacaatgtctgattcctccttcatctcagtgtggaaatccacctgcagatatggttcattcctgagggcagagcacacagtgttgagcaggtcccattcttgtggggcacacacaagacacacacacaa

SEQ ID NO: 178789 - DNA, 601 bp, Human
tccatttggggaaaatggcaagtgaaccgacattgaccctggtcaggtatgggaaaagagctgaggatggcagtgcaaggagaggtgatggcagagcaagcaacaacacctgttgaatgagagagggaaatgataaaagtaaagggaacccctgtgtgtgtgataaaaagcctgggacagggggagttatgggtgatgaaaagcctgggataaggggagttgtgggtgatgaaaagccggggacagagggagttatctggagttagggcatgaagagctgcctcctgctctgagatcccayggaagccgggtgcggggagctcctggggtgctcacctggtacttatctggcagcactgagatgctcagttcaaattcttggccatcctgaaagggcatattcttggattccacctgctgcttccaggccccatactcacggctgttcatgaccacacgacgaccaaagcacacttggaaatggaagacaatgtctgattcctccttcatctcagtgtggaaatccacctgcagatatggttcattcctgagggcagagcacacagtgttgagcaggtcccattcttgtggggcacacaca

SEQ ID NO: 178790 - DNA, 601 bp, Human
ggaagatagaggatattctccatttggggaaaatggcaagtgaaccgacattgaccctggtcaggtatgggaaaagagctgaggatggcagtgcaaggagaggtgatggcagagcaagcaacaacacctgttgaatgagagagggaaatgataaaagtaaagggaacccctgtgtgtgtgataaaaagcctgggacagggggagttatgggtgatgaaaagcctgggataaggggagttgtgggtgatgaaaagccggggacagagggagttatctggagttagggcatgaagagctgccwcctgctctgagatcccatggaagccgggtgcggggagctcctggggtgctcacctggtacttatctggcagcactgagatgctcagttcaaattcttggccatcctgaaagggcatattcttggattccacctgctgcttccaggccccatactcacggctgttcatgaccacacgacgaccaaagcacacttggaaatggaagacaatgtctgattcctccttcatctcagtgtggaaatccacctgcagatatggttcattcctgagggcagagcacacagtgttgagcaggtcccat

SEQ ID NO: 178791 - DNA, 601 bp, Human
atttagctacatgaaaatttaaataacatcataaggggaagatagaggatattctccatttggggaaaatggcaagtgaaccgacattgaccctggtcaggtatgggaaaagagctgaggatggcagtgcaaggagaggtgatggcagagcaagcaacaacacctgttgaatgagagagggaaatgataaaagtaaagggaacccctgtgtgtgtgataaaaagcctgggacagggggagttatgggtgatgaaaagcctgggataaggggagttgtgggtgatgaaaagccggggacagwgggagttatctggagttagggcatgaagagctgcctcctgctctgagatcccatggaagccgggtgcggggagctcctggggtgctcacctggtacttatctggcagcactgagatgctcagttcaaattcttggccatcctgaaagggcatattcttggattccacctgctgcttccaggccccatactcacggctgttcatgaccacacgacgaccaaagcacacttggaaatggaagacaatgtctgattcctccttcatctcagtgtggaaatccacctgcagatatggttcattc

SEQ ID NO: 178792 - DNA, 601 bp, Human
aaaatgctcatcatcactggccatcagagaaatgcaaatcaaaaccactatgaggatattatctttaacagcgtataaacatagaaaaacacctctgactttaatctgaataaaatgtgaatgttttggcctacccatttgaaatgtcagaaactttgatcacattctttattactgaggctacacagggagtcatattttaggtttcattctcaaatttaaaatccatacaactttgaaccagttattccttttctttataatcatgttccaatataaatagggaaaagttggcaatgamaaaagggttgattagaaagcttaatacagtaacatttgtgagagcaaaacattggaaaccaactcagtgctcttgtaaagggtcaagtacagcaagttgaggaaatccttctaggggaatattatgtaatccttaaaaaaatgaggcagcaccatggatagattatttctccaatatatattctttgagtacaactcaactgtcattcctaaagtgtaatgtgtagggacattgataccagcatttgtttaaaaacaaataaaagtgtatatatgggtgtatgtatatgcttctataagg

SEQ ID NO: 178793 - DNA, 601 bp, Human
actcaaacaaatgtacaagaaaaaaacaaacaaccccatcaaaaagtgggcgaacgacatgaacagacacttctcaaaagaagacatttatgcagccaaaaaacacatgaaaaaatgctcatcatcactggccatcagagaaatgcaaatcaaaaccactatgaggatattatctttaacagcgtataaacatagaaaaacacctctgactttaatctgaataaaatgtgaatgttttggcctacccatttgaaatgtcagaaactttgatcacattctttattactgaggctacacaggcagtcatattttaggtttcattctcaaatttaaaatccatacaactttgaaccagttattccttttctttataatcatgttccaatataaatagggaaaagttggcaatgaaaaaagggttgattagaaagcttaatacagtaacatttgtgagagcaaaacattggaaaccaactcagtgctcttgtaaagggtcaagtacagcaagttgaggaaatccttctaggggaatattatgtaatccttaaaaaaatgaggcagcaccatggatagattatttctccaatatatattctttgag

SEQ ID NO: 178794 - DNA, 601 bp, Human
atctgacaaagggctaatatccagaatctacaatgaactcaaacaaatgtacaagaaaaaaacaaacaaccccatcaaaaagtgggcgaacgacatgaacagacacttctcaaaagaagacatttatgcagccaaaaaacacatgaaaaaatgctcatcatcactggccatcagagaaatgcaaatcaaaaccactatgaggatattatctttaacagcgtataaacatagaaaaacacctctgactttaatctgaataaaatgtgaatgttttggcctacccatttgaaatgtcagaaastttgatcacattctttattactgaggctacacagggagtcatattttaggtttcattctcaaatttaaaatccatacaactttgaaccagttattccttttctttataatcatgttccaatataaatagggaaaagttggcaatgaaaaaagggttgattagaaagcttaatacagtaacatttgtgagagcaaaacattggaaaccaactcagtgctcttgtaaagggtcaagtacagcaagttgaggaaatccttctaggggaatattatgtaatccttaaaaaaatgaggcagcacc

SEQ ID NO: 178795 - DNA, 601 bp, Human
aacctactcatctgacaaagggctaatatccagaatctacaatgaactcaaacaaatgtacaagaaaaaaacaaacaaccccatcaaaaagtgggcgaacgacatgaacagacacttctcaaaagaagacatttatgcagccaaaaaacacatgaaaaaatgctcatcatcactggccatcagagaaatgcaaatcaaaaccactatgaggatattatctttaacagcgtataaacatagaaaaacacctctgactttaatctgaataaaatgtgaatgttttggcctacccatttgaaaygtcagaaactttgatcacattctttattactgaggctacacagggagtcatattttaggtttcattctcaaatttaaaatccatacaactttgaaccagttattccttttctttataatcatgttccaatataaatagggaaaagttggcaatgaaaaaagggttgattagaaagcttaatacagtaacatttgtgagagcaaaacattggaaaccaactcagtgctcttgtaaagggtcaagtacagcaagttgaggaaatccttctaggggaatattatgtaatccttaaaaaaatga

SEQ ID NO: 178796 - DNA, 601 bp, Human
gagcttctgcacagcaaaagaaactaccatcagagtgaacaggcaacctacaaaatgggagaaaattttcgcaacctactcatctgacaaagggctaatatccagaatctacaatgaactcaaacaaatgtacaagaaaaaaacaaacaaccccatcaaaaagtgggcgaacgacatgaacagacacttctcaaaagaagacatttatgcagccaaaaaacacatgaaaaaatgctcatcatcactggccatcagagaaatgcaaatcaaaaccactatgaggatattatctttaacagcstataaacatagaaaaacacctctgactttaatctgaataaaatgtgaatgttttggcctacccatttgaaatgtcagaaactttgatcacattctttattactgaggctacacagggagtcatattttaggtttcattctcaaatttaaaatccatacaactttgaaccagttattccttttctttataatcatgttccaatataaatagggaaaagttggcaatgaaaaaagggttgattagaaagcttaatacagtaacatttgtgagagcaaaacattggaaaccaactcagtgctc

SEQ ID NO: 178797 - DNA, 601 bp, Human
aaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatgtacaagaaaaaaacaaacaaccccatcaaaaagtgggcgaasgacatgaacagacacttctcaaaagaagacatttatgcagccaaaaaacacatgaaaaaatgctcatcatcactggccatcagagaaatgcaaatcaaaaccactatgaggatattatctttaacagcgtataaacatagaaaaacacctctgactttaatctgaataaaatgtgaatgttttggcctacccatttgaaatgtcagaaactttgatcacattctttattactgaggctacacagggagtcatattttaggtttcattctcaaatttaaaatccatacaactttgaaccag

SEQ ID NO: 178798 - DNA, 601 bp, Human
ttctaactggtgtgagacggtaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatktacaagaaaaaaacaaacaaccccatcaaaaagtgggcgaacgacatgaacagacacttctcaaaagaagacatttatgcagccaaaaaacacatgaaaaaatgctcatcatcactggccatcagagaaatgcaaatcaaaaccactatgaggatattatctttaacagcgtataaacatagaaaaacacctctgactttaatctgaataaaatgtgaatgttttggcctacccatttgaaatgtcagaaactttgatcacattctttattactgaggctacacagggagtcatatttta

SEQ ID NO: 178799 - DNA, 601 bp, Human
atccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagacggtaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaamtaaagagcttctgcacagcaaaagaaactaccatcagagtgaacaggcaacctacaaaatgggagaaaattttcgcaacctactcatctgacaaagggctaatatccagaatctacaatgaactcaaacaaatgtacaagaaaaaaacaaacaaccccatcaaaaagtgggcgaacgacatgaacagacacttctcaaaagaagacatttatgcagccaaaaaacacatgaaaaaatgctcatcatcactggccatcagagaaatgcaaatcaaaaccactatgaggatattatctttaa

SEQ ID NO: 178800 - DNA, 601 bp, Human
gttcacacagcaggctaagaagctgagcaagagctgacacactgaactgaggcccttctgctgtcaaagccaggaccccctcatcattccaccatgaagggagtggtttcagcagaatctagtggaaaatcttaagaataaaactacttacctcctgtgacaaccacccgccccaccaccccagactaatgccgagcttgttaagtctcgtcccggaggtggaaatcttaatccccaaatctccactccatccccggggatccgccccactgtaagtgcagaaggcgggaaagtgagccgragagcgccgcacacggccaaccggggagtcctcatccactccggcccactcggaaaagctgggatgcgggataaggggatggtggtggtggcagcgacagggaaggcaaatgggggcttcccacacacagctccaggacccaaggtcaggaactctccatctccgacccaagcctgattcccaaaacacgcccagcgatccaagactccagatgcctgaatccaaactctagcccaagacccttgagtgccgcctcctgcccaatatccaaaatccctattagacggcctcaatgagacg

SEQ ID NO: 178801 - DNA, 601 bp, Human
taaagagctaacacctgacaacttttacaacttcacattctaccacacatggaggaaggttggaagaacgggtatcctccatttatgagggaatcacagaccagaatgcctgcaggcaagccaggatctcagcatacctggcctacaatcccccaccccacttcatcaagagatccccaaacacggaagagaaagggaacttgggagaagggcacagatccacaaatctcctgccaggtgacccccatctctccacacaaacacacacacaaaagaaaaagaaagcctgtactaggaaaasagaccctttgggccatggtggaaattctccaaactcaatgaagcaagttctcacacagatgagtgcgggttgggcaggccagatggaggaagtgctcaggcaccaccgagaaggattctaatgttgttctctttgagaaagataaaggtaacaattagagctaatactattatatgtcaagcactgtgctattttttttaacgtcgcttaatcctaactggcgccattttattgatgagaaaacagaggctcagagaggtaaagccacttgcccaagttcacacagcaggctaagaagct

SEQ ID NO: 178802 - DNA, 601 bp, Human
tgttcactttttaatgttctactccccctacagtccactttccacacagcaactaataagtgctgtttttgaaacagcaactcagatctcaattttcttgcccaagccctccaacagttttccaaagccaagaccttcatttaggggagatgccacagctaggcttatgaaagtctcaacccaggcctaacagaaaggaagtactggcatgtgcttggggcggagtgggcatgagtgtaaactttcaatcccagatactcaaaacatctcaatccgtttcaggtcctggagcttttggggraaaatgtaccaaaagtacccagtcctcagaaaaaacacatgttcacacaaacttttccagtaagttctttttttggggggaggggggtccataaaccccctgatttaaaatctgctctccttccacagccttctccatctcaaaaatggcaattccatccttccagttacacacccccaaacccttggttatccttgactccgatcacacacccacatacaatctgttggttctgtcttcaaaagcatgtaaaactgtcagcatgtccactgctcccatcctggtccaccacaccatctc

SEQ ID NO: 178803 - DNA, 601 bp, Human
gacagtttgaggccaggagttcaagaccagcctggccaacatagtgaaaccctgtctctactaaaaatacaaaaaattagctgggcgtggtggcgcatgcctgtaatcccagctactcaaaaggctgaggcacaagcatcaattgaacacaggcggaggttgcagtgagctgagatggtgccactgcactccagcctgggtgacagagagagattctgtatcaaaaaaataaaaataaaaaaaatgcagtgctcatcctatagggttgtaaagattaaatgacttgtacccacagagcacwtcacatatatactatctggcacctactttgaacatcatcattcaaactcaggggtacgcgtctcctcttccctcctcatgtaccaaaagtacccattcctcagaaaaaacacatgttcacacaaacttttccagttagttcttttttcatctttctattaaagatgaaaatgtaacttttaatagctactcctaatttgatcttttaaaatgaagtttccttttcaaaactctagaacataactaagagttgttcactttttaatgttctactccccctacagtccactttccacacagc

SEQ ID NO: 178804 - DNA, 601 bp, Human
ccaggcaggcggacagtttgaggccaggagttcaagaccagcctggccaacatagtgaaaccctgtctctactaaaaatacaaaaaattagctgggcgtggtggcgcatgcctgtaatcccagctactcaaaaggctgaggcacaagcatcaattgaacacaggcggaggttgcagtgagctgagatggtgccactgcactccagcctgggtgacagagagagattctgtatcaaaaaaataaaaataaaaaaaatgcagtgctcatcctatagggttgtaaagattaaatgacttgtacmcacagagcacatcacatatatactatctggcacctactttgaacatcatcattcaaactcaggggtacgcgtctcctcttccctcctcatgtaccaaaagtacccattcctcagaaaaaacacatgttcacacaaacttttccagttagttcttttttcatctttctattaaagatgaaaatgtaacttttaatagctactcctaatttgatcttttaaaatgaagtttccttttcaaaactctagaacataactaagagttgttcactttttaatgttctactccccctacagtccact

SEQ ID NO: 178805 - DNA, 601 bp, Human
tgaggcttggatgggttaggtaacttgcctgattaaagcctgaggttttttttttttttttttttgagtctcactctgttgcccaggatggagtgcagttgtgcgatctcagcttagtgcaacgtccgcctcctgggttcaagcaattctcctgtctcagcctcccaagtaggtgggactacaggcacacgtcaccacacccagctaatttttgtatttttagtagagatggggttttaccatattggtcaggctggtctcgaactcctgacctcaggtgatccacctgcctcggcctccsaaagtgttgagattaaaggcatgagccacctcgtctggccaaagcctgaggttttaaggcactacacttaacagcttataaacacataaagtaacaaagggtaacagagtgggacacgtgggtgccaggggccctctaaatgggaagcctatacaggctcagaaaccatgaagatctcctggttctttctaaagaaaccagaagagcaggttttagcagcataaaattttaaagaggcccatcaaatcaaatagtctggtatctatactccccgttgtctctctaaggttggtcacccca

SEQ ID NO: 178806 - DNA, 601 bp, Human
gacaatgattaggacccccaaaaggaggctttttatggaggggtagtgtaataaatacaagaggcaggaagtacaggagacctaggagatggggaggagactgaaggagaagaggttggccctccaagggtggcttccaagactctgaagccaagctgccacctccacaacctcacctagctccccttacccctttctattcctgcagactcaagaggtctgctcatccactccaactccatccgaatcagagatccactggcttcttccagaagcctgcggtggcctgtcctaccccacmggggccacccccagacccctcaccgatgagcatgcggtatttgtgtgggtgtcgagcatcctcgatcacaggaatgatgttggtcctcttcttggccaagttaatgaggtcacggccagagcggtgggagaactcgactgcatagactagaccatcctaaaataaattaaaaattaatgaacagtgatgctagttctcatgcatggagtgcctactttaggcccatacactatacacagcatctcttccaacccccaaatcaaaaccctaccatctaatgactattgttatcatgtccat

SEQ ID NO: 178807 - DNA, 601 bp, Human
gaaatgtgataaaaggcttaatgaaagtttttggctgggtgcagtggctcgtgcctgtaatcctagcactttgggagcctgagacaggcagattgcctgagctcaggagctccagagcagcctgagcaacatggcaaaaccccgtctccactaaaaatataaaagttagccaggtgtggtggcacacgcctgtagtcccagctacttaggaggctgaggcagaagaattgcttgaacctgggaggcagaggttgcagtgagctgagattgcaccacttcacgccagccttggtgacagagygagactctgtctcaaattaaaaaaaaaaaaagtttttagttttgttttggatttgaagcaggaagccttaaacagtcctatttatctaaaagccagtgcttaaattttatacccaggaattgtttggcttatttctacttcctcttctttaataatagtaataatgcagttgagaataataaaacaaatgtagcaaaaggctaacaaatggtgaaccttgtgaagggtgcatgggagagttctccattatttccaaataaaaatgctgtgaaagatgcacctagcttttatctagtatct

SEQ ID NO: 178808 - DNA, 601 bp, Human
ttctcctgttgcatctttttcacttcggaggcaaacacggcctcggctgaggctgtggagtcaatgcagttggcctaaagaggagaaaggactaatgtctacaacagggctttgggctgtttttctcttgtgtgctctttaaaccagatgttttcattattaattcaagtaaaactcagtgctatggttctagtgtgtcccccaaagttcatgtgttggaaacgtaacccttaaatgcaagagttgagaggtgggacctttgagagatgattcaggtcatgaggcctctgccttcctgaayagagtaatgctattatcacaagagtgggttgctgattaaaaggatgattatgccccctttctatcttgctctcacccttctgccaatggatgacagcaagaaggccctcgccagattcagacctccaatcttggactttccagcctttggaactgggagccaaataaatttccattcattataaattacccagtctaaggctgggcgtggtggctcacgcctgtaatcccagcactttgggaggccgaggtggctcaatcacgaaatcaggagattgagaccatcctggccaacacggtg

SEQ ID NO: 178809 - DNA, 601 bp, Human
ttcatatggctcaagggtcaactgctcctgcggcttcatgttctcctgttgcatctttttcacttcggaggcaaacacggcctcggctgaggctgtggagtcaatgcagttggcctaaagaggagaaaggactaatgtctacaacagggctttgggctgtttttctcttgtgtgctctttaaaccagatgttttcattattaattcaagtaaaactcagtgctatggttctagtgtgtcccccaaagttcatgtgttggaaacgtaacccttaaatgcaagagttgagaggtgggaccttygagagatgattcaggtcatgaggcctctgccttcctgaacagagtaatgctattatcacaagagtgggttgctgattaaaaggatgattatgccccctttctatcttgctctcacccttctgccaatggatgacagcaagaaggccctcgccagattcagacctccaatcttggactttccagcctttggaactgggagccaaataaatttccattcattataaattacccagtctaaggctgggcgtggtggctcacgcctgtaatcccagcactttgggaggccgaggtggctcaatc

SEQ ID NO: 178810 - DNA, 601 bp, Human
cgacccatttccgcagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgytacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctg

SEQ ID NO: 178811 - DNA, 601 bp, Human; identical to SEQ ID NO: 110084

SEQ ID NO: 178812 - DNA, 601 bp, Human; identical to SEQ ID NO: 110085

SEQ ID NO: 178813 - DNA, 601 bp, Human; identical to SEQ ID NO: 110086

SEQ ID NO: 178814 - DNA, 601 bp, Human; identical to SEQ ID NO: 110087

SEQ ID NO: 178815 - DNA, 601 bp, Human; identical to SEQ ID NO: 110088

SEQ ID NO: 178816 - DNA, 601 bp, Human; identical to SEQ ID NO: 110089

SEQ ID NO: 178817 - DNA, 601 bp, Human; identical to SEQ ID NO: 110090

SEQ ID NO: 178818 - DNA, 601 bp, Human; identical to SEQ ID NO: 110091

SEQ ID NO: 178819 - DNA, 601 bp, Human
gtctttttttttttttttttttttttgagacagagtctgtcgcccaggctggagtgcagtggcacgatcttggctcactgcaagctccgcctccggggttcacgccattctcctgcctcagcctcccgagtagctgggactacaggcacccgccaccacacccagctaattttttgaatttttagtagagacggggtttcaccatgttagccaggatggtctcgatctcctgaccttgtgatccgcccgcctcagcctcccaaagtgctgagattacaggcgtgagccacggcacccagcsgagatggggtcttgctttgttgcccaggttggtctcaaaactcccagcctcaagcaaccctcccacctcagcctcctgtgtagctgagatcacaggtgcacaccactgtgcttggctaatttttgtatttttagtagagttagggtgttaccatgttgcccaggctggtcttaaactcctgggctcaagtgatcctcctgcctcagcctcccaaagcgctgggattacaggcatgagccaccatgcctggctagctttttaacttatatggaaactctttcatttaaatgccaataaagc

SEQ ID NO: 178820 - DNA, 601 bp, Human
aggccaccaggggggtgaggtctacccccttttttttttttgtagagatggagtctttttttttttttttttttttttgagacagagtctgtcgcccaggctggagtgcagtggcacgatcttggctcactgcaagctccgcctccggggttcacgccattctcctgcctcagcctcccgagtagctgggactacaggcacccgccaccacacccagctaattttttgaatttttagtagagacggggtttcaccatgttagccaggatggtctcgatctcctgaccttgtgatccgcccrcctcagcctcccaaagtgctgagattacaggcgtgagccacggcacccagccgagatggggtcttgctttgttgcccaggttggtctcaaaactcccagcctcaagcaaccctcccacctcagcctcctgtgtagctgagatcacaggtgcacaccactgtgcttggctaatttttgtatttttagtagagttagggtgttaccatgttgcccaggctggtcttaaactcctgggctcaagtgatcctcctgcctcagcctcccaaagcgctgggattacaggcatgagccaccatgcct

SEQ ID NO: 178821 - DNA, 601 bp, Human
tttttttttgagacagggtctcactttgtcacccaggttggagtacagggacgtggtctcagctcattgcagcctcgacctcccaggttcaggtgatcctcctgcctcagccccccaagtagctgagattacaggggcgtgccaccacatccagctaatgttttttgtgttttttgcagagacagagtttcaccatgttgcccaggctggtctcgaactcctgagctcaagtgatctgtccacctcagcctcccaaagtgctgggattacaggcatgagccactgcgcctggccttttttwaaaaaattttagtagaaatgggggtcttgttatgttgcccaggctggtcttgaactcctggccacaagcagtactcccacctcagactcccaaagtgctgagattacaggtgtgagccactgcgctcagcctgtcttttttagtttgctatttaaagtcgtgctccctcgggcatgaggatatgcgcaggcagagtgcagatgctcacaggaacaccctgtaacttgtcaggcaaggggtgccttctggaccctgaccctccctacaccagcaggaaacccaaggacagcagcggtcact

SEQ ID NO: 178822 - DNA, 601 bp, Human
attaatatccccatcgtacagatgagaaaactgaggcccaaagtcacttgcctaaggttctacagataggggagagatttgaacctgggaaagtgaatgccagcgtgtaagttctcaccccctatgcaattctgtccagtgcacttgaaccccaggtgcactgtgaccagtgatggctacagaatcatccaagcccggtataaaatgaaaatgtggggcatcttgttcaagaagcaggaaaattgttttcctttcttttgtagtctctctctagactgatcatcgtcttttttttttactrttattagagacagggcctcactctgttgcccaggctggagtgcaatggtgcgatcctagctcactgcagtcttgaactcctgggctcaagcaatcctcctatctcagcctccagagtagctgggagtataggtgcacaccaccatgcccagctaatttttttttttttttttttgagacagggtctcactttgtcacccaggttggagtacagggacgtggtctcagctcattgcagcctcgacctcccaggttcaggtgatcctcctgcctcagccccccaagtagctgagattacagg

SEQ ID NO: 178823 - DNA, 601 bp, Human
cttgaactcaggaggcagaggttgcagtgagccaagatcacgccattgcactccagcgtgggtgacaaaagtggaactccatctcaaataataataataatgatagtgctcatttgactcacaattactttataatataggtgctattaatatccccatcgtacagatgagaaaactgaggcccaaagtcacttgcctaaggttctacagataggggagagatttgaacctgggaaagtgaatgccagcgtgtaagttctcaccccctatgcaattctgtccagtgcacttgaaccccaggtgcactgtgaccagtgatggctacagaatcatccaagcccggtataaaatgaaaatgtggggcatcttgttcaagaagcaggaaaattgttttcctttcttttgtagtctctctctagactgatcatcgtcttttttttttactgttattagagacagggcctcactctgttgcccaggctggagtgcaatggtgcgatcctagctcactgcagtcttgaactcctgggctcaagcaatcctcctatctcagcctccagagtagctgggagtataggtgcacaccaccatgcccagctaa

SEQ ID NO: 178824 - DNA, 601 bp, Human
gcgagacccagttctttaaaaaaacaaaaaacaaaaacaaaaaccactgagacagtgaggactctagtccctcttccctcagacccaggacccacaccacctctccctaacactctggagccccatcccagtctgaacctttgtgagctctgctgtctgcaccagcctgtttttactccctgcatacatcatctgttgttccggcttgcagcctgcgtggaaaagaggagaaaggcacatcagtggggacccaggcgtgttctctaaagctctagtaatgtcctgaaggccctgcagcttkccaagggtcctaggagctcttctaaggaggtccctgcactgtactcagtttctaggttggcttgggggcttcaagttattctgagggtctctggagatgatttaggggccagacggggatttctaggtgaaaggaaaaggtgggttggcttaggccccaggactgagaacgggtgggctcttggtgaatctgagcccccacctccacttcactgccctcccacatcatgcgtgcgacacacacacatcctcacccagtcacacacaggctgtcacatgctcacactcttacacaagtgcc

SEQ ID NO: 178825 - DNA, 601 bp, Human
tgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcat

SEQ ID NO: 178826 - DNA, 601 bp, Human; identical to SEQ ID NO: 178825

SEQ ID NO: 178827 - DNA, 601 bp, Human
gcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaawttttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatg

SEQ ID NO: 178828 - DNA, 601 bp, Human
gtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtscctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacat

SEQ ID NO: 178829 - DNA, 601 bp, Human
gatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctcyacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttca

SEQ ID NO: 178830 - DNA, 601 bp, Human
tagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggygcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagact

SEQ ID NO: 178831 - DNA, 601 bp, Human
tagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctygaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgg

SEQ ID NO: 178832 - DNA, 601 bp, Human
agtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaargcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttt

SEQ ID NO: 178833 - DNA, 601 bp, Human
ctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcrgattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagac

SEQ ID NO: 178834 - DNA, 601 bp, Human
agttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccrcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacct

SEQ ID NO: 178835 - DNA, 601 bp, Human
atctggtaaatcgctataaaggcggcatttctttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctyggcctcccaaaatgctgggattagaggcgtgagccaccgcgccaggcctaaagggggcatttctaatactggagaaaggtgaactttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaa

SEQ ID NO: 178836 - DNA, 601 bp, Human
tgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctcggcctcccaaaatgctgggattagaggcgtgagccaccgcgccaggcctaaagggggcatttctaatactggagaaaggtgaactttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccagg

SEQ ID NO: 178837 - DNA, 601 bp, Human
ctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctcggcctcccaaaatgctgggattagaggcgtgagccaccgcgccaggcctaaagggggcatttctaatactggagaaaggtgaactttttttttttttttttccgagacagagtctygctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatt

SEQ ID NO: 178838 - DNA, 601 bp, Human
ctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatttggctcatctagggaaaaacaagagtcccacctcacacctaatcaaaaagtaaattccagcagattaaatacctgaatatgacaggaaggtayacaccaaattcatgggacagatggcctggggaggaatgaaacttggaaggcggtatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaag

SEQ ID NO: 178839 - DNA, 601 bp, Human
tatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaagcagttctctgcctcagcctcccaagtagctgggattacaggcatccgccaccaygtcaggctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaa

SEQ ID NO: 178840 - DNA, 601 bp, Human
ctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttagkccgggtgcgatagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaa

SEQ ID NO: 178841 - DNA, 601 bp, Human
tatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttaggccgggtgcgrtagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagctttttta

SEQ ID NO: 178842 - DNA, 601 bp, Human
gggtgcgatagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagyttttttaaagatagatagaagaaaatgtttgcaatatgtataacacatacagtatatagaaccctcatatcaatatatataatttccaaagaaaaagtggataaagaatatgagcaattcattcacaaaaaatacaaatagccaaaagacatgaaaaagaaaaaaacattgttaataaaataattttttaatctatccaactggcaaaattaaaagggttgatgatattcaattttggtaaaggaagacataggcacacttgtatattggcacaaacttattgagagcagtttgaccaaa

SEQ ID NO: 178843 - DNA, 601 bp, Human
gatgttaaatgaaagaagcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttcttttttttyttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacagggtttcaccatgttggccaggctggtctcgaactcctgacctcaggtgatccacccgcctcagcctcccaaagtgctgggattacaggccatgagccaccacgcccggcctctttt

SEQ ID NO: 178844 - DNA, 601 bp, Human
agcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacagggtttcaccatgttggccaggctggtctcgaactcctgacctcaggtgatccacccgcctcagcctcccaaagtgctgggattacaggccatgagccaccacgcccggcctctttttttccaaccataggat

SEQ ID NO: 178845 - DNA, 601 bp, Human
attaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacagggtttcaccaygttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctccc

SEQ ID NO: 178846 - DNA, 601 bp, Human
tcactgcaacctctgccttccaggttcaagtgattctcctgactcagcctcccaagtagctgggattacaggcacatgctaccacgcctggctaatttttgtatttttagtagagacagggtttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtcccccccccca

SEQ ID NO: 178847 - DNA, 601 bp, Human
ggattacaggcacatgctaccacgcctggctaatttttgtatttttagtagagacagggtttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcaraggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtccccccccccagcctcccaaagtgctgggattacaggcgtgagccaccgtgcctggccacatctgatcctctc

SEQ ID NO: 178848 - DNA, 601 bp, Human
tcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatycattgtccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtc

SEQ ID NO: 178849 - DNA, 601 bp, Human
tctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgaca

SEQ ID NO: 178850 - DNA, 601 bp, Human
ggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgcccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcct

SEQ ID NO: 178851 - DNA, 601 bp, Human
tcatcccctggtaaggctggctgagagaaattcccctgaaaacatttattttactcagtttattgataagtgataataaaagataagtattacatatttgtgtatttattaatggcccagagtagagcattcagatattttcccagtctgatatatggtttcaggtgagaaaataagggatttatatagtgacaatatttttaagtgaaaagtggaatacatagtcaaagaatttgggcactgccttggtggctggaggcaggtcagaaaatgtcagttggcatggtagaacttctaggaygctgaaatagtttgtggagacacaagtaagaattttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcttgatctcctgacctcgtgatccgcccgcctcggactcccaaagtgct

SEQ ID NO: 178852 - DNA, 601 bp, Human
attttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcttgatctcctgacctcgtgatccgcccgcctcggactcccaaagtgctgggattacaggcgtgagccaccgcgcctggcygagaatattttaaactaccacacttaccatgcatgtggtaaactatcagtctgtatttatcagtgatggttatttcctaatacccaggaggcatccatgtgagccacccttccattgctttaagaccaagggagcgagtgaccagcaggattcaagatggcagctctgccgaggagtgggagtcccagctaacttctgctccctgctctcccaccaacagcctacaccgatttcttcctcccgctgctaagccgctgtccctccgccatgggaataaagaataaggatggggagacccct

SEQ ID NO: 178853 - DNA, 601 bp, Human
ggactgcaggcgcccgccaccaggcctggctaattttttgtattttttagtagagatgggatttcaccatgttagccaggatggtcttgatctcctgacctcgtgatccgcccgcctcggactcccaaagtgctgggattacaggcgtgagccaccgcgcctggccgagaatattttaaactaccacacttaccatgcatgtggtaaactatcagtctgtatttatcagtgatggttatttcctaatacccaggaggcatccatgtgagccacccttccattgctttaagaccaagggagygagtgaccagcaggattcaagatggcagctctgccgaggagtgggagtcccagctaacttctgctccctgctctcccaccaacagcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggagg

SEQ ID NO: 178854 - DNA, 601 bp, Human
ctcgcaccacgcactcatattccctcaccccaccatcacggccccaaagaaggtcttccctctcgcgaagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccytgggggtccccgccgccagggggcgcccggccccggtagccgacgagacagtagaggtaatagaggccgtcctgcgggagcgccagcccctcggcgtccgagaactgcgtcccgctcgtcagaaacgcctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgc

SEQ ID NO: 178855 - DNA, 601 bp, Human
agacaggagaggtgggtggggtttgggagccagagttttggttctctacacctccaatccaaggtgtctttgggtggggagtctagtcaaggggccctgggcctcgcgctagagatgtggagggccctacagagaggggctgccctctaattagcaagtggtgacctcattggcccaagggacacctccccctaagctgagggtgattcatctctctgtctccggcttccttcctgtcaaggatgtgggggaagggacagtgaggatgaggcctgggcagctaaggctacccctaacctgytgccagggtctcccagcacaagtcctctgactgcaataaccatcctctcacaggacacagggccggaatctctgcggcacagcctcacccacgagtaaaaatagccccggaggcgaatgtgagagtgaggtggggaccacacctaagggggcggacccaagcaggctccgacttccctgggcccagggagagggaatggctgcccgagaaacccaagcagaagggagagggagacacaggcagagacacacaaagatgagagaaacaaaaggggggaaggggaaagaaaggcggcaggaa

SEQ ID NO: 178856 - DNA, 601 bp, Human
ggcttgtgaggtccctgtcgggcgcccctcttggcagccactaggatgcgctcactccccaaaaatgcagcagccccgcccccttaaccctcagctgctcgctaccgcagggactggaagtccagcccgggacccgcaggggttatgggacagaaggagaaagctggagaggcaggggctggggaatggaagtcctgaatacccgaacgagaagggagagaggtgggtaggaagggaggagttcgagcctaaggagttaagcatcctctctccgccctggctggtcacgctgcccctagcrcgacctagtataaaccagaccgagtcccgaaggactgggagaggtctaaaacgaaatgcgaggggcggggtaacagggggcgtggttccggggcgctggcactactcccggctccaggacccggttccccgtctatgtcccaaagtccaccccgcctagctccgcgcccaaataccggctccccatactctctgtctggtgcaggcatgggcccggcacccccaaactccggcccccacacggttcagggccccccacgcaagactcacctccagcggccacccccactcctgtcgcgct

SEQ ID NO: 178857 - DNA, 601 bp, Human
tcctcctgccatctctaggcgtccctcccactccgccccacccactccagaccttccgctcctgtcgacctcactctacccagcaccctcaggggtcagattctttaagaggagcctgaggaacaaggctagggtctctaatctccaaaacacctgttgcccctgcttgggggcttgtgaggtccctgtcgggcgcccctcttggcagccactaggatgcgctcactccccaaaaatgcagcagccccgcccccttaaccctcagctgctcgctaccgcagggactggaagtccagcccgsgacccgcaggggttatgggacagaaggagaaagctggagaggcaggggctggggaatggaagtcctgaatacccgaacgagaagggagagaggtgggtaggaagggaggagttcgagcctaaggagttaagcatcctctctccgccctggctggtcacgctgcccctagcacgacctagtataaaccagaccgagtcccgaaggactgggagaggtctaaaacgaaatgcgaggggcggggtaacagggggcgtggttccggggcgctggcactactcccggctccaggacccggttccc

SEQ ID NO: 178858 - DNA, 601 bp, Human
atggggtatcttcaaacataggctgctctctgcctctcatttcctcagcgggcgcccaggcccttccgacccccacctgcaccccctccctccctaggctggtcccgctccgcacccggaacgtgtccgccacgatctcagctcctcggtgattggtccatttggagaggcctacgaaaaactcccggcctgagtccgggaggccgcggaggtttgagggcgggagtgagttagaaacaaggctccagacggccgagtctcccaaactctacttccctgtgccaagacctatgcctccccscagcctcaccggtgaagagaacgtcagtgccatccagcgtcgcgttctcgtctcctatttccacaattcggagccccaggtcttgcagggctttgcggactccatcgaccttaggataggagaagagggcacggagctgtgacacccccatcctcaattcttccccaaagccccgacatccagttccttctgcctttccccataccacacccgcgccacggcgctcacctctggcctacgagcggggctccagggccgcgtgattagggccgtgtccccttggatcacggccgtgtcgcc

SEQ ID NO: 178859 - DNA, 601 bp, Human
aggtgccacctttggggtttcctgaaactccggaagagcaaattaatcacccctgttcccagtcctgctgttgtaacttcttattttctcctgtgttctttcatgtaagatggacagcccattgagggcaggggttagggctaatttcctaagcctcccagctcccggcctcccgggcccagaactgcgcccactttcgttggccccgccccctcctcacccggacagccttttgggcagcgtcgctgctgcctgccacaacagtgcgaggtccccccatgccgcagagaccgcgcaggtgggagggacccgagactggcacagtggagacggcgaagtcctagggagagcgaagggaggtattcaggggcgcgggaggggtgatggggtatcttcaaacataggctgctctctgcctctcatttcctcagcgggcgcccaggcccttccgacccccacctgcaccccctccctccctaggctggtcccgctccgcacccggaacgtgtccgccacgatctcagctcctcggtgattggtccatttggagaggcctacgaaaaactcccggcctgagtccgggaggccgcggaggtttgag

SEQ ID NO: 178860 - DNA, 601 bp, Human
tcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagatggtgtttcaccatgttggccagggtggtctcaaactcctgaccttgtgatccgcccaccttggcctcct

SEQ ID NO: 178861 - DNA, 601 bp, Human
ctcaagcttctccagagaggtggggatggaaccatgaattcctctgctctctgggattgcagatgtgttacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagayggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaagttttatttggcttatggttctggatggttggaaagctcaaaattgggcatcttcactggtgagagcctcagactgcttcaactcatggaagaa

SEQ ID NO: 178862 - DNA, 601 bp, Human
ttgacaaccagctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggytgttttttggtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagc

SEQ ID NO: 178863 - DNA, 601 bp, Human
agctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggttgttttttkgtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagccactgtgcc

SEQ ID NO: 178864 - DNA, 601 bp, Human
aatccccagtctgttgttacgagtgccaaacaggatgagaatatgactcgatttctgggaaagcttggtaaggacttggtaaaggatagagggaaaatggggaaggactaatatatggaatattccagggggctagaattgggtgagagggagtgtcagacagaggtagaaggactgagatgtaaagaatgatagccttttctttcctcccccacagcctcccaggagcacagagagcctaaaagacctgaaatcatatttttgccaagtgtggattttggtatctccttccttttgcttwgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataacctgcagcttattgggaagcctctgcttaagtcatgtctagggatgagggcctcccctgaggagtggtgacactttttggacagggttttattgttggaattctccccattaagttaaagccttttatcaccaaaccaaaaggca

SEQ ID NO: 178865 - DNA, 601 bp, Human
cagacagaggtagaaggactgagatgtaaagaatgatagccttttctttcctcccccacagcctcccaggagcacagagagcctaaaagacctgaaatcatatttttgccaagtgtggattttggtatctccttccttttgctttgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataayctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccag

SEQ ID NO: 178866 - DNA, 601 bp, Human
ttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagagtctgaaaatttggttcttgctctagctttccattaactgcctgtgtgagcttgggcaagtcaaataatctctcttgcttctattgtctcattcttaaamtggggtgaaaaaattgagctacaagaccgttccctttgcttgcctccctcaaataggtctggagataagcaaacaacgcctcctttctggaaactactccttcatcccagacgccatgactgccactgagaaaatcctcttcctctcttccattattccctttgactgcctcctcacagtgagattggtcctgggggataagggctgggaggcggcacaagtgctagggctgaattctgggaggtactggcctagccctggaaaatagtaactttccctggtgctctgcagcccccagga

SEQ ID NO: 178867 - DNA, 601 bp, Human
ctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctcaggggatccactcgcctcagcctcccaaggtgctgggattacaggcatgagcgaccgcgcccggccgtccagttttttacatatgtgtgttgggctcttgagttttttgtttstttgtttgttttttagatggaatcttgctgtgtcacccaggctggagtgcagtggtacaatttaggctcactgcaacctccgcctcttgggttcaagtgattcttctgcctcatcctacctcagcctcctgaatagctggaactacaggcctgcaccaccatgcccagctaatttttttgtatttttagtagagatggtgtttcgccatgttgcccaggctggtctcaaactcctgagctcaagtgatcctcctgccttggcctcccaaagtgctgggattataggcatgagccaccctg

SEQ ID NO: 178868 - DNA, 601 bp, Human
caggcatgagtcactgcgcctggccgtcactccactttttaaatagcctaagtagaaagaaaataacataaaccttaggaggttttcccattaccttcaggattaagattagcatcttaagcagtataatgatgttcagggtccatcacgtttaccccagttttaatttccagactcaccttccaaagccccttctaagtcctttcctactggatctaccttatattctagtcatttagggccacttgccattatggaaacatgtcatgcctgtgtttatgctgctccttctggaaagtcttttttttttttttttgagacggagtctccctctgtcacccaggctggagtgcagtggcgcggtctttgctcactgcaacctccacctcccaggttcaagcaattctcctgcctcagcctccggagtagctgggattacagggacccaccaccatgcctggctaatttttgtatttttagtagagatgggatttcaccatgttggccacgctggtcttgaactgctgacctcgtgatctgcccacctcggcctcccaaagtgctgggattacaggcataagccactgtgcccggcctggaa

SEQ ID NO: 178869 - DNA, 601 bp, Human
gttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatgtgtrtcttgtaggagttaatttaggataatctctgaggtcatctccaggtaatcagcatctccaggaatcggcagggtaatttaattacccacacattcttcagtgcttcaggtgcagatctttaatctcagccacagatgggagggagagaattctcagtggagaagagagctggatttaaggtcggggaggaatgcgtattccccaaatggaatcagacagggcatgagatcatataacttgaagaatcatcatataatctaatgaactaaggacaggtgacatatttattaatatttctgt

SEQ ID NO: 178870 - DNA, 601 bp, Human
ttctcagttgttaaatttacagtttggtttaactaaagtctctcccagtacgagcagggcgtgagtcagagatacctaagtgtttagtgcagcgcatgtgctttctaaagtggggatggctatttacagactggcctacactgttctggtgggagccctcagtgaccaaggagcagaggtacctgaaacccacccttgaagccatctggatgctccgcttcattcaaatctggggtgttctaacccaaagtaactggccacagactgcaatgtaagatacaaatcttcaggacctagtgtrtgcacatgttggctcttatataagatggcatccttagtacttgttctatgtagaaaagaatttgtgggctcacaagtccctacagagtctcacactctcatggccaataagtatacagggatacccggaattagacaaacacagatgagacatttatttctgtatatgaatttattttatttatttatttattttttgagacagagtctcactctgtcacccatcctggagtgcagtggcctggctcattgcaagctccacctcccgggtttacaccattctgcctcaccctcccgagta

SEQ ID NO: 178871 - DNA, 601 bp, Human
tactaaaaatacaaaatttagctgggcatggtggcacacacctgtagttccagctgctggggaggctgaggcaggagaatcacttaagcctgtgaggcagaggttgcagtgacccgagatcccgccactgtaccctagcctgggcgacagagcaagactccatctcaaaaataataataataatacaaatatctatatatccatcagccaatttaagaataagacatgccgggcgcggtggctcatgcctgtaatcccagcactttgggaggccgaggcgggtggatcacaaggtcaggarttcaagaccagcctggccaagatggtgaaaccccgtctctactaaaaatacaaaaattagctgagcacagtggcgggtgcctgtaattccagaacctgggaggtggaggttgcagtaagccaagattgtgctactgcactctagcctgggcgacagagcaagactctatataaaaaataaaataaaaaaaaagaataagacactattggccgggtatggtgactcacgcctgtaatcccagcactttgggagccgaggcgggcagatcacgaggtcaagagatcgagatcattctggcca

SEQ ID NO: 178872 - DNA, 601 bp, Human
gcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctctttttttttttaactttgtattcaggaaaatgtaaaaaatatttagaataatataattaacccccatgtacccaccatgcagtttcaacactttaacttacgccaattttttttttatttctttttctttttttttttagacagagtcttgctctgtcgcccaggctggattgcagtggtgcgatctcggctcactgcaacctctgcctcccaagttcaagtgattctcctacctcagcctcccaaatagctgggattacaggtgcccaccaccacactggagtgatttttgtatttttagtagagatgggatttcaccatgttggccaggctggtctcaaattcctggcctcaagtgatctgcccatctcggcctcccaaagtgctaggattataggtgggagcca

SEQ ID NO: 178873 - DNA, 601 bp, Human
tgctgcacctggctttcttggattattttgaagcaagtcccagccattatatcatttcatccataaatatttcagtgtaatttcttttttctttttttttttttttttgagatggagtctcactctgtcaccaggctggagtgcagtggcatgatctcggctcactgcaacctccgcctcccaggttcaagcgattctcctgcctcagcctcccatgtagctgggataacaggcacatgccaccatgcccaagttttttttttgtatttttagtagagacagggtttcaccatgttggccrggatggtcttgatctcctgacctcgtgatccacccgcctcggcctcccagagtgctgggattacaggcgtgagccacctcacccggccaatatttcagggtaatttctaaaagaaaattattttttaaaaagaataacagtattgttatcttactttaaaaattgtattatttggtatcatcaaatatctgaaatttttcttttttgagacagggtctcactctgtcacccaggcttgagtgcaatggcacaattgtagctcactgcagcctcaaactgttgggctcaagcgatcctccc

SEQ ID NO: 178874 - DNA, 601 bp, Human
gtttaatacctaaatctattattcatttatttatttatttatttagtttgaggtgagtctccctctgtcgccaggctgaagtgcagtggcacgatcttggctcactgcaacctccgcctcctgagttcaagtgattctcctgcctcagcctcctgagtagctgggacttacaggcgcacaccaccacgcccagctaatttttgtatttttagtagagacgggatttcaccatgttggccaggatggtcttgatctcttgacctcaggtgatccacccgcctcagcctcccaaagtgctggsattacaggcgtgaaccactacacccagccatctattaattctttagcaattacaaagtagtagcatttaaatctctgattctttcttcatttattagccagaaatttctgtaaagagaaacttccttttatgtactatttggttgccaagtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaag

SEQ ID NO: 178875 - DNA, 601 bp, Human
gtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcct

SEQ ID NO: 178876 - DNA, 601 bp, Human
tcagggaagagcatatacctcaaacaggtgaggagaagccctgcagcctgggcctctggcgtctcctgcatctactccacccctacttgccagccaactcaggctcctgcagctcttctcccattttctgaccccgctcttcatgaaaggaccatcacccacatccctgtgcttccacctcacatgttcttattctccactggagagccatgctctaatggaactttccgtggcccaaattccttcacctgcctctgagtaggtacacaccactcccaagtatgtctctgcccacgtcccrtgcctcttcactgattctaaattagcccacagggctatggtcaggattcggggaggagagacagagtcagtgtgtctgttacctatttctcctgtttcaccctgtccatttctctttgatgtgccattcatgccttgagcctcactttcacctcagcccacggcaccaggccccaggccctgtctccttccctattcaggtaggcttgatcacattcatggccctggtaggcagctttgtgccagcagaggaggccgaaattggggcagtagacgccatcttcacacgaattcatagctg

SEQ ID NO: 178877 - DNA, 601 bp, Human
aggggagaaactaaggaggggaaaatggaggaggatgaaggagcatgacagtgaggctgggcctctggaatggaatagggctgtgtgggcagaaaagaaatagaacacgagacagggaaaggcagtgcaagtgcagaggggcatatggggtccccatggctccgaatgctaacctctgccctctttgcaggtggatgggctcgcgcttctggccgctgtgctccgacactggctggcacgtggacccacatgcccccacatctttgtggccaccaactttctgagccttgttcagctacarctgctgccacaagggcccctggtgcagtatttggtgaggagaccaatctagctcctcggggacccccaggctgggcatttcccagaggtggggattggctcctctatcagaacaagggctccctcagcacagagaccacatcccttcccttttctccctccccacaggattggccaagggtttcaggacaggaaggaggtgattgatgatacactgtcttttattctcttttaagaccatggagacctgtgaggatggcaacgatcttgtcttcttctatcaggtttgcgaaggtgttgc

SEQ ID NO: 178878 - DNA, 601 bp, Human; identical to SEQ ID NO: 19057

SEQ ID NO: 178879 - DNA, 601 bp, Human
atagtagagactgaagtcatcacccaccaccgtctcccactcctccagggacccggggtcccctttcgtcagggtcacttctcctgaacgccgggcagaacctaactcctccgactagaaaaagatcagaaaaattgaggccactgacaccctgcgcatttctactgaggatgggatgcagccccacctctgaccctccctcagagcagcccccgaggggtagaggctctgcctctgctgcttaccaggccacctcctgagttcagcttcctccttttggccagatctggaagaagagagmgaatggtgtggggcctatcaccgaaaccttcagaacagaccacatcaagccaccgggggtgggggatgggactgacctgaggtcacctttcccagtgagtggacatcatcactcatgcggaaatgctgtatttcagggggccgcttctcagggaccgggggctgtgggccgagagggagcacactgagggtcagagagcacctacagttttgcctgggttagcctggagccccaggcgggggtggggtagtgagccacacctccaaatgccatgtgaggctccagtagccacaaactggc

SEQ ID NO: 178880 - DNA, 601 bp, Human
gttatagacagcatggggcaatgacttagtggatattcagaagataaaaaggacagaaagcagaaaaacagggaacaaggaggactggacagtgagccccagccctgggggagcaccggcggggagggcagaccagctctgtctcaccttgctgtcggagtccacgcgctcatccacagagtaggaatcatagtagagactgaagtcatcacccaccaccgtctcccactcctccagggacccggggtcccctttcgtcagggtcacttctcctgaacgccgggcagaacctaactcctcygactagaaaaagatcagaaaaattgaggccactgacaccctgcgcatttctactgaggatgggatgcagccccacctctgaccctccctcagagcagcccccgaggggtagaggctctgcctctgctgcttaccaggccacctcctgagttcagcttcctccttttggccagatctggaagaagagagagaatggtgtggggcctatcaccgaaaccttcagaacagaccacatcaagccaccgggggtgggggatgggactgacctgaggtcacctttcccagtgagtggacatcatca

SEQ ID NO: 178881 - DNA, 601 bp, Human
cagatcgtgatattgcgctccagcctgggcgacagaatgagattccgtctccccccacaaaaaaaaggagttatagacagcatggggcaatgacttagtggatattcagaagataaaaaggacagaaagcagaaaaacagggaacaaggaggactggacagtgagccccagccctgggggagcaccggcggggagggcagaccagctctgtctcaccttgctgtcggagtccacgcgctcatccacagagtaggaatcatagtagagactgaagtcatcacccaccaccgtctcccactcytccagggacccggggtcccctttcgtcagggtcacttctcctgaacgccgggcagaacctaactcctccgactagaaaaagatcagaaaaattgaggccactgacaccctgcgcatttctactgaggatgggatgcagccccacctctgaccctccctcagagcagcccccgaggggtagaggctctgcctctgctgcttaccaggccacctcctgagttcagcttcctccttttggccagatctggaagaagagagagaatggtgtggggcctatcaccgaaaccttcagaacagacca

SEQ ID NO: 178882 - DNA, 601 bp, Human
gtaggtgtgtgtgctgggagatgtacagatgggtcaagatggactgtgtactgataatggctggagctgtgtattgggtacatgggggctccctattctactcttttgattatgcttgcaagttttcatgataaaatgttaaataaaaggcaaaatcagagagactaaacattctactgtgtaggcaaacatataagataaaaccagacaaagagcaacgaaataagcaaataaatgacaatgcaatgcttttgaattttatataaacagcataacgtatgttttaaaaaagtgctttctrgtcatttctttttttgttttctttttttaaacagtacatgtctgttaaatggtcatttcattagctgattaaaaaaaaaagaatactaaatcccatgtgcagggtggtggccacctttgtggatgaaacgggcagaatacacattgaaaatgagttacagctgggcgcggtggctcacagctgtaatcccagcactttgggaggccaaggtgggtggatcaactaaggtcaggagttagagaccagcctggccaacacagggaaaccccgtctctactaaaaatacaaaaattagccggg

SEQ ID NO: 178883 - DNA, 601 bp, Human
gccccacctctccgtccacactctcagtggccatgcacttgtgccccgccctctcgctgatgcggtcaatcttgggtgcctccatgcggcagctgcacaggggcaactcctcaaaccctcgctctgtctccagcgaagatgtgtcattggacaccccttggatggaggaaaagaggagctgagggaggctctgcacctcacctactgggacccctggcgggtcctctcactccctccctaccccaccccgccatgccccagaacccctaaagcctggccatggacaccccggctctggcgyggttcccctccttccctttccctcctgccctgaggtcgccccctagtggctccctgtcccggcaattggcaattaccagcgtggttgggggagagggtcccctcgctgggcagctccagggaccccagagggacctccatgtactcactggggcctgaggagcccacaccattcactcctgacacagagacagagagagtgagagtgcgagctcacaggtgcctggacgcgtgggtacatgcaggtggacatgcgagagcgtgtgtgtgcgtgcacacactctggggggccgggcggggg

SEQ ID NO: 178884 - DNA, 601 bp, Human
acaggccttgtggaagcggtgggccacacggaagtcagggtggcactccaggaaggtgccctgggagcagggaaacaacatggtcaggttactggggccccctctgccacagggcatgctacctgtctgccccactggtcactcaccgccgtgcagaagtagccgcagcccgggcagcagtggtgtttgaccatgcgggcgcggtgggtctcacagagcaccatcagggccacacggctggatggcctcatggtctcccgcttgaggatggcggcattgcagcctgacagctgtgcgcagygaggatgggtgagaagagagcgtgaggctggggccggggactggacgccctggcacctctcccaccagcccacggccccacctctccgtccacactctcagtggccatgcacttgtgccccgccctctcgctgatgcggtcaatcttgggtgcctccatgcggcagctgcacaggggcaactcctcaaaccctcgctctgtctccagcgaagatgtgtcattggacaccccttggatggaggaaaagaggagctgagggaggctctgcacctcacctactgggacccctggcgggtcctc

SEQ ID NO: 178885 - DNA, 601 bp, Human
gcgacaacccaataacaataaacactcctaggaacatagattgtattctctaaaaaatgcttctggccgggcgctgtggctcacgaggtcaggagttcaagatcagcctggccaatatggtgaaaccccgtctctactaaaaatacaaaaattagccgggcatggtggtgggcgcctgtaatcccagctactcgggaggctgaggcaggagaatggcgtgaacctgggaggcggagcttgcagtaagctgtgatcacgccattgcactccagcctgggcaacagagtgagactccgtctcaaaaaaaaaaaaaaaagtttcccataaaggaagcagagtttcttagagaaatggtggattctgagttgggggcaggaaatgtgctgaaaggtcaggaggctctcaaaggccactgggccactgggtcatgtcacagccacagaggcctcttaaaggggcttcttctggacaatgatggaataattcaaagactgagaagaatgccaataaatgactaaaacacatccaatgtatgacaacccaagagttaataaaaagcctcactggacactttcagagattaagacaggaactgattatt

SEQ ID NO: 178886 - DNA, 601 bp, Human
tttctcatctgtgtcttccttctttctccattgctgtctccttgttcccacggctctaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcagggtgstacaccaggggccaccccagaacttttgtttaggagttgctcagggtgggacttaacctgactagatggcaaagttgcttttgcagagggcttttcaaaatatccagaaaatgtcaattgccagtagcaaggaattgggaacaggtcttgatggagactgtggggtactaaagccagggatgactttttatgtacaattgactgcctagtagtgaccattcagaacagatgctgaatggtcctggagtcctctagacatctgaggatcccaaggggagtgtctggggaggccacggccct

SEQ ID NO: 178887 - DNA, 601 bp, Human
cccgtgggtggcaatgtgagcttcgagtgtgaggatggcttcatattgcggggctcgcctgtgcgtcagtgtcgccccaacggcatgtgggatggagaaacagctgtgtgtgataatgggggtgagttctctggctgatgggctacacagggggctggggtctcctggggaaccctggggcccaatgtgcatccaggaagcctctgtggggataggagtctgttgttcagtgtgccataataatattcctggattttggtaaattgaggtctacaggtcacacatcacaagtctgcaaggsccaggccccaggcagctggtgctaagcttcagatgtagcataaagcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccat

SEQ ID NO: 178888 - DNA, 601 bp, Human
gcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccatctggattaaatgagttgacattagtaagcatatacaacagccctrgagtgcggtggctcacgcctgtaatcccagcactttgggaggccaaggggggtggatcacaaggtcaggagtttgagaccagcttggccaacatggtgaaaccccgtctctagtaaaaatacaaaaattagccgggtgcggtggcgcatgcctgtaataccagctattcaggaggctgaggcaggagaatcatttgaacccaggaagtggagattgcagtgagccgagattgcatcattgcactccagcctgagtgacagagtaagactctgtctcaaaaaaaaaaaaaaaaaaaaaaat

SEQ ID NO: 178889 - DNA, 601 bp, Human
acaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcrtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaa

SEQ ID NO: 178890 - DNA, 601 bp, Human
tctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcmagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagca

SEQ ID NO: 178891 - DNA, 601 bp, Human
agatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctaccctwctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagtttt

SEQ ID NO: 178892 - DNA, 601 bp, Human
agataagaaggctttgggaatgcatcttttggaagtagtgaatagttctactttactagacaaggctgccaaactaaggttttgaggcttttttatagacaatgtgaagccatttatggtttttgagaaacagagggagcagaattttgtgttttcaatggatcatttgaacaggagtgaagaagtctgttcaaaaaaaaagactgagaaatttgttgagagaccattacaatggcccacatgaatgtcaataaagccctgctcgggggaatgcacagtgaagaataaacaggaaaaattmcttcaaaagaagaaacaataagacttggcaaaggtttgactatgcaaatagtggggaagtcagagttttgagtccaaacatgtggcagaattggtgtagtcaatcttatttggaagatcaagaatagaaagatgatagcttcaacactgagtatctgaagtttttcagtataacactggatagaactggaaaaaacaaacttggggatcatcagctcttaagcggtactaaaagccatgggaaaggaagacaatccatggcaaattgcatagaaaagacagaaggtccacaccaaggctt

SEQ ID NO: 178893 - DNA, 601 bp, Human
atttttagtagagacggggttttaccatgttggccaggttggtcttaaactcctaatctcaagtgatctgcccacctcagcctcccaaagtgctgggattacaggcatgagccaccacgcccagctggtattttttataagtgactcgatatattatgtattcagtttatttgaacctctcttgaacctgataacattttcagccctttccatcccttagggcaacatattccaagagctccaatccaaggtggattagaaccacagaatttgtaaaatggagaattcaggagtcgtctarttttttcattttatacatgagaggtgaaactcagaatggtacagcaatttgccagtgcttgagtatgcatatttttccccaaacccatctacattccaacttggagggatgccctttaaacaatctttctgcttgtgctcacctttaacttcccctcaagggttcgagaacgcttgaagcctgagttcttggtctcagccttgatggcactgatggctcctgacttcaccagctgctttgcctgctctgttgctgtggctgtgtccatgacaggctgctctgatagtgctggagagacaa

SEQ ID NO: 178894 - DNA, 601 bp, Human
caagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacrcaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctgtgttccagatcct

SEQ ID NO: 178895 - DNA, 601 bp, Human
catcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctayagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtct

SEQ ID NO: 178896 - DNA, 601 bp, Human
aagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcractatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttgg

SEQ ID NO: 178897 - DNA, 601 bp, Human
tccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgrtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtg

SEQ ID NO: 178898 - DNA, 601 bp, Human
agagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgygggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggaggtga

SEQ ID NO: 178899 - DNA, 601 bp, Human
gaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggccyggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaagg

SEQ ID NO: 178900 - DNA, 601 bp, Human; identical to SEQ ID NO: 178898

SEQ ID NO: 178901 - DNA, 601 bp, Human; identical to SEQ ID NO: 178897

SEQ ID NO: 178902 - DNA, 601 bp, Human; identical to SEQ ID NO: 178896

SEQ ID NO: 178903 - DNA, 601 bp, Human; identical to SEQ ID NO: 178895

SEQ ID NO: 178904 - DNA, 601 bp, Human; identical to SEQ ID NO: 178894

SEQ ID NO: 178905 - DNA, 601 bp, Human
cagcagtcaataactctcttcttcccagccccacataactctttatattaaaaagacccaagatcaggcgtggtggcttatacctgtaatccaagcactttgggatgccaaggtgggaggatcacttgagcccaggagtttaagtccactctgggcaacataggaagaccccatttttacaaacaataaaaaaaattagccagacatggtggcatgtgtctgtggtcccaactactcaggaggctgaggcaggaggatcacctgagctcaggaggtcaaggctacagtgagctgtgacccygtcactacactgtagtttgggtgacagagggaggccctatctcaaaaaaaagcaaaaaacaaaaaacaaacaaacaaaaaaatcttcactgctagataaccaaaggggatgtggaaaatgaagatattaaggaaacggcaaaggtagtggagaaggccccccacacctcacacacctcatgactcatagcacacaaatcatttaaatcatttctttgtcacccacgggtgaagggaatgaagcagagtccccgtcacagagagtaagagggatatggctctctcacctcgctggatggct

SEQ ID NO: 178906 - DNA, 601 bp, Human
gcccctgcttttgcagtctccatccagtgaacagtaacatcacccacccacagccatcctagccacaaacctctttgactcctacctctctccaatgtccaggaggtcacaactcatctattccacttcattctttctcaagtctgctttcttcatgacatccgaatatcttacttgatcaactgcataagcttcttccttggttctcttgcctctggccctgcccctctgcaacccattctctactttgccactagaatcatcttcctaatcatattacttccctgcttaattctccaawggcccccacctatccacaggataaaagctaagagccccttagcaggggccccacctggccctgtagcccctgcagttccacatcactccccaaatccttcttacatccactctgaagaaatgcagggtcctcagacacaagtcaacccccacactgtcctcctggctaatttctacgtgtcctttaaaactctcaggaaacccttcttccaggggcacatcccagattcagcgccaatgtggatgaaatgtcccctcttatgagctttcatggtaccctctagtgatttttttttttttt

SEQ ID NO: 178907 - DNA, 601 bp, Human
cctccaaatccactttccatccctccctgctgtgctccctgagatccagggagaatctgaatggactgcatcagcgggctccctggttggagttcagccagtgagagatggtgccaggagatccagaaggtactttgaaatcaacaatcaacatgtcaactgggcatggtggcttacgcctgtaatcccagcactttgggagccaaagtgggtggatcacctgaggtcgggaattcaagaccagcctaacatgaaagaagccctgtctctactaaaaatacaaaattagccaggcgtggtrgagcatgcctgtaatcccagctactcaggaggctgaggcaggagaatcgcttgaacccaggaggcagagattacagtgagccaagatcacaccactattgcactccagcctgggcaacaagagtgaagctccataacaacaacaacaacagaatcaacatgtccaacgctgaattcatcatcttccctgaccagaaagcccctgcttttgcagtctccatccagtgaacagtaacatcacccacccacagccatcctagccacaaacctctttgactcctacctctctccaatgtccagg

SEQ ID NO: 178908 - DNA, 601 bp, Human
atttaaccatggctgggcatggtggctcacgcctgtaatcccagcactttgggaggccgacacccaacgcaggtggattgcttgaagccaggagtttgacaccagcctgaacaacatggcaaaaccctgtctctaccaaaaatacaaaaaaatagccggacatggtggcacgtgcctgtagtcctagctattaggggggctgaggcaggacaatagcttaaacccaggaaacggaggttgcagtgagtggagatcacgccaatgcactctagcctgggtgacagggcaaaactctgtctcaaaaaaaaaaaaaaaaaaaaaaaaagggaactatttaaccatgatgtattataaccctcacaaaactctccaaaagcaagaactatgtctcatgtccattgagggtaaagtacaggccctcaaaaaatacctaagtatggaggagaatctgactctaataacactatgcaatgcaaagccaccaacaatccttacaatccttttgctgctaatagcagtgggcgatctcggctcactgcaagctccgcctcccgggttcaccccattctcctgcctcagcctcccgagtagctgagactac

SEQ ID NO: 178909 - DNA, 601 bp, Human
gcatcctgaaggggacagggactctgtcttcacttccaggacctcctctcctataaaagcctatgtggggcattccagagatacattagtcaggaagagtgtcgaggagaaggagctgaagaagggaaagctctcatacctctaggtcaggaggaactcactggaaaacctggaggaaggaaggaaggtggtgctcacctggctggaggagtcggctgagagcagggaggcctcagagttgacggaagaacatggagagacaggttctatcttggtctggacatctgtgggaggcaggatkaggcaaaagctggatatcatgtaaacactgaagggttaagagggttaagatgggaggctgggcatggtggctcacgcctgtaatctcagcactttgggaggccaaggcgggcagatcacctgaggtcaggagttcaagaccagcctgaccaacatggagaaaccccgtctctactaaaaatacaaaattagtcgggcatggtggcgcatccctgtgtcccagatactcaggaggctgaggcaggagaatcgcttgaacctgggaggcaaaggttgcagtgagccaagatcgcgccattgc

SEQ ID NO: 178910 - DNA, 601 bp, Human
tgcggagccagacgcctgtattgggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggtgcgtcaacgtggtggg

SEQ ID NO: 178911 - DNA, 601 bp, Human
ctgggattacaggtgtgaaccattgcacctggcccagaatgttttaagtgtgtcaccttattgccttagaaggtttagtctgatgtgggagtcagcaaaccttgtctataaagggccagagagtaaatatttttgactttgtaggacatatagtctgtttcacaactcctcaattctgctgttgtagtgtgaaagcagccatgtaccatatgtgaatgaatgtgcctgtgttccagtaaaacttcatttacaaaaacaagtagcaggctggatttggtcctttggtcacagtttgccaacytctagaccagaccatggggccagaatacttgggtttgaatcttgaccctattgggtgcctttgggcaagttacttaaccattctgttactcagttttccttatctgtaaaatattatagcatgtacttcaccaggtggttgtaaggattaaataaataaatgaatgcaatgtactttgaatagtacctggctcatatagtagatactagatagaagtacttgctattgccaggtgtggtggctcacacctgtaatcccaatatcttggcagggggaggtgggcgcatcacctgaggtcgg

SEQ ID NO: 178912 - DNA, 601 bp, Human
gcactccagcctgggcaacaagagcgaaactccatctcaaaaaaaaaaaaaaaaaaaaaatatatatatatatatatatatcctcatccctatttcccgacagtcccggtaaccaggcttttgatttttttttttaaattctgagtgagatgggaaggcactggacagttttcagtgaaggcaggacatctcttaaaatattgtaataatataatagtaagtgatgagttttatgtacatcatgtcatttcacatctaccacaaccctatgaatgacagtgatagctcatggttatataasatttttaatgttccaagtcactgtttcttccttttttttttttttgagacagagttttgttcttgtcgcccaggctagagtgtaatagcacaatctcggctcactgcaacctccgcctcctgggttcaagccattctcctgcctcacctcccaagtggctgggactacaggtgcccaccaccatgcctggctaatttttagtatttctggtagagacggggtttcactgtgttagccaggatggtctcgatctcctgaccttgtgatccgcctgcttcggcctcccaaagtgttgggatt

SEQ ID NO: 178913 - DNA, 601 bp, Human
ttttttgtatttttagtagagacggggtttcactgtgttagccaggatggtttcgatctcctgacctcgtgatccacccgcctcggcctcccaaagtgctaggattataggcgtgagcccacgcacccggccttgcctggccaatattttttaattaaaagattttaactccatctggctgggtgcggtggctcacgcctataatcccagcactttgggaagccgaggcgggtggatcacctgaggtcaggagttcgagaacagctggctaacattgagaaaccccatctctactaaaaayacaaaaattagtgggcctggtggcgcacgcctgtagttccagctactcaggaggctgaggcaggagaacttgaaaccaggaggcggaggttgcaatgagccgacagggtgccactgcactccagcctgggtgacagagcaaggctctgtctcaaaaaaaaaagaaaaaaaggattttaagacctttctattttgaaataatttcatacttaagaaaagtttgcgcctgtaatcctagcactttgggaggccgaggcatgagcccaggggtttgagaccagcctgggcaacatggcaaaac

SEQ ID NO: 178914 - DNA, 601 bp, Human
ttgtttgtttgtttgtttgagttggagtttcactcttgttgcccaggctggagtgcaatggcaaatctcggcccactgcaacctccgcctgccaggttcaagtgattctcctgtcttagcctcctgagtagctgggattataggcgcccaccaccatgcccaactaattttgtatttttagtagagacggggtttctccatgttggccaggctggtcttgaactcctgacctcaggtgatccaccctccttggtctcccaaagtgctgggattacaggcatgagccaccacacctggcctyttttttttttttttttgagacaaagtctcactctgtcgccaggctggagtgcagtggcgccatcccggctcactgcaacctttgcgtcccagaatcaagcaattctcctgcctctgcctcctgagtagctgggattacaggcgcccaccacgcccagctaattttgtatttttagtagagacagggtttctccgtgttggccaggctggtctcgaattcctgacctcagatgatccaccctcctcggcctcccaaagtgctgggattacaggcttgagccaccacgcccagctaattttg

SEQ ID NO: 178915 - DNA, 601 bp, Human
ctctgtcacccaggctgaagtgcagtggtgcgatctcgactcaatgcaacctccacctcccgggttcaagtaattatcctgcctcagcctcttgggtagctgggcttgcaggcatctgccaccatgcccagctaatttttgtatttttagtagagatggggtttcaccattttggtcaggctggtcttgaactcctggcctcaggtgatttgccctccttggcctcccaaagtgctgcaattacaggcgtgtgccactgcgcccggccagattttctccagctcttctgataacctccccscaaatctctttgtagcttctttggtttctatgatgcaaatgagaccgtcctggagatggaggagcaactggtgagccccctgggattacttccccttctagccgctgtcccaccttattccagagccctctctgtgactcctgagctgaagggttcaccctgtggggaggaggtccaggatcccagcagtaactcactttgtctctccttgtgtctctcttccatgcttccacgccccttcgaccaccttgaaggtttatctgcgggattcttttgggttgaagactctattggcccggg

SEQ ID NO: 178916 - DNA, 601 bp, Human
ggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgtgacttggctcatttccaggtggaggggacctggctccccaaggagggtgggggcggagcctgaggcctgggt

SEQ ID NO: 178917 - DNA, 601 bp, Human; identical to SEQ ID NO: 38932

SEQ ID NO: 178918 - DNA, 601 bp, Human; identical to SEQ ID NO: 38933

SEQ ID NO: 178919 - DNA, 601 bp, Human; identical to SEQ ID NO: 38934

SEQ ID NO: 178920 - DNA, 601 bp, Human; identical to SEQ ID NO: 38935

SEQ ID NO: 178921 - DNA, 601 bp, Human; identical to SEQ ID NO: 38936

SEQ ID NO: 178922 - DNA, 601 bp, Human; identical to SEQ ID NO: 38937

SEQ ID NO: 178923 - DNA, 601 bp, Human; identical to SEQ ID NO: 38938

SEQ ID NO: 178924 - DNA, 601 bp, Human; identical to SEQ ID NO: 38939

SEQ ID NO: 178925 - DNA, 601 bp, Human; identical to SEQ ID NO: 38940

SEQ ID NO: 178926 - DNA, 601 bp, Human; identical to SEQ ID NO: 38941

SEQ ID NO: 178927 - DNA, 601 bp, Human; identical to SEQ ID NO: 38942

SEQ ID NO: 178928 - DNA, 601 bp, Human; identical to SEQ ID NO: 38943

SEQ ID NO: 178929 - DNA, 601 bp, Human; identical to SEQ ID NO: 38944

SEQ ID NO: 178930 - DNA, 601 bp, Human; identical to SEQ ID NO: 38945

SEQ ID NO: 178931 - DNA, 601 bp, Human; identical to SEQ ID NO: 38946

SEQ ID NO: 178932 - DNA, 601 bp, Human; identical to SEQ ID NO: 38947

SEQ ID NO: 178933 - DNA, 601 bp, Human; identical to SEQ ID NO: 38948

SEQ ID NO: 178934 - DNA, 601 bp, Human; identical to SEQ ID NO: 38949

SEQ ID NO: 178935 - DNA, 601 bp, Human; identical to SEQ ID NO: 38950

SEQ ID NO: 178936 - DNA, 601 bp, Human; identical to SEQ ID NO: 38951

SEQ ID NO: 178937 - DNA, 601 bp, Human; identical to SEQ ID NO: 38952

SEQ ID NO: 178938 - DNA, 601 bp, Human
ggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtggggttgagggagtggctcaccccacagactgaggaccagcacccaggctccaactgctgttccggcwgccatcctgcttccttccagggtcctggctctgtctgcccctctccctgctgtggcctccgccctaggtggggcctgcaccctctctccagcccccatctttcagtcgtcttgtcacagggaatgctaggaattcatgcctttgggacaagagtccttcaggtactagagaaataattatcaccccacccctgggtactaccagcctctgggtacagtcacttccctgggggatggggagtgtaccctctagggtctcattccctcagagcccccgatcctatttattccatcagtccat

SEQ ID NO: 178939 - DNA, 601 bp, Human
ggctgcaacaggagccccgcttaccagtttccattccagccgctggggtggtttcttgggggcccccttacacttcagcaccagtggctcgccaatccgggctgtgatgttttgagcacctactactgcccctgggagatagcaccatggtagaggggtaggaagggaatgagggctaacaaaatttggacagggtgggtgagggaccttgaaaggcacttcctcgggttctgggaaaagttctaggacgactggggtgtggggttaaagtgctttctgcagggagggtcagtggggttgrgggagtggctcaccccacagactgaggaccagcacccaggctccaactgctgttccggctgccatcctgcttccttccagggtcctggctctgtctgcccctctccctgctgtggcctccgccctaggtggggcctgcaccctctctccagcccccatctttcagtcgtcttgtcacagggaatgctaggaattcatgcctttgggacaagagtccttcaggtactagagaaataattatcaccccacccctgggtactaccagcctctgggtacagtcacttccctgggggatggggag

SEQ ID NO: 178940 - DNA, 601 bp, Human
tggagtttcacttttgttgcccaggctggcatgcaatggtgcgatcttggctcatcgcaatctatgcctcctgggttcaagcaattctcctgcctcagcctctcaagtagctggcctcccaggtagctgggattacaggcatgtgccaccatgcctggctaattttgtatttttagtagaaatggggtttctccatgttggtcaggctggtctcgaactccctacctcaggtgatctgcccgcctcagcctcccaaagtgttgggattacaggcgtgagccaccgcgcccagccgtctgtycctttttttagctcagagggaagaagggagaggcttggctgctctcttggcagaatttgggtggggcaggggaggcttgggtgtgggtgcatggagggagaggtggggtggctgttagggataaggccagaatggggcaggaaattagagcctgtgctgtcctgcaccctagtcccagggtctgtagggcttggggagaggtctcaccgatgatgctgatgctgacagcacggctttcctggggcccgtggctggaatgggtggccacacagctgtaggttccctggtcctgaggcccta

SEQ ID NO: 178941 - DNA, 601 bp, Human
gttatttagtgggagccccagtggagtctttccctttctttttttttttgagatggagtttcacttttgttgcccaggctggcatgcaatggtgcgatcttggctcatcgcaatctatgcctcctgggttcaagcaattctcctgcctcagcctctcaagtagctggcctcccaggtagctgggattacaggcatgtgccaccatgcctggctaattttgtatttttagtagaaatggggtttctccatgttggtcaggctggtctcgaactccctacctcaggtgatctgcccgcctcarcctcccaaagtgttgggattacaggcgtgagccaccgcgcccagccgtctgttcctttttttagctcagagggaagaagggagaggcttggctgctctcttggcagaatttgggtggggcaggggaggcttgggtgtgggtgcatggagggagaggtggggtggctgttagggataaggccagaatggggcaggaaattagagcctgtgctgtcctgcaccctagtcccagggtctgtagggcttggggagaggtctcaccgatgatgctgatgctgacagcacggctttcctggggccc

SEQ ID NO: 178942 - DNA, 601 bp, Human
ctgatcctcccacagagcctgtacggagacagggaaaattgagagcacagccaccaccactcaccattcctttcttgttgaccatccccccagtcacatgtgttgggggctatcttctgcttccctgactttatcaaacccctcacctgcagttggcccctcctcgcctggttctggaagacaaagttggatccagtcagaaaggaagacttcgggttgagagagggttatttagtgggagccccagtggagtctttccctttctttttttttttgagatggagtttcacttttgttgccsaggctggcatgcaatggtgcgatcttggctcatcgcaatctatgcctcctgggttcaagcaattctcctgcctcagcctctcaagtagctggcctcccaggtagctgggattacaggcatgtgccaccatgcctggctaattttgtatttttagtagaaatggggtttctccatgttggtcaggctggtctcgaactccctacctcaggtgatctgcccgcctcagcctcccaaagtgttgggattacaggcgtgagccaccgcgcccagccgtctgttcctttttttagctcagaggga

SEQ ID NO: 178943 - DNA, 601 bp, Human; identical to SEQ ID NO: 38977

SEQ ID NO: 178944 - DNA, 601 bp, Human; identical to SEQ ID NO: 38978

SEQ ID NO: 178945 - DNA, 601 bp, Human; identical to SEQ ID NO: 38979

SEQ ID NO: 178946 - DNA, 601 bp, Human; identical to SEQ ID NO: 38980

SEQ ID NO: 178947 - DNA, 601 bp, Human; identical to SEQ ID NO: 38981

SEQ ID NO: 178948 - DNA, 601 bp, Human; identical to SEQ ID NO: 38982

SEQ ID NO: 178949 - DNA, 601 bp, Human; identical to SEQ ID NO: 38983

SEQ ID NO: 178950 - DNA, 601 bp, Human; identical to SEQ ID NO: 38984

SEQ ID NO: 178951 - DNA, 601 bp, Human; identical to SEQ ID NO: 38985

SEQ ID NO: 178952 - DNA, 601 bp, Human; identical to SEQ ID NO: 38986

SEQ ID NO: 178953 - DNA, 601 bp, Human; identical to SEQ ID NO: 38987

SEQ ID NO: 178954 - DNA, 601 bp, Human; identical to SEQ ID NO: 38988

SEQ ID NO: 178955 - DNA, 601 bp, Human; identical to SEQ ID NO: 38989

SEQ ID NO: 178956 - DNA, 601 bp, Human; identical to SEQ ID NO: 38990

SEQ ID NO: 178957 - DNA, 601 bp, Human; identical to SEQ ID NO: 38991

SEQ ID NO: 178958 - DNA, 601 bp, Human; identical to SEQ ID NO: 38992

SEQ ID NO: 178959 - DNA, 601 bp, Human; identical to SEQ ID NO: 38993

SEQ ID NO: 178960 - DNA, 601 bp, Human; identical to SEQ ID NO: 38994

SEQ ID NO: 178961 - DNA, 601 bp, Human; identical to SEQ ID NO: 38995

SEQ ID NO: 178962 - DNA, 601 bp, Human; identical to SEQ ID NO: 38996

SEQ ID NO: 178963 - DNA, 601 bp, Human; identical to SEQ ID NO: 38997

SEQ ID NO: 178964 - DNA, 601 bp, Human; identical to SEQ ID NO: 38998

SEQ ID NO: 178965 - DNA, 601 bp, Human; identical to SEQ ID NO: 38999

SEQ ID NO: 178966 - DNA, 601 bp, Human; identical to SEQ ID NO: 39000

SEQ ID NO: 178967 - DNA, 601 bp, Human; identical to SEQ ID NO: 39001

SEQ ID NO: 178968 - DNA, 601 bp, Human; identical to SEQ ID NO: 39002

SEQ ID NO: 178969 - DNA, 601 bp, Human; identical to SEQ ID NO: 39003

SEQ ID NO: 178970 - DNA, 601 bp, Human; identical to SEQ ID NO: 39004

SEQ ID NO: 178971 - DNA, 601 bp, Human; identical to SEQ ID NO: 39005

SEQ ID NO: 178972 - DNA, 601 bp, Human; identical to SEQ ID NO: 39006

SEQ ID NO: 178973 - DNA, 601 bp, Human; identical to SEQ ID NO: 39007

SEQ ID NO: 178974 - DNA, 601 bp, Human
cagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatg

SEQ ID NO: 178975 - DNA, 601 bp, Human
ttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacc

SEQ ID NO: 178976 - DNA, 601 bp, Human; identical to SEQ ID NO: 21591

SEQ ID NO: 178977 - DNA, 601 bp, Human; identical to SEQ ID NO: 21592

SEQ ID NO: 178978 - DNA, 601 bp, Human; identical to SEQ ID NO: 21593

SEQ ID NO: 178979 - DNA, 601 bp, Human; identical to SEQ ID NO: 21594

SEQ ID NO: 178980 - DNA, 601 bp, Human; identical to SEQ ID NO: 21595

SEQ ID NO: 178981 - DNA, 601 bp, Human
tttggagactgctcgggaagctgtggtcagtgtgtgtggccacctgtactggtgagaatcgaggaggggggcgggaggtggtgggtctcgcttatatactggagaggctaggagcgaataatcatacagtcatacagataatcggagggcacgttcccataggtgaagcccgacaggagacataagactttgctggtatgtgtgggtgggagtataacggtcgagatctgtggaaagaaaggtcttaggaaccaggagctgaggcacgtgatgtgctgagaagagaaggtggggcggggartggcaggacaatgtgagacccgagccaccttaccccagagaagtgaggggtcttagctgtgcaggtggaaacaagtgagacacaaaggttaagggaggcacgcatcagttgagtcggggagaaccaggaaatatggatcacattcagatgagatctgggagggggctggtataagggcactgtggagaggcagacttgaaaggttaaagggtcataaagatagggacattattgagcttgaaagtgagtaatgggggaatgtgctagtaaaggggtttggtttggagtgatggggttggg

SEQ ID NO: 178982 - DNA, 601 bp, Human
gggtctgcagaaccccaattcctcctgttgactgtgcctttgatccctcctcacaggaaacactgagacgcacagagccccggacttggtacaatggacccgacacatggaggtgagggatgtcagaggtcagaggtcaagtggacagatccttggtagcaggaagcaggagtgaggcttggtgataaagatgacttttttttttttttttttttgaaacaaagtctcgctctgttgctcaggctggagtgcattggcacaatctcggctcactgcaacctctgcctcccaggttcaagcragtagctgaactacagatgagtgccaccaggtgtggctaattttttttttatatttttagtagagacggggtttcaccatattggccaggctggtcttgaactcctgacctcaagtgatctacccgcctcggcctcccaaagtgctgggattacaggtgtgagccacggtgcccagcctgatgacttgttcctgagtgcaaagatcggattcgaattaaggatggagatggaggggtttgaagcacaggtcccaaaggtcaccaaaagtcagccagtagatagagtcttcctgctagtgc

SEQ ID NO: 178983 - DNA, 601 bp, Human
caggtcccaaaggtcaccaaaagtcagccagtagatagagtcttcctgctagtgcggctggaggccaggggtgaggagtgacaatcggaggtgaccaggctggaattcagacccagggaggggaagccttgctcctgctgtcactccctgatcctcgctgctgccccaggaagccagaaggagatcaactctgggcagggatcatggcttgttcatctttttaccacagcacttagcactgcggggtcctaccccaccagcagacccatcaccaccccaccaatgcctgcccttccccccrcaggcctgccaccactgaacccccatccctgctgaccccccaggttgtttttttttttaaaaaaagcactgtgcctggcatagacagaaattcagtgaatgtctggtgaatgaaaggatggctgactggagggacagtgggctctaccctggctttgtcccgtaggctgtgaaggcacaattgctggagcaagcgcagggacaactgagggagctgctggatcgggccatgcgggaggctatacaatcctacccatcacaagacaaacctctgcccccacctcccccaggttccttgagc

SEQ ID NO: 178984 - DNA, 601 bp, Human
cccttccttccccagccttggttggccctttgtctgtcctcccagggccggccactctcaaatgcttctcaatgacaccttgccctgaggcagatgtgtgtgtgtgtgcacacatgcacacccatacacactcctttccaagtcagttctattcaagtaacctccattgagcacctcccgagtaccagtcctagtggccagagaaatgaggggggcagaccccactcctgtctgtgaggcactcccagtcttgtggggaagacagacatgtaaccaagtgcctgggtgggtcatttccccsacagagcaccccatccaactgtgaggatgagcctcagagagctgtatacccctgggggtctgtattttcatacctcccactattcccagaccaaactgagggttggggctgctatttctcatggcccaataacgagatgcagatgaactggggaggaagtgagtttttatttctgtaaccagttacagggagaaggcctggaaattatcaccaggccaactaaaaattacaatttccagagcatatataccttctaagctctacatctatgtgtaggtgtgcattcatctaaagacataa

SEQ ID NO: 178985 - DNA, 601 bp, Human
ttgccctgaggcagatgtgtgtgtgtgtgcacacatgcacacccatacacactcctttccaagtcagttctattcaagtaacctccattgagcacctcccgagtaccagtcctagtggccagagaaatgaggggggcagaccccactcctgtctgtgaggcactcccagtcttgtggggaagacagacatgtaaccaagtgcctgggtgggtcatttcccccacagagcaccccatccaactgtgaggatgagcctcagagagctgtatacccctgggggtctgtattttcatacctcccmctattcccagaccaaactgagggttggggctgctatttctcatggcccaataacgagatgcagatgaactggggaggaagtgagtttttatttctgtaaccagttacagggagaaggcctggaaattatcaccaggccaactaaaaattacaatttccagagcatatataccttctaagctctacatctatgtgtaggtgtgcattcatctaaagacataagtgattaacttcttttaatctataactaaggtctgagtcttgaagaccttcttctggagcctcagtaagtttacttaat

SEQ ID NO: 178986 - DNA, 601 bp, Human
aaactgagggttggggctgctatttctcatggcccaataacgagatgcagatgaactggggaggaagtgagtttttatttctgtaaccagttacagggagaaggcctggaaattatcaccaggccaactaaaaattacaatttccagagcatatataccttctaagctctacatctatgtgtaggtgtgcattcatctaaagacataagtgattaacttcttttaatctataactaaggtctgagtcttgaagaccttcttctggagcctcagtaagtttacttaatctaaatgggtccargtgctggggtgattacccttctcttatctcctgctaaataacggaggtttggggagtttcttcagacccccagcaaaacttgtttaatcatgctttgaggttcaggaaaggcctaggcaaaactcttggtgggcttttgttacattccagcctttgtataagggcactggtttttaacatttaacttaaccactcagtcagtactgaaacagttgttatggaggtctgcattagtgagacctgcttgtcacagtccccactgtcaatttacacgatttttatcatgcatggatatttatt

SEQ ID NO: 178987 - DNA, 601 bp, Human
ctaaatgggtccaagtgctggggtgattacccttctcttatctcctgctaaataacggaggtttggggagtttcttcagacccccagcaaaacttgtttaatcatgctttgaggttcaggaaaggcctaggcaaaactcttggtgggcttttgttacattccagcctttgtataagggcactggtttttaacatttaacttaaccactcagtcagtactgaaacagttgttatggaggtctgcattagtgagacctgcttgtcacagtccccactgtcaatttacacgatttttatcatgyatggatatttatttatcatgagaatcgcagggagatggggagtcgtaatctttctggctacttcctgctgagagggggtcgtcgttatggggcaccaaaagcagcagtggagtggaagaggttgatttgttcgcagtagcactctctgtttcggggccttggaggcagcacctgctgaaacataatagtatgtaacagtacatataaataggctactgctcttttcttctgaagtttaagttgtctagtcttcagtttgcagggctttaagaaagcagagcttaggtttcagtgattacc

SEQ ID NO: 178988 - DNA, 601 bp, Human
taaatgggtccaagtgctggggtgattacccttctcttatctcctgctaaataacggaggtttggggagtttcttcagacccccagcaaaacttgtttaatcatgctttgaggttcaggaaaggcctaggcaaaactcttggtgggcttttgttacattccagcctttgtataagggcactggtttttaacatttaacttaaccactcagtcagtactgaaacagttgttatggaggtctgcattagtgagacctgcttgtcacagtccccactgtcaatttacacgatttttatcatgcrtggatatttatttatcatgagaatcgcagggagatggggagtcgtaatctttctggctacttcctgctgagagggggtcgtcgttatggggcaccaaaagcagcagtggagtggaagaggttgatttgttcgcagtagcactctctgtttcggggccttggaggcagcacctgctgaaacataatagtatgtaacagtacatataaataggctactgctcttttcttctgaagtttaagttgtctagtcttcagtttgcagggctttaagaaagcagagcttaggtttcagtgattacca

SEQ ID NO: 178989 - DNA, 601 bp, Human
acaccattccagtcaaagccttgggaaaataaccactttttccaattatgtcctgttacaaaagaaaacagattcttattgtactatgcaaataactaatattgcaaatagtttccaaattctggagaaatcaggtagagagaaacaaacatgctccaaattttattcataggagtatactttacttaattgttaaaagctattaatagctcaaaagaaaagtttccttgactctgcaaagcaaaacaaaggactagcaacattttaagcaaaaagtgaaaaagatcacttcaatctcctwttagttcagtacatgcagttaattcctgtcctgcttcatattaatgaatattttaactcttcaagagccctaaatgtttttcctccattgtgatgtcacaatctacaaagttatcagaaacctgcattcaagagcacctgttagagctttataactgattataaaaccaccttctaaagaggaccaaaacaagaaaacaattgtttatggatgacaaacagttttagggtagccatagttaaagacacaattgacaaggaaatctgttacctctgtagcacacaacaatttaacataaca

SEQ ID NO: 178990 - DNA, 601 bp, Human
ttatcagaaacctgcattcaagagcacctgttagagctttataactgattataaaaccaccttctaaagaggaccaaaacaagaaaacaattgtttatggatgacaaacagttttagggtagccatagttaaagacacaattgacaaggaaatctgttacctctgtagcacacaacaatttaacataacaatggctgggcacagtggctcatgcctgtaatcccagcactttgggaggccgaggtgggtggatcacgaggtccggagttcaaaaccaacctggccaatatggtgaaacccygtctctactaaaaatacaaaaattagctgagcatggtggtgcatgcctgtagtcctagctacttgagagactcaggcagaagaatcacttgaacctgggaggcagaggttgcagtaagccaagatcacgccactgcactccagcctgggcgacagagcgagactccatctaaataaataaataaataacaattctaattattattgataatgtacactaagatatatcagaattatagcagtctctcataactttggaatacataccaataacatatttatacaaatatagcccaaagaa

SEQ ID NO: 178991 - DNA, 601 bp, Human
ctacttgagagactcaggcagaagaatcacttgaacctgggaggcagaggttgcagtaagccaagatcacgccactgcactccagcctgggcgacagagcgagactccatctaaataaataaataaataacaattctaattattattgataatgtacactaagatatatcagaattatagcagtctctcataactttggaatacataccaataacatatttatacaaatatagcccaaagaaagtcaaaccccattttatatttggcaatgcttcctgtatgatttttggtaccaaataarccaaatttcacctttatattagtgtactattaatgttaaacccaattatttatttatttatttattttcttttttgagacagagtctcactccgtcacccaggctggagtacagtggcatgatctcggctcactgcaatctctgaatcctggattcaagtgattctcctgcctcagcctcccaagtaattggaattacaggcatacgccaccacacccagctaatttttttgtgtgtattcttagtagagatgggatttcatcatgttggccaggctggtcttgaactcctgacctcaag

SEQ ID NO: 178992 - DNA, 601 bp, Human
ggcagaagaatcacttgaacctgggaggcagaggttgcagtaagccaagatcacgccactgcactccagcctgggcgacagagcgagactccatctaaataaataaataaataacaattctaattattattgataatgtacactaagatatatcagaattatagcagtctctcataactttggaatacataccaataacatatttatacaaatatagcccaaagaaagtcaaaccccattttatatttggcaatgcttcctgtatgatttttggtaccaaataagccaaatttcacctttwtattagtgtactattaatgttaaacccaattatttatttatttatttattttcttttttgagacagagtctcactccgtcacccaggctggagtacagtggcatgatctcggctcactgcaatctctgaatcctggattcaagtgattctcctgcctcagcctcccaagtaattggaattacaggcatacgccaccacacccagctaatttttttgtgtgtattcttagtagagatgggatttcatcatgttggccaggctggtcttgaactcctgacctcaagcgatccacccaccttg

SEQ ID NO: 178993 - DNA, 601 bp, Human
ccaggctggagtacagtggcatgatctcggctcactgcaatctctgaatcctggattcaagtgattctcctgcctcagcctcccaagtaattggaattacaggcatacgccaccacacccagctaatttttttgtgtgtattcttagtagagatgggatttcatcatgttggccaggctggtcttgaactcctgacctcaagcgatccacccaccttgacattcccaaagtgctgggatcataggtgtgagccactgcacctggccttaaacctaagtcttaataaaaccttatacacatggtttacccaattttaatgtttgaccataaggtaagatttgtatagactttttcgaaccctttacaatttttgttaaagagcaggttagtgctctaagagaaacccattgtgcttttattttaatgctcaatttacagaagaaactggatgatacccctttaactttagccaatatgtttacacacagaatttcctttacaatcaaccttccacaacttgcttaaacctccatctttatcttacccaacttaaaacaatccttttaccttttaatctagggaaaaatccattattgtcatg

SEQ ID NO: 178994 - DNA, 601 bp, Human
cttgcacataaattgtttcttcaacagtgttaaatatatattatactgttaactcttagcaacctttacttttggtgaaaaccttggtaagtttgggattttaattatgtactaggtgtggcgcctaggacctagacaggagtacagataaggtctgacttattccagcgtctaactccatgtgtcctaggacttacctagctgtaaagcaggcaagttgtacagctaagagtcataaagcatttaggaggcctaatcacctttaaattgtataacatttcttgtataaatttcctttaayaaattctttcaggacttccacagacaatctctgacatcccttgactttctgatttgtcctaaacatgtttctctttaaacaaccagttattttactttaggacaagaatttaccatacaagatcctttcttatataaattctcttttctttaatatctttttgcatatctagggggcatggctaatttcacatgtccctagccttatctagaatctaacgctccaaaataaatttaacaatttttaagtcaaagatgcagtttatgacctaaagcatttagcaaacctaatatttgacat

SEQ ID NO: 178995 - DNA, 601 bp, Human
tgtggcgcctaggacctagacaggagtacagataaggtctgacttattccagcgtctaactccatgtgtcctaggacttacctagctgtaaagcaggcaagttgtacagctaagagtcataaagcatttaggaggcctaatcacctttaaattgtataacatttcttgtataaatttcctttaacaaattctttcaggacttccacagacaatctctgacatcccttgactttctgatttgtcctaaacatgtttctctttaaacaaccagttattttactttaggacaagaatttaccayacaagatcctttcttatataaattctcttttctttaatatctttttgcatatctagggggcatggctaatttcacatgtccctagccttatctagaatctaacgctccaaaataaatttaacaatttttaagtcaaagatgcagtttatgacctaaagcatttagcaaacctaatatttgacatccataatttaaaccaaacgtttacatttttgaagatatttttattttaccaataatctttaaaattgtctttatttttataactttttttatgcctctcttatttcctgttttttt

SEQ ID NO: 178996 - DNA, 601 bp, Human
agcaaacctaatatttgacatccataatttaaaccaaacgtttacatttttgaagatatttttattttaccaataatctttaaaattgtctttatttttataactttttttatgcctctcttatttcctgttttttttaccttgttttatatataacctttaaggtttgaattagacaaaaattagttactctttaaaaaggacacaatttttagaaagaatgttttcctacatttttattggaaaatacccaaataatgaaatatctgttgtttaactttagattctaaattatgacaagtttatgagtatttatcccattacatttatctaattatttattttaatcatttgcctacatttttttttttgagatggagtctcactctgtcacccaggctggagtgcagtggcgtgatctcggctcactgcaagctccgcctcccaggttcacgccattctcctgcctcagcctcctgagtagctgggactacaggcgcccgccaccacgcccggctaatttttttggtatttttagtagagacggggtttcaccgtgttaaccaggatggtctcgatctcctgacctcatgatctgcct

SEQ ID NO: 178997 - DNA, 601 bp, Human
aaaaattagttactctttaaaaaggacacaatttttagaaagaatgttttcctacatttttattggaaaatacccaaataatgaaatatctgttgtttaactttagattctaaattatgacaagtttatgagtatttatcccattacatttatctaattatttattttaatcatttgcctacatttttttttttgagatggagtctcactctgtcacccaggctggagtgcagtggcgtgatctcggctcactgcaagctccgcctcccaggttcacgccattctcctgcctcagcctccygagtagctgggactacaggcgcccgccaccacgcccggctaatttttttggtatttttagtagagacggggtttcaccgtgttaaccaggatggtctcgatctcctgacctcatgatctgcctgcctcggcctcccaaagtgctgggattacaggtgtgagccaccttgcccaacctatagtgtagctttaaaacagagaatgataacagtcctttcccagaacaaacttccttcatgtctgtggactagactaaggccacaagagtagaagttagggtattttactaaataattcaaga

SEQ ID NO: 178998 - DNA, 601 bp, Human
actttagattctaaattatgacaagtttatgagtatttatcccattacatttatctaattatttattttaatcatttgcctacatttttttttttgagatggagtctcactctgtcacccaggctggagtgcagtggcgtgatctcggctcactgcaagctccgcctcccaggttcacgccattctcctgcctcagcctcctgagtagctgggactacaggcgcccgccaccacgcccggctaatttttttggtatttttagtagagacggggtttcaccgtgttaaccaggatggtctcratctcctgacctcatgatctgcctgcctcggcctcccaaagtgctgggattacaggtgtgagccaccttgcccaacctatagtgtagctttaaaacagagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctc

SEQ ID NO: 178999 - DNA, 601 bp, Human
attatgacaagtttatgagtatttatcccattacatttatctaattatttattttaatcatttgcctacatttttttttttgagatggagtctcactctgtcacccaggctggagtgcagtggcgtgatctcggctcactgcaagctccgcctcccaggttcacgccattctcctgcctcagcctcctgagtagctgggactacaggcgcccgccaccacgcccggctaatttttttggtatttttagtagagacggggtttcaccgtgttaaccaggatggtctcgatctcctgacctcrtgatctgcctgcctcggcctcccaaagtgctgggattacaggtgtgagccaccttgcccaacctatagtgtagctttaaaacagagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctctatgccaaattttg

SEQ ID NO: 179000 - DNA, 601 bp, Human
atttattttaatcatttgcctacatttttttttttgagatggagtctcactctgtcacccaggctggagtgcagtggcgtgatctcggctcactgcaagctccgcctcccaggttcacgccattctcctgcctcagcctcctgagtagctgggactacaggcgcccgccaccacgcccggctaatttttttggtatttttagtagagacggggtttcaccgtgttaaccaggatggtctcgatctcctgacctcatgatctgcctgcctcggcctcccaaagtgctgggattacaggtgtragccaccttgcccaacctatagtgtagctttaaaacagagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctctatgccaaattttgacaccttatggtatttggcagagataagtatgaaattgcttgatca

SEQ ID NO: 179001 - DNA, 601 bp, Human
tgcctcggcctcccaaagtgctgggattacaggtgtgagccaccttgcccaacctatagtgtagctttaaaacagagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctctatgccaaattttgacaccttatrgtatttggcagagataagtatgaaattgcttgatcaataaatgcaaacaaaaatgtatgctggcaactcttaagacatttctagtattactttaccaataatttttaaagctagcttatgtattaaagattttatttaagtcacataaacttgaaaaagcatttgactagtctttccttttttctgttaaagtatttaagtgcttttatttttctttaagccaattaattagaactcttttatatattttcagtagtgaaacatggtatacacaagacataaatacgcagacgtattagg

SEQ ID NO: 179002 - DNA, 601 bp, Human
agagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctctatgccaaattttgacaccttatggtatttggcagagataagtatgaaattgcttgatcaataaatgcaaacaaaaatgtatgctggcaactcttamgacatttctagtattactttaccaataatttttaaagctagcttatgtattaaagattttatttaagtcacataaacttgaaaaagcatttgactagtctttccttttttctgttaaagtatttaagtgcttttatttttctttaagccaattaattagaactcttttatatattttcagtagtgaaacatggtatacacaagacataaatacgcagacgtattaggcatgccaatagaagtacattttatagattcctaagacctcctttttcctctcttttaactggatctttgtgct

SEQ ID NO: 179003 - DNA, 601 bp, Human
ataagtggagacaaattttggacaacacaagggggagtgcactcaggcaaaacagactcaaaaccaactcaaaacctgattgcaaccaaaatgcaaagcaggcgtatgagtgagccctattgcttccctgggtggtaccggacaaatggcttaacaagcccaataggaaaacaataggctcccggcatatgatctgtttaactcaccctttgagcgtgtctgcttctgatctctgttcttccccagtagtgaaagggacgtgcagttttgcacacgggacagccctcgggagggtccccargaaaaatctcacgggcagctgcttggaccctcctgaagactgtctcatcgcaagccactggtggctgaacacagcaccatcccggtctctcctggctggcttgccacgttttgttcccaggtcaaactgaaggttgggctgctatttcttgaggcccagtaacgagatgcagatgaactggggaggaagagagtttttatttctgtaaccagttacagggagaaggcctggaaattatcaccaggccaattaaaaattataaagttttccagagcttatataccttctaagctctatgtc

SEQ ID NO: 179004 - DNA, 601 bp, Human
aacaagcccaataggaaaacaataggctcccggcatatgatctgtttaactcaccctttgagcgtgtctgcttctgatctctgttcttccccagtagtgaaagggacgtgcagttttgcacacgggacagccctcgggagggtccccaggaaaaatctcacgggcagctgcttggaccctcctgaagactgtctcatcgcaagccactggtggctgaacacagcaccatcccggtctctcctggctggcttgccacgttttgttcccaggtcaaactgaaggttgggctgctatttcttgmggcccagtaacgagatgcagatgaactggggaggaagagagtttttatttctgtaaccagttacagggagaaggcctggaaattatcaccaggccaattaaaaattataaagttttccagagcttatataccttctaagctctatgtctatgtgtaggtgtgcattcatctaaagacataagtgattaacttcttttaatctataactaaggtctgagtcttgaagaccttcttctggagcctcagtaagtttacttaatctaaatgggtccaggtgctggggtgattacccttctctta

SEQ ID NO: 179005 - DNA, 601 bp, Human
gaaagggacgtgcagttttgcacacgggacagccctcgggagggtccccaggaaaaatctcacgggcagctgcttggaccctcctgaagactgtctcatcgcaagccactggtggctgaacacagcaccatcccggtctctcctggctggcttgccacgttttgttcccaggtcaaactgaaggttgggctgctatttcttgaggcccagtaacgagatgcagatgaactggggaggaagagagtttttatttctgtaaccagttacagggagaaggcctggaaattatcaccaggccaaytaaaaattataaagttttccagagcttatataccttctaagctctatgtctatgtgtaggtgtgcattcatctaaagacataagtgattaacttcttttaatctataactaaggtctgagtcttgaagaccttcttctggagcctcagtaagtttacttaatctaaatgggtccaggtgctggggtgattacccttctcttatctcctgctaaatcacagaggtttggggagttccttcagaatcccaataaactcatttgtggaggcctggggagtttcttcagacccccaataaaact

SEQ ID NO: 179006 - DNA, 601 bp, Human
aacacagcaccatcccggtctctcctggctggcttgccacgttttgttcccaggtcaaactgaaggttgggctgctatttcttgaggcccagtaacgagatgcagatgaactggggaggaagagagtttttatttctgtaaccagttacagggagaaggcctggaaattatcaccaggccaattaaaaattataaagttttccagagcttatataccttctaagctctatgtctatgtgtaggtgtgcattcatctaaagacataagtgattaacttcttttaatctataactaaggtctragtcttgaagaccttcttctggagcctcagtaagtttacttaatctaaatgggtccaggtgctggggtgattacccttctcttatctcctgctaaatcacagaggtttggggagttccttcagaatcccaataaactcatttgtggaggcctggggagtttcttcagacccccaataaaacttgtttaatcatgctttgaggttcaggaaaggcctaggcaaaactcttggtgggcttttgttacattctggcctttgtataagggcactggcttttaatatttaacttaaccactctat

SEQ ID NO: 179007 - DNA, 601 bp, Human
agctccaaggatccacaggctcagcaacagcactgccttttggtaaaatttttgttgttagttatacaagtattaaaaggacaaaatctactgctaggtttgcataagaaaaaaataaattaaaaaaactaaaaatgataaaatctcagtaaaaagctcaaatacatgtttttgtgtaaaggaggtccttcttgaccgcctccttcaatcccacactgctctcggaggattttaaacagtttctggctgggtgcagtggctcacgcctgtaatcccagcactttgggaggccgaggcaggmggatcacttgaggtcagcaattcaagaccagtctggccaatatggtgaaaccctgtctctactgaaaaaaaaaaaattagccagtcgtggtggtgcaagcctgtagtcccagctattcaggaggctgaagcaggataattgtttgaacccgggaggcggaggttgcagtgagcagaaattgtgccactgcactccagcctgggtgacagagcgagactctgtctctaaaaaaaacagtttctgagtttccacccagagcattttccatgcattgacattcagtaccaaagataggtacat

SEQ ID NO: 179008 - DNA, 601 bp, Human
actcctgacctccagtgatccacccacctcagcctcccaaagtgctgggattacaggcatgagccaccgcgcccggccaatttttttttttttttttttttttttagagacagggtcttgctatgttgcccaggctggtcttgaactcctgggcttaagcaatcctcctgccttggcctcccaaagtgttgggattacaggagtgagccattgaggctggcccctaatttcaatatcgttgtatctcagcgaataggaaagctcgaggagaacagaagagatgggagaatggccggtcagyagagtagtcagaacacacacagaatttgtcagttaagtttgctctcttatttgggtgtatttcatgatgccctaaaacaattacaattgtaacattaaaaatcactggtcacagtgatttttgccgaggtgagaagttggggtagaagggtggacctgtgactcatggtggtggagaggggacgtttctgggaggcctggggaggcagtgggagggtggtgccaagggaagaggaggccagtgctgggccagaggtccaatgccaccggcagctgccagtgtccctctccagttatgtat

SEQ ID NO: 179009 - DNA, 601 bp, Human
aataagaagaaagaaatatttcaggaattgccaaaatgtgacacagtggcatgaagtgagcacttgccgttggaaaaagtggcactgatagccttgtctcttgcagggttgccacaaactttcaatttgtaaaagaggcaatatctgggaagtgcagtaaaataagatgtgcctgtattaggaagtccagacagaaggggaaggagaatgggttgtcgaacgtgtgggtaccaaatgaagctctggccacagcaggccctgcactggaagatagggtgcctgaaatgacagcagaagagayggtgttaaagagccagttccgctcctgcccagcttagctcccctagcccgcatccaggtcctacgtccagctccttgcttatcccccacccccaccctatccatttctccactcaccaatcccaccacccttccccagcagccccctcacctctgccctctgcccttgcccttactaatccacccctctcattcctccccaggtgaggggatccaggcccccagtttctccagctacctctacttcctcttctgcccaacactcatctacagggagacttaccctaggtaagaccctgca

SEQ ID NO: 179010 - DNA, 601 bp, Human
ccaggcccccagtttctccagctacctctacttcctcttctgcccaacactcatctacagggagacttaccctaggtaagaccctgcactccttccccaaatgcccaggcccatcaggaaacttacccttctactctcccctccctgaggtcctcaggctcacctcaggcactggccactttctcaggaagcatctcataataaagatgggaaataggtgactggtagactaccctgtctccttgcccggcctatgatgacactagggcaacccactttcctggtttacccaggactgtcytgataatcctacccatcctacacacccttgttgacatccatgcttaaaacccacttgttatctctgttatggaaagttcagagtatcctagaccccaccaccctagataatcctcccaggcctaagcaattaagggaactgaggagagagggccccagaacccgtgcccaggctgaacagagaacaacatgaaagaatgagaaacatattgtccccattgccgctgcaggacgccctatgtcaggtggaattatgtggccaagaactttgcccaggtgagaagatagggtagaagggtgg

SEQ ID NO: 179011 - DNA, 601 bp, Human
cccatcctacacacccttgttgacatccatgcttaaaacccacttgttatctctgttatggaaagttcagagtatcctagaccccaccaccctagataatcctcccaggcctaagcaattaagggaactgaggagagagggccccagaacccgtgcccaggctgaacagagaacaacatgaaagaatgagaaacatattgtccccattgccgctgcaggacgccctatgtcaggtggaattatgtggccaagaactttgcccaggtgagaagatagggtagaagggtggacctgtgactcwtggtggtggagaggggacatttctgggaggcctggggaggcagtgggagggtgatgccaagggaagagaaggccagtgctgggccagaggtcaatgccaccggcagctgccagcatccctctccagttatgtgtccccatgccccctccaggccctgggatgtgtgctctatgcctgcttcatcctgggccgcctctgtgttcctgtctttgccaacatgagccgagagcccttcagcacccgtgccctggtgctctctatcctgcatgccacgttgccaggtgagccaactaaggtagg

SEQ ID NO: 179012 - DNA, 601 bp, Human
tctccttctgagtctcccctcacatctgtcccctcctatcagggccattgccatggtctcagttcagaccatctgctccccctccacatcagcctcctaacccatctccctggcacccagatctttcctttcccatctacccctaacactgctgcccaggtgaactttcctactgcaactaatcattccctaccctccttcaaaaactctagtgataagtcaatgctggcacttttggatcagatatgaacccttgatgtggcatccaaggctccttcccacacagccccagcctatctgsaacaagctgaagatatgtgcttccatgcctccaggcctttgcccatactggcccctcagcttgaaataccctttcctaattttcagccatggaatctagttgcttcttggaggcccatggttgagatgccccctcctgtgggaagccttccttttgtagccatcaattactatgacccacctgtttctctgtactcacaggcacatcaatgccaccatacttagctcccattacatttgccctggacacatggttggacatctttctgtctctgtctctgtgtgtgtctcacttcaatta

SEQ ID NO: 179013 - DNA, 601 bp, Human
ttccgcagtgtttgtgtccctgggtacttaagattagggagtggtgatgactcttaaccagcatgctgccttcaagcatctgtttagcaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctatttctttctacacagacaccgcaaccatccgatttctcaatcctttccccaccwttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctgccggactgggcggctggccgggcggggggctggaggtgggggctctttgtggaggagctcagggagacttactcttcactcctttcctcaccctgccagct

SEQ ID NO: 179014 - DNA, 601 bp, Human
aaggtcacagatcaacaggatcccaaggcagaagaatttttcttagtacagaacaaaatgaaaagtctcccatgtctatttctttctacacagacaccgcaaccatccgatttctcaatcctttccccacctttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggcygggcggggggctgacccccccacctccctgccggactgggcggctggccgggcggggggctggaggtgggggctctttgtggaggagctcagggagacttactcttcactcctttcctcaccctgccagctccttggtgcccgggcccgaggggtagccatgctgggtgtgttcctggtctccgcagtggcccatgagtatatcttctgcttcgtcctggggttcttctatcccgtcatgctgatactcttccttgtcattggaggtgagctggtctctgtgccactggaagggagccat

SEQ ID NO: 179015 - DNA, 601 bp, Human
ctttgtggaggagctcagggagacttactcttcactcctttcctcaccctgccagctccttggtgcccgggcccgaggggtagccatgctgggtgtgttcctggtctccgcagtggcccatgagtatatcttctgcttcgtcctggggttcttctatcccgtcatgctgatactcttccttgtcattggaggtgagctggtctctgtgccactggaagggagccatccagagggaggcctgcatcctgctcctgcagatcccagactgatggtgggaggcctcgcccccaggcctggaggyaaggctgctgagactgagaggtggagtcaagggggtacttggaaagcagggagggaggcagcatttgggaggcagccaagctgtatcctggggcatgtgggaggaggtttctggttggagaggaatatttgaatagatcactcatggaggaagacaaagaggaggaaactgggatgaggctgagaggctcagtatgagattcaggatattgaagtacaaactgaagaatcctggttttacatgggccactttagacctctacgaatttctgcacctgagttcaagatcttctccaatggg

SEQ ID NO: 179016 - DNA, 601 bp, Human
ccccaactgcagacttaggaatcagtttactcagctcctgagttttggggagttaagggaaatggtgggtcacagctctaggaaaatgggctcccggaggtctggaaggagggcatatgggggacggagaatgtatctttgggggaattgagaaaggttgggatggggctgggggatctgacatgtagacagctctcacctggtagacaggcagtgcggcactggtgacagcaaagatgggctggatatttgctgcagagagggcctgggctacctgacccacagaagggtagtcctgggrcagggagcagggacaaggtgagccccacaggtttcccccacaacatgcaaggtgccctcagcccagggaatccaggaaccaaggttccaccagctggaggagccctggaggcttgctatggaataggaaggaggtagggaatggggtgacaaaggtgtcctgtctcggcagctgaaaggaggaactgctggagaagatggcagggtgtctacagggtggttactggtgaggactgtaaggctgggagtgggagtcctggaaggaaagaggtgtggctgaaatggggagaggcagggtgac

SEQ ID NO: 179017 - DNA, 601 bp, Human
ttcttgccataggtttaggagatgctccctgttatcaagaagcctacagcctagttgcagaggtaagacctaaaccactaagaatttttatggttccttctacctgtaaaattctatggttcttgtgaagaatagctctgaattatttataaacttagtgaaagcaggctccagatctcacattgtttatgtacagactgactggggacaaatgccagcccttctgtttgttatctttgtgaccttggacaagtcacttagcctccttgtgtgggtttcctcatctgtaaaatagggatgrtaacagttatgaagcaaggcttttggcagggttaaatgaagtagcaaacagtatgtacacctaggatggtgggcgcatgaaataaaagctcagtgattgaaactttcctttcttgcccagagcagagctccatgctgtctgcatgtcagatgttttaagatttatgaatgtaagattgaacagttaatgacagccacatgcagactataggtaggagctgtggaatgttagaccaaaaagtgaccatttcctcttagttctgccaccccacccaagggcccctttccacctttccctagt

SEQ ID NO: 179018 - DNA, 601 bp, Human
agagaagtaggtcagagggtttgatcacccctgacttgtctctcccaggaacctctaaacccaagttctcaaaagagttggagacagacaaacagctgaaaggatgttaagtatagtgaaacactgaggggtgagagagtggagggagccccagtcagggggagggcctggacatacatgggaagcttcaagggatgaaactgagtggggagtcgggatgtcgaggagactcctgtgggggggatggaaagcagcggaggaatacgggccagggttggttggttgttgggagccaggtggktgaagggaagaggaggccctcacctgcatacaccacattgtaggtgtccctggccatcactgcagtggggagcctggggctgggtgtcactgcaattacagtcacacagcgtgtgcaactccacaatcagctcctctgagaagccaagggcccggagcctcaggagatggggctctgggaggcagtgggtggcttggagagaaacccagaaagtcacctgagaagaggcaggaatcaggccatggttatacacatgcacacacacataccccaaactcaccaatcatccagaacctcacc

SEQ ID NO: 179019 - DNA, 601 bp, Human
agcaccatagtagccgtccaagcactggcagcggttgcatttgcagcgtccatgcccactgcagagccctccctcgggactgatgcaactgtccatgtccccactgcattcgcatgctctgcccgtgcggttggcatgacagtgacatactccacattggcagcgaccaaagcctggggtagagccatgcagagggtgacaaccatactccacacacacagttggccatcatgtggcacgacaagcccacgcatccaatctttttgaagtatgccaaccacaccctctaacccatacaccrgaatcttttgatatttgccttccatgccaggagattcccagagcctaagtgccttgggaaggcctctcagaccccgcccttctccccaaggctccaggtacctccgcagaggatgccctcatgtcgctcacagctggcatcgtcacactcgcacagatgcccagagctctgtccactgcagctgcagcgtccacattgacagtgaccctttccactgcacaggggccctgtgccattgggagcccggcacccagattccaggtctggggaggacagctctgccacagagcactcacagag

SEQ ID NO: 179020 - DNA, 601 bp, Human
gggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcaggtaaggggtaggagggacctcaactcccagccttgtctgaccctccaattatacactcctttgcctctttccgtcattccataaccaccccaacccctactccaccgggagggggttgggcatacctggatttccatccgcgcacctagccacagggtccctaagagcagcagctaggcatgggagggctctttcccaggagagagggggaaggggacagggttgagagctttacagaggaagtggacagcatggagggaggtaaggaaaggcctgtaaagaggaggagacactggctctggcggaatggggactattggagggttaagcggatgtggctaaggctgagtcatctaggagtaaacaagaggccttcctttgggaggag

SEQ ID NO: 179021 - DNA, 601 bp, Human
gttttcactaggatacataacactttttacacactcaccccacccatccctggctttctattcatggaacaacctctctctacaatccctccagatcttcgcaaatactgtggacaatgcccgcatcgttctgcagattgacaatgcccgtcttgctgctgatgactttagagtcaagtaagtttgggggctagagagctgggggtccaggggtggagctaagaaggatctgctccccaggctgggtcagttaggggctcacagtgggatcctgttaggtgtgggtggatgagagtcaggktccatcagtgtattcatttaactgttcatttgtataaccccgtttaagaatactgtcctccaagtgccaagaatggtgctcaggggattaccacctaattgctgactcaagttgctggtttgcaatgggcacagaacttctcttagtaggtggcatgagttgagaaggttctggatcagagataggggcccctctgatcacctccactcctataggtatgagacagagctggccatgcgccagtctgtggagaacgacatccatgggctccgcaaggtcattgatgacaccaatatcaca

SEQ ID NO: 179022 - DNA, 601 bp, Human
ataggtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggcaagcaggggccactggccaggccagggattgaggggccaagagaagtctgggtcggagaatagacaagacaaaccaactgcaagtagccttgctaagacgtttagaaatagcagcctgggctcttcttaaataagacygttctgatgaagagcattctcagggggtcgagtacaccctggctcacctgaattacaggtcaaaatgatatgggttagaaaatgagatgagaacagaagtagaagcagctaacactaggagctgggggtgataaaggaatgacagcagatggagttggcagcgcttcctaaaagatggtagaaggagcaggtttgtgaaggggagggtggataaaggaacagggtgaagttacagagaaaccatcagtgagtgggtggcatttctacccactggagtagaaaggccagaactggcattgc

SEQ ID NO: 179023 - DNA, 601 bp, Human
gttgagggtcttgatctgctccttctcctgggtgcgcacggcctggatgttggggtccacctccaggacaagggggctcagcaggctctggttgaccgtaactgcggtgatgcctcccatgccgctggccccaccatagccgccgcccaggccaccgcgaaagttgctgctgcccactcgggagaagctcgaggagctgatgcgggaaccgggcccactcgtgtaggagcggctgctgaaggcccgggggccagaggtggacaccttgtaggacttctgggtcaccctgatggacatggtrgaggcaggagtggaggcaggcgggccgaaccaggcggagatcctagaaggagcggagaagctgcttcttggtgaggagagctctcaggaatggccttttataaaagagatcccagccccgggggatgggggggaaaggcctcgtacctgagtggctaggcccagagggggctgggcctaacccgtcacctgccacctccgggcaggactcaggtgggggcagcagagagctgccgccacccaagggcccgttccaaccctggagcccactccagcaccacccccagaaacccaggaaaag

SEQ ID NO: 179024 - DNA, 601 bp, Human
aataggcctaacttcatttacataggttgtatattacacatcaataaaaatagccaagctttctttgggagtctccggcgcccaggctggagtgcagtggcaagatctcagctcactgcaagctccgcctcccaagttcatgccattctcctgcccctgcctcagcctcccgagtagctggggctacaggcacctgcctgccaccacgccccactaatttttttgtatttttagtagagacagggtttcaccgtcttaggcaggatggtctcgaactcctgaccttgtgattggcccgccytggcctcccaaagtgctgggattataggcgtaagccccgcgcccggccaaaaatagccaacctttctaaagatgttaagattgaaaaagaggccgggcgtggaggctcacgctgtaattccagcactttgggtggtcaaggcaggcggatttctgaagtcagagttcgagaccagcctgccaacatattgaaccttgcctacaataattacaaaattaaccgggctgtgcacgcacttgtagtcccagctactcggtggctgaggcaggagaatcgcttgaacccaggaagcggagcgtt

SEQ ID NO: 179025 - DNA, 601 bp, Human
ttcagttgggtggagggtgggagttgctcacttgttcttgaagtcctccaccagcccctgcatgttgccaagctccgcctccagcttcagcttctcctggcccagagtctccagctgccgcctaaggttgttgatgtagctctcgaacatgttgtccatgttgcttcgagccgtcttctgctgctgcaggaggctccacttggtctccagcatcttgttctgctgctccaggaaccgtacctatacgaaggaggagagagcaaaaaggtctacatcaggccagggctcaaagtctggaggraagcaagcagtcttttctcttaattcactcctcaagcagtaaggtctccagaccccaggcacctggttagctgttctggaaagatcacctatgaccagggggagaaagcatggcatgatggtgaggtggggagcaatgtccctcagcattgggtaggggaaggagacaggtaaggtaattatgttaaagctgcatttgcaaaccaataggcctaacttcatttacataggttgtatattacacatcaataaaaatagccaagctttctttgggagtctccggcgcccaggctggagtgca

SEQ ID NO: 179026 - DNA, 601 bp, Human
aacagcagggcctgacatgagacctcagacagaactttctagagtttgctagaggtcaagggtcaagactaaagaggggccagaatgttaagtacaaaagtgaggcccacaggctgcctatctctcccgtctcaggtttaccatgtcaacattgacacataatttgttcttcaaatccagacagttgagattgaaagggggtgggtactatcaacaattgtgctaggaacctgggcataaacacagactgttccgagcaaacctcatcaggtggtcaccctaattagataggactgcactkcccacaacagagggccatggggacttagtcccaaggtcccaaggggtggaggagagcacggtgacttcagttgggtggagggtgggagttgctcacttgttcttgaagtcctccaccagcccctgcatgttgccaagctccgcctccagcttcagcttctcctggcccagagtctccagctgccgcctaaggttgttgatgtagctctcgaacatgttgtccatgttgcttcgagccgtcttctgctgctgcaggaggctccacttggtctccagcatcttgttctgctgctccaggaac

SEQ ID NO: 179027 - DNA, 601 bp, Human
aaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacaggctgcctatctctcccgtctcaggtttaccaygtcaacattgacacataatttgttcttcaaatccagacagttgagattgaaagggggtgggtactatcaacaattgtgctaggaacctgggcataaacacagactgttccgagcaaacctcatcaggtggtcaccctaattagataggactgcacttcccacaacagagggccatggggacttagtcccaaggtcccaaggggtggaggagagcacggtgacttcagttgggtggagggtgggagttgctcacttgttcttgaagtcctccaccagcccctgcatgttgccaagctccgc

SEQ ID NO: 179028 - DNA, 601 bp, Human
cacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtcttttgggagacaggggcgttgtgaaaatcaggaaaattcagttcacasagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacaggctgcctatctctcccgtctcaggtttaccatgtcaacattgacaca

SEQ ID NO: 179029 - DNA, 601 bp, Human
ccactccatccttgtctacctttctgtgcacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtcttttgggagacaggggcgtkgtgaaaatcaggaaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacaggctgcctatctctcccgtc

SEQ ID NO: 179030 - DNA, 601 bp, Human
taccactccatccttgtctacctttctgtgcacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtcttttgggagacaggggcrttgtgaaaatcaggaaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacaggctgcctatctctcccg

SEQ ID NO: 179031 - DNA, 601 bp, Human
tctgtccaaatgcacctaccactccatccttgtctacctttctgtgcacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtctyttgggagacaggggcgttgtgaaaatcaggaaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacagg

SEQ ID NO: 179032 - DNA, 601 bp, Human
agagttctgtccaaatgcacctaccactccatccttgtctacctttctgtgcacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttsgtcttttgggagacaggggcgttgtgaaaatcaggaaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggccc

SEQ ID NO: 179033 - DNA, 601 bp, Human
caaggggctcccaaggtccacccaatggcctggtcacaggactttctagttgcccactttgtggattgatcttccagcccagcctctgcccatcacatgtgcattctcagcccacacaccttcacctctgcttcctgcaacacaccctcttccacctccttctctagggagccttctagagccagatctccagttctactgctctgttttctgaaccatgtcccaacaccgatgtcaagagttctgtccaaatgcacctaccactccatccttgtctacctttctgtgcacccaaatgttkacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtcttttgggagacaggggcgttgtgaaaatcaggaaaattcagttcacagagatgcaggata

SEQ ID NO: 179034 - DNA, 601 bp, Human
gagttgctgctgaatcaccacaccctatgatgaccttggatacgttatttcacttctctgagcccactttctcgtctgtgaaatggggtaatgactcatccctcatgcgagggacagaacatatagacccaataaatactagccgagcaaatattggtggctgtaattagtcagcagtgggcctttgtcttattagtgtgctgggggctgggaggagcctctggttgagtctcagggtggaggcgctgacaaggctgggggaccctcactctcctgcgaccaggaacatacctcttcatayagctgcctgaggaagttgatctcgtcggtcagcccttccaggcgagactccagctctaccttgttcatgtaagcttcatccacatcctgggggatgaggagaggggagcctgagctgggtttccacacccaaccccaaccaaggggctcccaaggtccacccaatggcctggtcacaggactttctagttgcccactttgtggattgatcttccagcccagcctctgcccatcacatgtgcattctcagcccacacaccttcacctctgcttcctgcaacacaccctcttccacctcctt

SEQ ID NO: 179035 - DNA, 601 bp, Human
gatgccaccagggtatcctccaggcccaaagccaccaggaccccctaaacctccaacaccaccagggcccccaaaacctccaaagcggcctccaccaaagccgcctccaccgaaaccaccaccactgaagccgctgccacctccaaagctgctgccgcctccaaaaccacctcctctgccaccaaatccaccagcggcgccaaagccaccacctcctccagccacactaatggagatgctcttggtccctccaaggccaacaagactccgactgccaaagccgcctccaccgaagcccccrccaccaccaccatggcggctcaagcaggagaagctggaagttgatctccggcttccaccagacaccacagctgagccgctgctgaagccccggaatcctcctccacctcctcctcttcctcgagatttgcaagagatctgacaactcatgatgcctttgtccagggaggaaagtcacaggctcttgagaagagtcaaggctggagactcaactgtgctgctgggaggctttcagggtccccttatatacctgccaactaggtgttgtgtacatgggtgtggatccacttatacgtgggtt

SEQ ID NO: 179036 - DNA, 601 bp, Human
tcttctccagagtcaccttgtcaatgaaggaggcaaatttgttgttgagagttttgatctgctcacgctcttgggccttcacattctggatctctgggtcaactttcacgttgagaggctgcaggaggctctggttgacagagacttcgtggatgccaccagggtatcctccaggcccaaagccaccaggaccccctaaacctccaacaccaccagggcccccaaaacctccaaagcggcctccaccaaagccgcctccaccgaaaccaccaccactgaagccgctgccacctccaaagcggctgccgcctccaaaaccacctcctctgccaccaaatccaccagcggcgccaaagccaccacctcctccagccacactaatggagatgctcttggtccctccaaggccaacaagactccgactgccaaagccgcctccaccgaagcccccgccaccaccaccatggcggctcaagcaggagaagctggaagttgatctccggcttccaccagacaccacagctgagccgctgctgaagccccggaatcctcctccacctcctcctcttcctcgagatttgcaagagatctgacaactcat

SEQ ID NO: 179037 - DNA, 601 bp, Human
gccaggggcagctcaggtgctgcttcaggacctcgagaagtgtctgaggctggatgccgagtcatgactggcagagcttctgagctccctgctttcgcccctggaaagtcccacagactcctaatgctacatccggctctctccacgcagaggagactctttgctgcttcactgctcactggtttgtttgcagctgctcccaatactctagaccatttccctccccgcatcctggttgaatttccagccaagatcccataaattctggggaaaaccgaaagcagccatctgctggcactgmtcgcaagggtgctgagtatgagagtcccagagggcagggctcctcagcctgatttttaagagccttgtaaatccctgcctatttcaaggcagataaaccaagacaggttcgtctgccttgaaataggagaaaagccagtaacactccgaagtgacaccaataaagactttatggatcacaaaactgagaacgcttctcttgaaggcaggaatttcctgcattcccaagcagatatttcaggttcagcttcccagagtttagtaatcactgctaaggaaggaaacactatctcagaagacg

SEQ ID NO: 179038 - DNA, 601 bp, Human
aggtctggtcatgacatcctgccatagctacaggcagacaggaggcctctgtctcccagcataagggaaacgcagaccctcagactaagcatacactaggtgggatgaaaatcatgtaaccgtctactcctgggcctctcccaaggttgtcctgagaattgtagtgagaggcacctgtatttctgagcctcctagttaacattcagcacttaagccagttatggtaagtgcccccagacagaagcttgtccatggcaaataccttaaatggacttcctgtttcagaaatcatctgtgcacmcttgggttggggagggggataggagacaaatgcattttgacctctgaagtacagtaggcacaggaatgggcacagggcttgtctcttccccaggggaaatggacatctggggaatggagggaggggaagctgtcctggtgtttcctgaaccttattcccataacatcggaggagaaaattcctcacccacaagacctatgctatgaaagcccccccagtggcctggaatgatggcagattgaagtcagctggtccataaaccccacttctgccactttttcaccaagcagaaaggacttt

SEQ ID NO: 179039 - DNA, 601 bp, Human; identical to SEQ ID NO: 32548

SEQ ID NO: 179040 - DNA, 601 bp, Human; identical to SEQ ID NO: 32549

SEQ ID NO: 179041 - DNA, 601 bp, Human; identical to SEQ ID NO: 32550

SEQ ID NO: 179042 - DNA, 601 bp, Human; identical to SEQ ID NO: 32551

SEQ ID NO: 179043 - DNA, 601 bp, Human; identical to SEQ ID NO: 32552

SEQ ID NO: 179044 - DNA, 601 bp, Human; identical to SEQ ID NO: 32553

SEQ ID NO: 179045 - DNA, 601 bp, Human
cttcctgtctagcctttttactgtcttcaaagtttttacgtctggagtcacatgataaaatcctgtgccctttctgttaactccactgcctaaagatgtgggtgatgaccaatggaagatgccacagtggacacaagaccaaggacattaagtgttggctccaaagcaaaaaaaccaaaaccatttttgatgaccttacatggatgccacaataatttgcaaacgttgtcaactgaggtgatgagttttcacatgaggctgttgtgaccttgccttcctcctgcctcacatcctctcaccygcttgggccacgttttccttcctcatagccctggtttcacttgctttttcaccgtgaaccttgagcagatttgcagcaatgttactgatgctttctgacctgacatcttgcccaacttggtcctttgcaattccaaagtcaatcagtcttcttacataagcccttccaatgcctctagactatacttttacagctttgaccagctgagagtgcttctgcccaggtgattgtttcatatccttgggtgtgatccatgtctctgagccagagtgttctcactgagcctaggaactgcatgtc

SEQ ID NO: 179046 - DNA, 601 bp, Human
aagaataaacctggctggttcttttccagtgaagaaggcaccaggaacccagaactgatggtaaatgagctctgactcttcctgtctagcctttttactgtcttcaaagtttttacgtctggagtcacatgataaaatcctgtgccctttctgttaactccactgcctaaagatgtgggtgatgaccaatggaagatgccacagtggacacaagaccaaggacattaagtgttggctccaaagcaaaaaaaccaaaaccatttttgatgaccttacatggatgccacaataatttgcaaaygttgtcaactgaggtgatgagttttcacatgaggctgttgtgaccttgccttcctcctgcctcacatcctctcacccgcttgggccacgttttccttcctcatagccctggtttcacttgctttttcaccgtgaaccttgagcagatttgcagcaatgttactgatgctttctgacctgacatcttgcccaacttggtcctttgcaattccaaagtcaatcagtcttcttacataagcccttccaatgcctctagactatacttttacagctttgaccagctgagagtgcttctgcccag

SEQ ID NO: 179047 - DNA, 601 bp, Human
agaaagaacttgtcatctggtcttccagagaagaataaacctggctggttcttttccagtgaagaaggcaccaggaacccagaactgatggtaaatgagctctgactcttcctgtctagcctttttactgtcttcaaagtttttacgtctggagtcacatgataaaatcctgtgccctttctgttaactccactgcctaaagatgtgggtgatgaccaatggaagatgccacagtggacacaagaccaaggacattaagtgttggctccaaagcaaaaaaaccaaaaccatttttgatgaycttacatggatgccacaataatttgcaaacgttgtcaactgaggtgatgagttttcacatgaggctgttgtgaccttgccttcctcctgcctcacatcctctcacccgcttgggccacgttttccttcctcatagccctggtttcacttgctttttcaccgtgaaccttgagcagatttgcagcaatgttactgatgctttctgacctgacatcttgcccaacttggtcctttgcaattccaaagtcaatcagtcttcttacataagcccttccaatgcctctagactatacttttacag

SEQ ID NO: 179048 - DNA, 601 bp, Human
gttggcacactaggagggcaaaggaagagaaagaacttgtcatctggtcttccagagaagaataaacctggctggttcttttccagtgaagaaggcaccaggaacccagaactgatggtaaatgagctctgactcttcctgtctagcctttttactgtcttcaaagtttttacgtctggagtcacatgataaaatcctgtgccctttctgttaactccactgcctaaagatgtgggtgatgaccaatggaagatgccacagtggacacaagaccaaggacattaagtgttggctccaaagmaaaaaaaccaaaaccatttttgatgaccttacatggatgccacaataatttgcaaacgttgtcaactgaggtgatgagttttcacatgaggctgttgtgaccttgccttcctcctgcctcacatcctctcacccgcttgggccacgttttccttcctcatagccctggtttcacttgctttttcaccgtgaaccttgagcagatttgcagcaatgttactgatgctttctgacctgacatcttgcccaacttggtcctttgcaattccaaagtcaatcagtcttcttacataagcccttc

SEQ ID NO: 179049 - DNA, 601 bp, Human
caattatggccttgggcagtgcaccttaaagttgtgctcagtgccagaaccttgaagatggactcagctgttggaggaagtcgcgtcagttacccacctgcactcctcgccctccagcagcttgcggtaggtggcgatctccacatccagggccagcttgacgttcatcagctcctggtactccttcagcagccgggccaggtcctgcttggccttctgcagggcatcctccagcccttccagcttgttcttagcatccttgagggccatctccccacgctgctcagcatcagcaatggcrgcctgtaggttggcacactaggagggcaaaggaagagaaagaacttgtcatctggtcttccagagaagaataaacctggctggttcttttccagtgaagaaggcaccaggaacccagaactgatggtaaatgagctctgactcttcctgtctagcctttttactgtcttcaaagtttttacgtctggagtcacatgataaaatcctgtgccctttctgttaactccactgcctaaagatgtgggtgatgaccaatggaagatgccacagtggacacaagaccaaggacattaagtgttgg

SEQ ID NO: 179050 - DNA, 601 bp, Human
cagagccaggagcaacctgcaggttggaagcccctcattccttgcaccttcttaatctgccctcagcctatcttggttaagggttgaatccatgtgctcctgggaccactggggttgagctggcctgggtcacagggtaccagaagggagaggttcccactgcagtgccccagaagtaaccacatctcaggcctgggaggggtgggttgagtcatagcaaggtcacagcagggacacacattccttttgggtccctgttggcccccctcctacatccgttgctcttctgccccagctctcyggcttcgtgcgcccccttctggcctctggtggaacagccaggtcttttcacccaaagcccaaagccccaaatagtcctttgaatttgttctccattttttcatttattttattatttattgtaattaattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcc

SEQ ID NO: 179051 - DNA, 601 bp, Human
gcagggacacacattccttttgggtccctgttggcccccctcctacatccgttgctcttctgccccagctctccggcttcgtgcgcccccttctggcctctggtggaacagccaggtcttttcacccaaagcccaaagccccaaatagtcctttgaatttgttctccattttttcatttattttattatttattgtaattaattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcccaggctggagtacagtggtccagcgtctcactgcaacctccgcccccccgagttcaagcgattctcctgtctcagcctccggagtagctgggactacaggagcctgataccatgccaggctaatttttgtatttttagtggagacggggtttcaccatgttggccaggctggtctcgaacgcctgacctcaagtgatctgcccaccttggcctcccaaagtgctggg

SEQ ID NO: 179052 - DNA, 601 bp, Human; identical to SEQ ID NO: 23748

SEQ ID NO: 179053 - DNA, 601 bp, Human; identical to SEQ ID NO: 23749

SEQ ID NO: 179054 - DNA, 601 bp, Human; identical to SEQ ID NO: 23750

SEQ ID NO: 179055 - DNA, 601 bp, Human; identical to SEQ ID NO: 23751

SEQ ID NO: 179056 - DNA, 601 bp, Human; identical to SEQ ID NO: 23752

SEQ ID NO: 179057 - DNA, 601 bp, Human; identical to SEQ ID NO: 23753

SEQ ID NO: 179058 - DNA, 601 bp, Human
tctcaaaaaaaaaaaaaaaatgtactttaaagtctaaacttaaacactttaattaatctacctgaagttcagctcctcattttaaaaaaagaaagcatttaattagataatctttaaagttatttctaagatactttaacctgccgggtgtggtgactcatatctgtaatccagcactttgggaggctgaggtgggcggatcaggaggtcaggagttccagaccatcctggcaaatatggtaaaaccccgtctctactaaaaacacaaaaattagcagggcgtggtggcaagcgcccgtawtcccagtcactcaggaggctgaagcaggggaatcgcttgaacccaggagacggagattgcagtgagccaagatcgggccattgcactccagcctgggcgatatagcgaaaactccgtctcaaaaagaaaaagatacttactttaaaccaaagtttcttttgttttgagacagagtctagctctgctgcccaggctggagtgcagtggcatgatttcggctcactgcaacctccacctccggggttcaagcgactctcctgcctcagcctcccaagtagccaagactacaggcaagtgcca

SEQ ID NO: 179059 - DNA, 601 bp, Human
aagtaatactcaaagaccaaattccagaaaaaccctcctcctgtacctccccccaacttaaaaaaaaaaaaaatcagtcttctccttttagctcactgtaatggaatgtgacctgtacttaagggcttttccattcctttttttctgcttacagaatatgaagcagacctattctctctcacaagggcaatatgcttttaaaagaaaaaaaggtgaaatgtacgaagttaataatgtattaattagaacaaacaaaagtaaaataatttactagatttctcacatgtgagttgtcctcctrttagaacaatgcatgacacttagaatgagtgtattttttactttttttttttttgaggcagagtttcactcttgttgcccaggctggagtgtaatggcgcaatctcggctcactgcaacctccacctcctgggttcgagcagttctcctgcctcagtctcgtaactgggattacaggtgtgcgccaccatgcctcgctaatttttgtatttttagtagagatggggtttcaccatgttggccaggctggtctcaaacccctaacctcaggggatccacccaccttggcctcctgcagtgc

SEQ ID NO: 179060 - DNA, 601 bp, Human
cttttcacctttcgctcagttgcttatcattgactggaaaacactgtagtatcccgcaaatgactgctacttttcatacaacaaaggctgattttgtttaatcctttgtcagttaaaaaaaaaaaaaaaggccaggtcttttgatgtcaggaaatgcagaagcaagcaaagtccaccaagtagctaaatgaatcaattacatttatgtttttaaaacaggtccaaagcctaaaataagtaaccccatagcaagtttattttagtatgtttgtactctccaagataacagacttttcccttytttaacaatagacatctaattagcataacattttcaaaattaatttcctgtgttttggtgagaatctttagactggggcatatgggaggggaagcagggaaataattattaaaaagtactcgtctgcagaagaaacaggactatgtaattcttacgcaaatgtttgttaactccctctggcacaaaaacagtgatgtcattctagacagcagtagagcagagttataatgaacatcaagtttttaaatcactgacaacttaaggaaattaagaatatgacttaaaaatctcctctcccca

SEQ ID NO: 179061 - DNA, 601 bp, Human
gaggggccaagggtgactccaagatttggaagaatttgaagtgtggaaaagccacttagtaatactgagagaggagatggtttgtttataaacagcaaaaattttattttggccaagctaattctgagatgcctattagaccatcacatgaagatgtaaagtaggcagctgaatatacaagtctggagttcagagaaggggtctaagttaaagataaaaaatctgggagttgtcagtatataaaaatgcatttagagatactcctggatgagattattaagagactgagtacatatagacmaaaaaaagaaaaaaaaaatccaagggctaaggacaaagtaaatttaatatttacaaatgcaaaagaaatgaagacagtaaaggaagctgaaaaggaatggacagtgaggtgggaggaatatcaagaagtggtgtcctgcaagccaaggtaagaacgtgcttcaaggaagaaaggtcaacaggaccaaatggtactgataggtcaaataagatgaggactgagaactcactggaattactggagaatcactgtcccttccagaacccaatcccatacaagcgttccttgttctagtagagt

SEQ ID NO: 179062 - DNA, 601 bp, Human
agccatggagacacctggaagaaggcttcaggcagagaaactggcaagtgcaaaagactttgtctttttcactgatgaaatgggaggccatttgactacagtgatcttgacttacattttcaaaggattactctggctgatcagtttaaaacagactataaagggttaaggacagaagcaaggagcctagttaggaagcaactgccataaaccaatggtaaattagaccagggtggtggtaagtagaagtcttcagattctgaacaaaatttaaagatagagtcaacagtatttgctaatsagctgaatataagattgaaagagaggggccaagggtgactccaagatttggaagaatttgaagtgtggaaaagccacttagtaatactgagagaggagatggtttgtttataaacagcaaaaattttattttggccaagctaattctgagatgcctattagaccatcacatgaagatgtaaagtaggcagctgaatatacaagtctggagttcagagaaggggtctaagttaaagataaaaaatctgggagttgtcagtatataaaaatgcatttagagatactcctggatgagattatt

SEQ ID NO: 179063 - DNA, 601 bp, Human
gagtgatgaaaatgttctttatcgtgactggggtggtggttacatttgtcaaaattcacccaactgtactcctaaaatgaatgcattttattctatataagttataactcaataatgctgattctttaagaaagacatctgataccatagagggtagaagaagggaaaaaatgaaagacaattagtatcattgtccccagatggtgaggtacgatgaagaaaaataaagccaacaaggggcaaataagtgtgggtgctggttaggtgtatacttttaaataggatggtcatgaaaggcctsattgcctctttagaaacaacctgtaggaagagaaagggtaagccatggagacacctggaagaaggcttcaggcagagaaactggcaagtgcaaaagactttgtctttttcactgatgaaatgggaggccatttgactacagtgatcttgacttacattttcaaaggattactctggctgatcagtttaaaacagactataaagggttaaggacagaagcaaggagcctagttaggaagcaactgccataaaccaatggtaaattagaccagggtggtggtaagtagaagtcttcagattc

SEQ ID NO: 179064 - DNA, 601 bp, Human
gtatccataaatccctccttcctctttcttctccagtgcccatactacaagcactatgcaaggctctctgctaaacaatctctacccaaagtccctaggagaactcatttattttcaaggcctcaacttagctaataaccctcaaaataatatcaaccactatcacctgcaccatgcatgttcagcatctatgatcacttctacttgtatgttccatatcacctcaaattcaacatggcccaaattaaactcattttatcaacccataccaacattccctataagtagtttcaccatctcracttcagcttccatcaatatcaccacatgcaagtcccaaaacggcagatatcctccttatatttctaatttatcactttctctcatactgacccttcacctcactattccacttccaccaccttaatttatgctcttattactaacctcctgaatagcttcctgcctgcctatgctcccagactaaactctgcctaattcatcctaaatatatcaacggttttcatatagctagccctcagttattgatcactataatgactgttgatgactttggcagacattattgtttatcccatat

SEQ ID NO: 179065 - DNA, 601 bp, Human
catattatagtggctctaatgtaagttattataaatatgtgtgtatgtgaatatatgtatacaaataatccaatcaaccttggattaactagttggttaaatttgtttctcacaggagatacaggcaaacaattctgaaattgctttatatgtgtatggggataaataaataagtaaatggacactggatggtaggagccgggtttctcatatgagagagaagttacagatacgcaagaaaggaaggctaaaatgaaccctgtggtatcgaagagtcggagatatcagtataaactcacawtcagcttagtatgtgtacagtgatgaacagacacagaaacaactgtagatatgtacatacacatgaattagtagcatatatacacatattatctattgctagtcaccagagggcctagaaacggtaacacctcagtagtaacaaataaacccagtgaccagatatagatttctaaataaccactctccaataaaaggaatcaggaaccacagcttcttggaaaaatgactaactatagggctcggcagggaaaatacaagatgaacctggagcatactgcagtatgagaaggtcaggaag

SEQ ID NO: 179066 - DNA, 601 bp, Human
cgagatcgcgccactgcactccagcctgggcaacagagcgagactccatctcaaaaaaaaaaaaaaaagaatgagcctatcttgcttctttgcctaactccactggtgaggaaagttactgaatttttacgtcgtaatttttagcgtggaagcaagtagaaataaattgaacttctttttttaaaatttttttaaattgaatttatttcttactttaatcacttccttagtaaggaagtgattaaaactttatggcacatccacattgtggactgctcagtgagttacagacttctgttaytggcataatgaagagtagataccctgaacactcctgattagaaacaaaggaaaaaaaaatttttttttaacattttgttgaactaacacaaaaggaaggattccacaaaggtccaaagtgaagtgaaactgggaattcaggaatgtaagacagcagtaaattggctttcatcctgagagtttatgctgaatcctggagaccttaagtatccacactggcacagaaataggatacaaaacaggagataaaaccaagggggcagccaggcataatggcatgcacctgtagtcctagctactc

SEQ ID NO: 179067 - DNA, 601 bp, Human
aaaaccattgttcacctgcccaaaacacaatcccagatcacttgcactgctgcattttggacacaatttccaaagtatggtcacctagacatatgctattcagaaacaacaaaatgcttatgacgagttcactttgggtgggaaatttttagagggtgtctaaaaacgtatcctattagcatttaggtttcagggtattcacaaattaagcagcatagaaaagacataagaatgagcctatcttcaggagaatggcgtgaacccgggaggtggagtttgcagtgagccgagatcgcgccaytgcactccagcctgggcaacagagcgagactccatctcaaaaaaaaaaaaaaaagaatgagcctatcttgcttctttgcctaactccactggtgaggaaagttactgaatttttacgtcgtaatttttagcgtggaagcaagtagaaataaattgaacttctttttttaaaatttttttaaattgaatttatttcttactttaatcacttccttagtaaggaagtgattaaaactttatggcacatccacattgtggactgctcagtgagttacagacttctgttattggcataatgaag

SEQ ID NO: 179068 - DNA, 601 bp, Human
aacatcagactccgttttctaaatcatcctgcagtttggtacaacttccactttcttataactcagtatgaatcaaaaccattgttcacctgcccaaaacacaatcccagatcacttgcactgctgcattttggacacaatttccaaagtatggtcacctagacatatgctattcagaaacaacaaaatgcttatgacgagttcactttgggtgggaaatttttagagggtgtctaaaaacgtatcctattagcatttaggtttcagggtattcacaaattaagcagcatagaaaagacayaagaatgagcctatcttcaggagaatggcgtgaacccgggaggtggagtttgcagtgagccgagatcgcgccactgcactccagcctgggcaacagagcgagactccatctcaaaaaaaaaaaaaaaagaatgagcctatcttgcttctttgcctaactccactggtgaggaaagttactgaatttttacgtcgtaatttttagcgtggaagcaagtagaaataaattgaacttctttttttaaaatttttttaaattgaatttatttcttactttaatcacttccttagtaaggaagtg

SEQ ID NO: 179069 - DNA, 601 bp, Human
ccactctcaaggacttgtaacctgctatttcacttcctcatttatttgtaattatgccatctgaaaacataattctgagactttcggttttgattatttgagaaacatcagactccgttttctaaatcatcctgcagtttggtacaacttccactttcttataactcagtatgaatcaaaaccattgttcacctgcccaaaacacaatcccagatcacttgcactgctgcattttggacacaatttccaaagtatggtcacctagacatatgctattcagaaacaacaaaatgcttatgamgagttcactttgggtgggaaatttttagagggtgtctaaaaacgtatcctattagcatttaggtttcagggtattcacaaattaagcagcatagaaaagacataagaatgagcctatcttcaggagaatggcgtgaacccgggaggtggagtttgcagtgagccgagatcgcgccactgcactccagcctgggcaacagagcgagactccatctcaaaaaaaaaaaaaaaagaatgagcctatcttgcttctttgcctaactccactggtgaggaaagttactgaatttttacgtcgtaa

SEQ ID NO: 179070 - DNA, 601 bp, Human
gagaaaggatttatcatgataatataagtcttatcataagcaaatattatgtacacagttgctcaatgtagagaatctcatagtcattctgcctgattgtttatggaaagccaaatagtaaataaagaattctggagttcaaaatgtaccaataaggaaaaataaaccatgaagagggaaagtattctctcatgacaaataatatgcagataacatgcttaaaatactcaggattatataacctgaattcgagttgatgctttgcaaaaggcctcttctttgacctggaaatcagtgccaygtgcctctgcactgtccactctcaaggacttgtaacctgctatttcacttcctcatttatttgtaattatgccatctgaaaacataattctgagactttcggttttgattatttgagaaacatcagactccgttttctaaatcatcctgcagtttggtacaacttccactttcttataactcagtatgaatcaaaaccattgttcacctgcccaaaacacaatcccagatcacttgcactgctgcattttggacacaatttccaaagtatggtcacctagacatatgctattcagaaaca

SEQ ID NO: 179071 - DNA, 601 bp, Human
tgaggtgggaggattgtttgagcccaggtgtctgagtctagtctgggcaacatagcaagaccctgtctcattaaaaaaaaaagcgggggggttgcgggagttgggcacagtggctcacacctgtaatcccagcactctgagaggccgaggcaggaggactgcttgagcctgggagttcaagactagcccaggcaacatgatgagacccatctctacaaaaaataaatttaaaatattagtcaggcacagtggcacacgcctgtagtcccagctactagggaggctgaggtgggaggatcarttgagactgagatatcaaagctgtagtgagccatgattgtgctactgcactccagcttgggtaacagagcaagatcctgtcttaaaaacattaaaaaaaaaaaaaaaagaaaagaaaatcaggcttcaagtagattcatatgtaaaagaaaaaataataaaggaataaaaatatatcatacgctaagagaaaagtcaacatacaaacaaataccctataagttttgttttttcagttatctgtttcaatttttatctagatattttttaaactatatttgtaaagtggagcgcccctcca

SEQ ID NO: 179072 - DNA, 601 bp, Human
tgtaaaaaagaccctataccaagatcctctaaaatttatcattattacccactctcctgcccatccaccacaatccactacacaagtgttgtttaaatatacattacattttgtttatggttttgttttttttaaagaataaacacattcaagggcaatgaacaaaatacattcaggttaaaaccatctcatcaaaattctctgcagttccaaagaagagactattcttttttttttgttttggtcttatatgcgctatgaatatgaatatgacagcttcacggctccaacgtaattataraaaataaaaataatatgacattactttggcaggcaggcatacattttcatttaatatgacacaataagattactactttctcccaaaagttaactcctattgccaataaaaacttacttctagttctttaattttttcttctgctattttctgcttctctaacagctgactgtgaattgcttccttggactgaagaataaacctatgaaacacaagaaagttgaaaattaagccacatgactattgaattcatcgaaatcaatagctacatactacaaatattaaactgagcaaattaaa

SEQ ID NO: 179073 - DNA, 601 bp, Human
agaaaaagaaaaaatcatttatccctacgtcccatctaatttctttagggtaaacagtattaacaatttaatatatatccttacatatcatcttcaatattcatacacaaatgtttgttttttgttttcataaagagaattatatacatattaccttgctacttattattcattaggataattttaaatatatttacctacagttgcaaaaatgcatttttgttttatctacatgaaatgattctgtttgggtttttaaagatacttttgtttcttatgagtgaaaacacagatatcaaaytgaacctcttagaacagttgagctgattaaaatgttaaaataggacacaacaacaatctggttatcacaggctgttttttctttacttggtttttttgcttttttgtcttgtttttacaatacacttttctaagctgcaaatctattatcaagtttgtttcaactatcagtagttaaaaataagcctaagtaacctaagatactgcatactcccaggccaggccaattcagtgcccctaagaaatcctcaggaggctacaagttgtagctcccaaattcagcagagggctgagttagatt

SEQ ID NO: 179074 - DNA, 601 bp, Human
cagcctgggcaacaagagcgaaactccgtctcaaaaaaaaaaaaaaaaaacaaaaaaagaaaagaaaagaaaagaaagaaagaaaaagaaaaaatcatttatccctacgtcccatctaatttctttagggtaaacagtattaacaatttaatatatatccttacatatcatcttcaatattcatacacaaatgtttgttttttgttttcataaagagaattatatacatattaccttgctacttattattcattaggataattttaaatatatttacctacagttgcaaaaatgcatttttgttttatctacatgaaatgattctgtttgggtttttaaagatacttttgtttcttatgagtgaaaacacagatatcaaattgaacctcttagaacagttgagctgattaaaatgttaaaataggacacaacaacaatctggttatcacaggctgttttttctttacttggtttttttgcttttttgtcttgtttttacaatacacttttctaagctgcaaatctattatcaagtttgtttcaactatcagtagttaaaaataagcctaagtaacctaagatactgcatactcccaggcca

SEQ ID NO: 179075 - DNA, 601 bp, Human
gtcaggcatggtggctcacacctgtaatcccagcactttgggaggccaaggtgggtggatcacaaggtcaggagttcgagaccagtctgggcaacatggtgaaaccccatctctactaaaaatacaaaaattagccaggcatggtgggcctgtagtcccaggtactcaggaggctgaggcagaagaatcgcttgaacctttggggcagaggtggcagtgagccaagacacaccactggactccagcctgggacagaatgagactctgtctcaaaaaaaaaaaaaaaaaaaaaaaaaaaaamcaaaaaacaaaacataagctccaaacttcgtatacagtaataatgagcacttgcccccccaacactgtattctctaaatatcactgcccactaaactgacagattaaggagaaattgataaacactgtcatagaggaagattcatcacatctctcagtaactaaatgaataagcagatgataattcagtaagatacacacaaaatttgaacatcacaattaacagtgtatatgtgcataagtgcacatgtgggggtgtgctgaagtaataaaaccataaagttgtagcagtggaaaagta

SEQ ID NO: 179076 - DNA, 601 bp, Human
agacatacgccccagtcaggcatggtggctcacacctgtaatcccagcactttgggaggccaaggtgggtggatcacaaggtcaggagttcgagaccagtctgggcaacatggtgaaaccccatctctactaaaaatacaaaaattagccaggcatggtgggcctgtagtcccaggtactcaggaggctgaggcagaagaatcgcttgaacctttggggcagaggtggcagtgagccaagacacaccactggactccagcctgggacagaatgagactctgtctcaaaaaaaaaaaaaaamaaaaaaaaaaaaaacaaaaaacaaaacataagctccaaacttcgtatacagtaataatgagcacttgcccccccaacactgtattctctaaatatcactgcccactaaactgacagattaaggagaaattgataaacactgtcatagaggaagattcatcacatctctcagtaactaaatgaataagcagatgataattcagtaagatacacacaaaatttgaacatcacaattaacagtgtatatgtgcataagtgcacatgtgggggtgtgctgaagtaataaaaccataaagttgta

SEQ ID NO: 179077 - DNA, 601 bp, Human
actaaagatacaaaaagtagccaggcatggtggctgtaatcccagctactcaggaggctgatgcagaagaatcgcttgaacccagaaggcggaggctgcagtgagccaagatcatgccactgcactccagcctggacaacagagcaagatgccatctcaaaacaataaaaaataaataaatataaacagaagagctgagaaattcctaacataaaacaaaataagacatacgccccagtcaggcatggtggctcacacctgtaatcccagcactttgggaggccaaggtgggtggatcacraggtcaggagttcgagaccagtctgggcaacatggtgaaaccccatctctactaaaaatacaaaaattagccaggcatggtgggcctgtagtcccaggtactcaggaggctgaggcagaagaatcgcttgaacctttggggcagaggtggcagtgagccaagacacaccactggactccagcctgggacagaatgagactctgtctcaaaaaaaaaaaaaaaaaaaaaaaaaaaaaacaaaaaacaaaacataagctccaaacttcgtatacagtaataatgagcacttgcccccccaac

SEQ ID NO: 179078 - DNA, 601 bp, Human
gaggtcaggagttcaagaccagcctggccaacatggtgaaacccaaaccccgtctctactaaagatacaaaaagtagccaggcatggtggctgtaatcccagctactcaggaggctgatgcagaagaatcgcttgaacccagaaggcggaggctgcagtgagccaagatcatgccactgcactccagcctggacaacagagcaagatgccatctcaaaacaataaaaaataaataaatataaacagaagagctgagaaattcctaacataaaacaaaataagacatacgccccagtcaggmatggtggctcacacctgtaatcccagcactttgggaggccaaggtgggtggatcacaaggtcaggagttcgagaccagtctgggcaacatggtgaaaccccatctctactaaaaatacaaaaattagccaggcatggtgggcctgtagtcccaggtactcaggaggctgaggcagaagaatcgcttgaacctttggggcagaggtggcagtgagccaagacacaccactggactccagcctgggacagaatgagactctgtctcaaaaaaaaaaaaaaaaaaaaaaaaaaaaaacaaaaa

SEQ ID NO: 179079 - DNA, 601 bp, Human
aagactatcttcccaccattaagacactgcttgtgccaggcgcggtggctcacacctgtaatcccagcactttgggaggccaaggcaggcagatcacgaggtcagaagattgagaccatcctggctaacacggtgaaaccctgtctcactaaaaatacaaaaaaaattagctgggcatggcggggtgtgcctgtagtcccagctactcgggaggctgaagcaggagaatggtgtgaacctgggaggcggagcctgcagtgagccgagattgcgccactgcactccagcctgggagacagarcgagactctgtctcaaaaaaaaaaaaaaaagacagtgcttgtgtttattctgctaataaggaatatgactccctatcaagattaacatgagggcaagtagtacccccacccctgcctataagagacaagggccagtagatgaggccacttggctggctgatgacatagggcacaacatgacaaagctacaaaaagctaaacaaagtctaggtaagctttgcactcataaataagatcagaaaaaagaaatcaggagagggcaagtataaagaaacagaaagaacaaagctgggtaaaagg

SEQ ID NO: 179080 - DNA, 601 bp, Human
aagaagttctaaggaaaaaaaagacagtaagactatcttcccaccattaagacactgcttgtgccaggcgcggtggctcacacctgtaatcccagcactttgggaggccaaggcaggcagatcacgaggtcagaagattgagaccatcctggctaacacggtgaaaccctgtctcactaaaaatacaaaaaaaattagctgggcatggcggggtgtgcctgtagtcccagctactcgggaggctgaagcaggagaatggtgtgaacctgggaggcggagcctgcagtgagccgagattgcrccactgcactccagcctgggagacagaacgagactctgtctcaaaaaaaaaaaaaaaagacagtgcttgtgtttattctgctaataaggaatatgactccctatcaagattaacatgagggcaagtagtacccccacccctgcctataagagacaagggccagtagatgaggccacttggctggctgatgacatagggcacaacatgacaaagctacaaaaagctaaacaaagtctaggtaagctttgcactcataaataagatcagaaaaaagaaatcaggagagggcaagtataaaga

SEQ ID NO: 179081 - DNA, 601 bp, Human
tacaaaaattagcccaggcacctgtaatcccagctacttgggaggctgaggcaggggaatcacttaaacctgggacatggagattgcagtgagccgagattgtgatactgcaccccagcctgggtaacaaagcaagacttcatctcaaaaaaaaaaaaaaaaaagtaaaaggaagttcttttgttttctttattctttgtacaattcataggttcaacaaagaagttctaaggaaaaaaaagacagtaagactatcttcccaccattaagacactgcttgtgccaggcgcggtggctcacrcctgtaatcccagcactttgggaggccaaggcaggcagatcacgaggtcagaagattgagaccatcctggctaacacggtgaaaccctgtctcactaaaaatacaaaaaaaattagctgggcatggcggggtgtgcctgtagtcccagctactcgggaggctgaagcaggagaatggtgtgaacctgggaggcggagcctgcagtgagccgagattgcgccactgcactccagcctgggagacagaacgagactctgtctcaaaaaaaaaaaaaaaagacagtgcttgtgtttattctgc

SEQ ID NO: 179082 - DNA, 601 bp, Human
gcaggtggatcacccaggagttcaagaccagcctggccaacatggtgaaacacagtctctactaaaaatacaaaaattagcccaggcacctgtaatcccagctacttgggaggctgaggcaggggaatcacttaaacctgggacatggagattgcagtgagccgagattgtgatactgcaccccagcctgggtaacaaagcaagacttcatctcaaaaaaaaaaaaaaaaaagtaaaaggaagttcttttgttttctttattctttgtacaattcataggttcaacaaagaagttctaagraaaaaaaagacagtaagactatcttcccaccattaagacactgcttgtgccaggcgcggtggctcacacctgtaatcccagcactttgggaggccaaggcaggcagatcacgaggtcagaagattgagaccatcctggctaacacggtgaaaccctgtctcactaaaaatacaaaaaaaattagctgggcatggcggggtgtgcctgtagtcccagctactcgggaggctgaagcaggagaatggtgtgaacctgggaggcggagcctgcagtgagccgagattgcgccactgcactcca

SEQ ID NO: 179083 - DNA, 601 bp, Human
acttcccaattaatcccattacagtgatgatggcctgaagaacagtctaacataggggtattaaaatgtaaaaagaggcagagcacagcggctcacgcttgtaatcctagcactttaggaggctgaggcaggtggatcacccaggagttcaagaccagcctggccaacatggtgaaacacagtctctactaaaaatacaaaaattagcccaggcacctgtaatcccagctacttgggaggctgaggcaggggaatcacttaaacctgggacatggagattgcagtgagccgagattgtgayactgcaccccagcctgggtaacaaagcaagacttcatctcaaaaaaaaaaaaaaaaaagtaaaaggaagttcttttgttttctttattctttgtacaattcataggttcaacaaagaagttctaaggaaaaaaaagacagtaagactatcttcccaccattaagacactgcttgtgccaggcgcggtggctcacacctgtaatcccagcactttgggaggccaaggcaggcagatcacgaggtcagaagattgagaccatcctggctaacacggtgaaaccctgtctcactaaaaataca

SEQ ID NO: 179084 - DNA, 601 bp, Human
ttttcaaataacaacaaatactgtattaggtattatgcactcagtaccttctttagaaagttattatcagtattttttaaaaatagaaaatttcctcaaaaaatgacaaaaataacatggttactctatcatactaaagccacgattttgtattttctcgtgaataggatcagcatcactggtctactaatcacagttaggatgtattctcttccagaatttgatctatcacctttataacgaaagattaaatctacataaaccgtgagtctgttatgaaaatacttcccaattaatcccrttacagtgatgatggcctgaagaacagtctaacataggggtattaaaatgtaaaaagaggcagagcacagcggctcacgcttgtaatcctagcactttaggaggctgaggcaggtggatcacccaggagttcaagaccagcctggccaacatggtgaaacacagtctctactaaaaatacaaaaattagcccaggcacctgtaatcccagctacttgggaggctgaggcaggggaatcacttaaacctgggacatggagattgcagtgagccgagattgtgatactgcaccccagcctgg

SEQ ID NO: 179085 - DNA, 601 bp, Human
caaaaaagacttctactttctcttagtaccaatgttatacattataaaaagaaaattattttacaaagacaaatgagacatgtcataattccaaatcacagttgtaatcatgctattttctaaaattatgcttgggtacttttcaaataacaacaaatactgtattaggtattatgcactcagtaccttctttagaaagttattatcagtattttttaaaaatagaaaatttcctcaaaaaatgacaaaaataacatggttactctatcatactaaagccacgattttgtattttctcgtraataggatcagcatcactggtctactaatcacagttaggatgtattctcttccagaatttgatctatcacctttataacgaaagattaaatctacataaaccgtgagtctgttatgaaaatacttcccaattaatcccattacagtgatgatggcctgaagaacagtctaacataggggtattaaaatgtaaaaagaggcagagcacagcggctcacgcttgtaatcctagcactttaggaggctgaggcaggtggatcacccaggagttcaagaccagcctggccaacatggtgaaaca

SEQ ID NO: 179086 - DNA, 601 bp, Human
tgttctctcgccgccattcttcctatttatttcaggaaccactgtctgaccaaaactgtcatttttgtggaagagttgggactttaaacgtcaagactttaacagttttttttttttacatatgatatgggctggggagttatttcaacagccctgggattgcaacattctgcatcagaagtggcgctaagcacgccagactgtcctaggtttccttattcttattctgttattgctgagctaaccagggtggtgaaaggggtggtaaccatgttggagacagaggggaaggaagctggtkaacctgtatatgcatgtgcctaaaatataacagactttaggttgaaggctgactttaggttgaagcagtaactggcctccacctggaacaaaaaaaacataaggcaatggtggcaaaaatgtgttcaaatgtatcattgaaagtttacatttacctcaaggattcctaatagttgagattcagaaggtcaggagctcatctctagatcatctgaatgctgacttaaattttcctaactgcaaaagaggcccattaattatttcctgcttacctccaaaaaagttagcaaaaccagaggat

SEQ ID NO: 179087 - DNA, 601 bp, Human
tgtcttgtttaatgttttaaaaacattctatcattggctctgctatcccctgccctcctttcttcattgaaaaacagaggtaagaccaagtctggccaatatggtgaaaccccatctctactaatgatacaaaaattagccgggcatggtggcatgcacctgtagtcccagctactcaggaggttgaggcagaagaatcgcttgaacccaggaggcggaggttgcagtgagccgagatcgtgccactgcactctagcctgggcaacagagcaagactccatctcaaaaaaaaaaaaaaaaagagaaaaacagaggtaagaatcagtgactatcatacagtagagtccacctgacatcacctccaaatgggggctcctattatatacaccaatagtaccagctcaaaaatgcagtacttagggcaaaactggacatccatccaagtgcctaccagtcaccacccatgcgatggaaaaaatgattctcaacaggcagagtaaaatttcctcaatcatgggaatccctccaaagcatgttctcatcagagtatcaaacctaagccaactgcagagtgtcacaggcacctcctatcctgttctct

SEQ ID NO: 179088 - DNA, 601 bp, Human
aaaatatatttgttgttgttgtcttttgagatggagtctcactgtgacgcccaggccggagtgcaatagcgtaatcttggctcactgcaacctccaccaccagggttcaagcgattctcctgccccagcctcccgagtagctggggctacagacgcgtgccaccaggcccagctaatttttgtatttttagtagagacaggatttcaccatattggccaggctggccttgaactcctgacctcaggtgatctgcccgcctcagcctcccaaagtgctgggattacaggcgtgagccaccaagcccagcctaaattatattattttagagatacatccataggtggtaaaaccattttttttttttttttgagacagagtcttgctctgtcacccaggctggagtgcagtggcatgatctcggctcactgcaacctccacctcccgggttcaagcaattctcgacctcagcctcccaagtagctaggattacaggcgcccaccaccacgcccggctaatttttgtagttttagtagagacggggtttcaccatcttggccaggctggtcttgaactcctgacctcatgatctacccgcctca

SEQ ID NO: 179089 - DNA, 601 bp, Human
tggactgtctagatagataaattgtggtacttctatatgacgggatactatgcagcaatgaaatgaacaactcacaatctcaagagataacacagatatacttcacaaacacaacgtggagagaaagaagtgaggcaaaaaaatagtgattttgttcatgtaaagttcagaaacaagctaaactaaattatatatatacacacacatatatatacataaaatacatatatacataatatatatatttatatacataagatatatatttatatacataagatatatttatacacataaaatrtatttgttgttgttgtcttttgagatggagtctcactgtgacgcccaggccggagtgcaatagcgtaatcttggctcactgcaacctccaccaccagggttcaagcgattctcctgccccagcctcccgagtagctggggctacagacgcgtgccaccaggcccagctaatttttgtatttttagtagagacaggatttcaccatattggccaggctggccttgaactcctgacctcaggtgatctgcccgcctcagcctcccaaagtgctgggattacaggcgtgagccaccacgccca

SEQ ID NO: 179090 - DNA, 601 bp, Human
aagtgtctagctatctagctactatggaaagtaggaaatcatcaagctaattttaatcatcaggagtgtaaacgttttatacttcttcccaggatgcaagctctcctggagtgtgggtggagggtggtttctgaaaattatcttagcaagatgctaagataaactgtaaaaatactccatgagaataccttcacttgttaagaataaaaatggactgtctagatagataaattgtggtacttctatatgacgggatactatgcagcaatgaaatgaacaactcacaatctcaagagataamacagatatacttcacaaacacaacgtggagagaaagaagtgaggcaaaaaaatagtgattttgttcatgtaaagttcagaaacaagctaaactaaattatatatatacacacacatatatatacataaaatacatatatacataatatatatatttatatacataagatatatatttatatacataagatatatttatacacataaaatatatttgttgttgttgtcttttgagatggagtctcactgtgacgcccaggccggagtgcaatagcgtaatcttggctcactgcaacctcca

SEQ ID NO: 179091 - DNA, 601 bp, Human
cctaaataaccgaaaactattttaaaacaaacatacatttttataaatgttaagaatgcaaatgagctctataaagagataagtactcatgtttgaaatcccaatatatgcacaataagagaaatcacttcacccaagactctccaagtcaaaacaacgtaggaaagagattaattttacatcttgcattgatttctaagataaaaattttaaaaagacatccataagtgtctagctatctagctactatggaaagtaggaaatcatcaagctaattttaatcatcaggagtgtaaacgtyttatacttcttcccaggatgcaagctctcctggagtgtgggtggagggtggtttctgaaaattatcttagcaagatgctaagataaactgtaaaaatactccatgagaataccttcacttgttaagaataaaaatggactgtctagatagataaattgtggtacttctatatgacgggatactatgcagcaatgaaatgaacaactcacaatctcaagagataacacagatatacttcacaaacacaacgtggagagaaagaagtgaggcaaaaaaatagtgattttgttcatgtaaagt

SEQ ID NO: 179092 - DNA, 601 bp, Human
tccaattatcttaagtctcttatcttaatcataaaatgaagatgcgccaccaggaaacagatcaaatcaagggtatatcaatgtgtgtgttaaatatctgtaatatatatttcaagataaataaggaaggctatccaattaaaagaaccaatctatgggccaggcacgatggcttatgcctgtaatcccagcactttgggaggccgaggcgggcggataacggggtcaggagatcaagaccatcctggctaacatggtgaaaccctgtctcttctaaaaatacaaaaaaattagccgggcrtggtggcgggcgcctgtagtcccagctacttgggaggctgaggtaggagaatggtgtgaacctgggaggtggagcttgcagtgagccaagattgcgccactgcactccagcctgggtgacagagcaagactccgtctcaaaaaaaaagaaccaatctatttgaactgcttacatctaagttctcattggatctacaatacttctatgaaggaaataaaatgcatcacagatgctttatatttgggcaaattttagcacttggatcataacatatacaatgaacaaggcattgacaatatt

SEQ ID NO: 179093 - DNA, 601 bp, Human
agataagtattccaaggagagcaacaaggcacccaatgtatccaagaagaaaataataactgaaacaagatgcaaaaagctgaactctgggctaattggaatgcaaatccaattatcttaagtctcttatcttaatcataaaatgaagatgcgccaccaggaaacagatcaaatcaagggtatatcaatgtgtgtgttaaatatctgtaatatatatttcaagataaataaggaaggctatccaattaaaagaaccaatctatgggccaggcacgatggcttatgcctgtaatcccagcamtttgggaggccgaggcgggcggataacggggtcaggagatcaagaccatcctggctaacatggtgaaaccctgtctcttctaaaaatacaaaaaaattagccgggcgtggtggcgggcgcctgtagtcccagctacttgggaggctgaggtaggagaatggtgtgaacctgggaggtggagcttgcagtgagccaagattgcgccactgcactccagcctgggtgacagagcaagactccgtctcaaaaaaaaagaaccaatctatttgaactgcttacatctaagttctcattggatct

SEQ ID NO: 179094 - DNA, 601 bp, Human
taacttttttttttttttttgagatggagcttcgctcttattgcccaggctggagtgcaatggcatgatctctgctcaccgcaacctccatctcccgggttcaagcgattctcctgcctcagcctccccagtagctgggattacaggcatgcgccaccacgcccggctaattttgtatttttagtagagatgggggtctctccatgttggtcaggctggtctcgaactcctgacctcagatcatctgcccgccttggcctcccaaaatgctgggattataggcgtgagccaccgtgacccrcctttaactttttaaattaagacaatgatctggacaaaggaaattgtttttgttttgttttgctttcctccatcttttcattttaagggggcatttttgctcctaaaatggaaactcagaaaaagaccaaggttataacaataaacttaatagaagtgactggagtgaccctagagatcttctaatccaatattctcattttatgtgaggaaactgaggcttagcgtacagcaagagttagaatgaagaactcctaaattaacataaggcttttaaaattaggaatttagggtaatgaac

SEQ ID NO: 179095 - DNA, 601 bp, Human
cttcctcacaagatgactatgtaaccaaaagaatagcttcgtgaatagtgatggaattcaaatatttcgattatgctggcagcaggtaagagactgaaagcaagacaaagtgagctgggagaaacctcaaattagacataattagcaaaacagcattgtccctagtcattctatttataaatgaagtaatatgcaaaaatcatttgaaaaatgaataaaacggtaagataaaaatggtaaaagccctatgaaaatggtgtaactgtttgcatcagcagataaactaaaattcacaaaaaaagttattaaaataaataagatacaattcattaaaaagttcataaacgggatgggcacagtggctcacacctgtaatcccagcactttgggaggccaaggtggaccgcttgaggccaggagttcaagatcagcctggccaacgtggtgaaaccccatctctactaaaatacaaaaattagccggttatggtggcgcaccctgtaatcccagctactcgggaggctgaggcaggaaatcttttgaatctgggagtcagaggctgcagtgagccaagaatgcaccactgcactccagcctgggt

SEQ ID NO: 179096 - DNA, 601 bp, Human
cagttacatgcaggtgtactggaatcacacatgctgcggtgtaggttacagttacatgcaggtgcactggaatcacacatgctgcggtgtgggttacagttaaatgcaggtgcactggaatcacacatgcggttatattttatcaaaccacctgactctgaacactgagttaggggagaatagtaaatagaaagattcttattcacacactaactcccccacttctaaccaccacactcactctccctctcttaaaagctaaatgcacatttccattgtcaaaagccacatttaaagatcrgcagaagaccacagttgcctggttaatctctagcacaaccgctgaatccgagcatgctctttcagcccccaggctctggctccacactaagggaatgtgggtacctgagccctgtggggtttgagaaaagggagagctcaaacaatgctctcatgagcactttaaacaaaaaatccattcaatgagaatggcaccatgttctttttgccctttctccccaggaactaaattaaacagattacagacagtagccagggctggccttagaaccacctcccgcttatttgttatttttagcaa

SEQ ID NO: 179097 - DNA, 601 bp, Human
agagtcaaatcaaagcagagctttatgctgcagtgtgggttacagttacatgcaggtgtactggaatcacacatgctgcggtgtgggttaaagttaaatgcaggtgtactggaatcacacatgctgcagtgtgggttaaagttaaatgcaggtgtactggaatcacacttgctgcggtgcgggttacagttacatgcaggtgtactggaatcacacatgctgcggtgtaggttacagttacatgcaggtgcactggaatcacacatgctgcggtgtgggttacagttaaatgcaggtgcaytggaatcacacatgcggttatattttatcaaaccacctgactctgaacactgagttaggggagaatagtaaatagaaagattcttattcacacactaactcccccacttctaaccaccacactcactctccctctcttaaaagctaaatgcacatttccattgtcaaaagccacatttaaagatcagcagaagaccacagttgcctggttaatctctagcacaaccgctgaatccgagcatgctctttcagcccccaggctctggctccacactaagggaatgtgggtacctgagccctg

SEQ ID NO: 179098 - DNA, 601 bp, Human
agaagacagggaggatttgggccttaatcacaggcccaaaacttcagtttttccaactctcttcttttactcctatacccagtcaccttggttctaccttaaaatacatccagagtctgatcacctccactgtcaccatcctggtccaacctaccatcatctctcacctggataatgcagcagcctatcattaaactagggagtaacactggtttgtgacttgagaaatatctaaaagcaggcatttcaaagcctgcaatgtctaactgctcagatcccaaagctatgggtaaatacgtcratcttcactaatgtatgctttcccaagatatttgcatggcacctccccacaacaaacccccaggatctctaataaaaacaatccttttttacctgtggtattaaagtaatcaggtttagacacccacccccttccccaaaataagaactgcaaaggaaagggttttggatgagatttcagactacgaaaatcaataaacttcagaatacaaaaatcaataagccctcaggtgagtcaacacagaatgtggaacacacacacacacctaaaaatttgctcctagttttcacacattccacc

SEQ ID NO: 179099 - DNA, 601 bp, Human
gaatgtctgcagcaggacgatccctctgtggagcccaggacatacggaatgctgagtagaaaccacactgaatgaatagcattgggacttagaacagctacttgcacagaacaagcagtacttagaaaaagtgagtagaagcaatgctaatttcattcactttaattcctttcccttagatctttccagcctcacttcccactcactcacttcccaatggagggttacaccactgcaaccaccactccacttccagacttttgtccacactattccttgatttgaaatgccctctcctctrccctagccccacctagcaaacttctagctgaccttcaaagcccaggtgaaatgcccgcccctctcccatgaacccattccagatctcttgtggagaatgagtgacatatggggaaggaagaggaagaagacagggaggatttgggccttaatcacaggcccaaaacttcagtttttccaactctcttcttttactcctatacccagtcaccttggttctaccttaaaatacatccagagtctgatcacctccactgtcaccatcctggtccaacctaccatcatctctcacctggataat

SEQ ID NO: 179100 - DNA, 601 bp, Human
ctaacagaactgaccacttctgctgccagcctctgcttggacagcccatgaaaaagcagtccccttaccaccaagggagttgagagcaacccttcagcctggccctgtatcagcagagggttgcccatgtgggtattcacttggttatttggactcaaaatggacgccgtccacacctctgtggtcctgctacagtgacccagggctcagtccacaaaccctgtcccttctccagctatacttttcccttagttgacccaagctagttctatgacttgaaacgccatctataaactggcaatttgtagacaattctccattttatttcgctagtccagagttccagattcatatatccaactgtctattcaacatctctacttgggtgtctaatagtaatctcaaaggtaaaggcccaaaccaaactttcagtttccttttaaaattagttttgggggaaaaaaaaatttagtttcaaaacttgaaaactgactaggaaacattgatctatgaataagcagtagcacatttgttcctataaacctgcagcaggacctggaatgtctgcagcaggacgatccctctgtggagcccaggacat

SEQ ID NO: 179101 - DNA, 601 bp, Human
ttatgttacaaggcaggtacttttcataagggataaatgtttatcctcacctccagctttaattagttatagtcccggcctcctccatctagtccagggaagactggtggcttttctgatgggcttgtttggaagaacaaaggggctcggccccttctgctctgccagaagctgcttgcttgcagaaggctcttgtaagtttaacagacagactctgcctgcctctgcagagaaagacctgtggttgtcccacacttatagagatttgcagggtaagttcatctatctgtatgcctaaatytggatcaatattaaaaacccatgactgctgcataccaaagccacatccttcaacctaatctttactaatattaaaggtaaaatatataaaaagatggaatttttatatccatctgtctttcaattggttccactcttgggccagaaataaaagttacttattgtctcccttcatcctaacacttgcttttgccattttacggacgagtgtatttaggcttaaaaacaccgtatcagtctatttttgcattactataaaggaatacctgacactgggtaatttataaagaaaagaagttta

SEQ ID NO: 179102 - DNA, 601 bp, Human
agaatttaatatgctaatagctctgatctaatagctgacataacaccaattaaatttttaatgacactggagtaataaaagagcccttggcatacttctctttgcaaacatgactcaaagggtggttttccttttgcccttgcttcaatttccagatgccaggccacttagaagccacttatctctttactcagagctggtattcgggggttatcattttataagaaaaggaccacaaattttagaatgcctacctactcagagtatccaactacagcataaggaatccccatttctttcmgagtaaaagtgaatggtaaagggtttggagtctagaatctggaatcccaggttaccactctgatgtccctctctttccctgactgattctggttctggctccatgaagaacacgtgacctccatttctaaatcatgggcagaagccaccaagttcatgagatggcttcacacagaatccatggctattagaaaataagagcagcagatcaaactgacctgctggcactcgactgttgagtccactgaccagccctaccaatggcaatgtttgtgcttcatatggaatgaaaaaaacaagt

SEQ ID NO: 179103 - DNA, 601 bp, Human
cagaaagctacatactagatgatccatttataaacacccaaaacaggcaaatctgcagagacagatagaaaacagattcatggttgccaggtactgagggaatgggcagtctcactgcttaatagttaagtttcttttgggggcaataaaaatgttctagaattagacagtggtgatgattatacaacattgtgtattttatgttatgtgaattttacctcactttaaaaaatatatatctccttttattctcaaaatgctgcaccacaaggggagaagacaggacacgggccgggcacartggctcatgcctgtaattccagcactttgggaggccgaggcaggtagatcacttgaggtcaggagctggagaccagcctggccaacatggtgaaaccccgtctctactaaaaatacaaaaattagctgggcctgatggtgcacaactgtaatcccagctactcaggaggctaaggcaggtgaatcgcttgaactcaggaggcggaagttacaatgagccgagatcacaccactgcactccagcctggatgacacagtaagactccatctcaaaaaaaaaaaaaaaaaaaagaaaggatat

SEQ ID NO: 179104 - DNA, 601 bp, Human
ctgatacatgctataacatgaatgaaccttgagacattaagctaagtgaaagaagccagacacagaaagctacatactagatgatccatttataaacacccaaaacaggcaaatctgcagagacagatagaaaacagattcatggttgccaggtactgagggaatgggcagtctcactgcttaatagttaagtttcttttgggggcaataaaaatgttctagaattagacagtggtgatgattatacaacattgtgtattttatgttatgtgaattttacctcactttaaaaaatatatatctccttttattctcaaaatgctgcaccacaaggggagaagacaggacacgggccgggcacagtggctcatgcctgtaattccagcactttgggaggccgaggcaggtagatcacttgaggtcaggagctggagaccagcctggccaacatggtgaaaccccgtctctactaaaaatacaaaaattagctgggcctgatggtgcacaactgtaatcccagctactcaggaggctaaggcaggtgaatcgcttgaactcaggaggcggaagttacaatgagccgagatcacaccactgcact

SEQ ID NO: 179105 - DNA, 601 bp, Human
gcgatgggcagctgaagtcggtggggacttttggttcagagaagattaagggaagaaggaatctatcactaccttaactatagaaagcaatggctctccaagtgcagtcctctcccagcagcatcgggatcacctgcgaacttattagaagggcatattcttatgcctcgacccagaccaactgaaccagaaaccctggggatggactacagcaatctgtgttttcacaatccctcccgggtggctgtgacccacactgaagtttgagactcaaactttttgttctaaatcaggagtcagmaaactttttctataaagggccagataataaatatttcaggctttcactgtggggttatctctgttacaactactcagctctgccattgtagcacaaaagcagtcagacaatgtgtaaacaaatgggtgtggtgcagatgaatgggcacggctatgtttcgaaagcacagaaacaggcagtgggctggacggggcaggcggtggtttgccagtgtctgttccttaaaaagatggggctttaaagggtaggactgagtccagcagttagagatttttaactttcactgaaagctgcctaata

SEQ ID NO: 179106 - DNA, 601 bp, Human
atccttcagaaaagaaagacagaaaagacccttcagaggtctttctgctgaaggacagggacaaaagacttgcttcagctaagcgctgacctgttttcctcccaggtgtgcttttacctgccgacagactgacactgctaccatatggggtcagactcccaaaccccacctatgatcacatgctggctagcacccccaattcagtctgccaagacgaacccgaacccctacaccactcaagcactttacagcagatatacacgaggggaaaaaattcttcttcaaacaacagtgtttagcygctcggtccccctgaggtttaggtgagttctacctactgctgccctccctaacacatcagcttcatgtgagtcccagagaaagcccagcctaccagataacctgggaatgaccagatagaaagctcagagtgaagcacagagccaggagcggcaactgtcctaatgcaatatggtgctgatcaagcctcagccaaagaatcactaccatctgcaggcaccaggtgtaaaagggatgatgacaagccagcaaatcacgtcaagtgatggggtcaagcgatgggcagctgaagtcggtgggg

SEQ ID NO: 179107 - DNA, 601 bp, Human
acaatggggatgtttggcaagaggccaagaactcactgagggctgaagaagcatgttttgatgggggacaaggttggtagaaggcaggggaaacaagacaaaaacagaaaaaaaggcaacaagaggacacaatcagagaaggcaggatggaaaatgggacagcatggccacggctgcagcaggcaggggcagggcagagccctgagggcacatgtgccctgagccgccagcctggatgggtgaggagggccaacagaggcaggcaaaaccccacacctgagagacaggtctaagcggtccwcggatatgcccacttgtaaactcatctgggtgcatccacttcaccagaggacacagctaggcgatatggtaaccactgagctacaccgctgggagacaaatcaaagaaagataaagcaatcttaggcatggagcaggagaataaagagaaatctcggaaggagttactgtccctgcatcttctagatactactttagaaatatccttcagaaaagaaagacagaaaagacccttcagaggtctttctgctgaaggacagggacaaaagacttgcttcagctaagcgctgacctgttttcc

SEQ ID NO: 179108 - DNA, 601 bp, Human
gtgttgctctaaaggaatacctgaggctgggtaatttatgaagaaaagaggtttgtttggcccacaggtctgcaggctatacaagcatggtgcagcatctgcttctggagagggtttctggctgcttgcattcgtggtggaaggcgaaggggagccacctgtacagaaatcatgtggccagagaggaaatgagagaggaggtgccaggctcttttcaacagccagtcagtgaagaaacaaagcatgagaactcactcccatgagaatggtaccaagccatacacaagaaacccgcccccayaatccaaacatctcccaccaggccccaccttcaacactggggatcaaatttttttgcgggggttgggggggtctgggggtaccaaatttcaacatgagacctgccagggggcaaagaaaccctatgcacaccacagcaggggcatccttcatttccagtgcggtgctgtgctcttgggtaagggcactaaccccatttaaagggctctgccctcatgacctactcatctcccaaatggccacacctcctaacaccatcatctcaggagttaggatttcaacaaagactttagggagaaac

SEQ ID NO: 179109 - DNA, 601 bp, Human
aagctggtctcaaactcctgacctcgtgatctgcccgcctcggcctcccaaagtgttgggattacaggggtgagccaccgtgccaggccgataaacaactcttagactttaactgtggtgagctgaaaaaaggcaaatactagtaagccctgacacacactaaagaatgtatgtccactgggtgtcacaaagaggggagcaatagctcggtgccatacaccacctgggcaccctgtggaccccatgtgaatgcaggggaaaggcgaatggaataagcccacttctcctcctacaaaagtcmgccagggcccagggactctggtctgttgcattcaatctctgccaacttgctgccacagctggcaaaaccatcaacttggaacatcagcaagagctcttctgccctcccacccagactccccagccaaactcaggctatacctctcagctttaaaaattccttcttctgtaaaatctctgctttctaacactttgatgaattttaccactgcatatcctaaagtcttcaggtttccaaacaatgatgcaaattaacatatctatctatatttttgttttgtttctagaaatggggtcttgt

SEQ ID NO: 179110 - DNA, 601 bp, Human
cggctcactgcaacctccgcctcccgggttcacacgattctcccgcctcagcctcccaagtagttgggattacaggcacacaccaccacgctggctaattttttctatttttagtagagatggggtttcactgtgttagccaagctggtctcaaactcctgacctcgtgatctgcccgcctcggcctcccaaagtgttgggattacaggggtgagccaccgtgccaggccgataaacaactcttagactttaactgtggtgagctgaaaaaaggcaaatactagtaagccctgacacacactaaagaatgtatgtccactgggtgtcacaaagaggggagcaatagctcggtgccatacaccacctgggcaccctgtggaccccatgtgaatgcaggggaaaggcgaatggaataagcccacttctcctcctacaaaagtcagccagggcccagggactctggtctgttgcattcaatctctgccaacttgctgccacagctggcaaaaccatcaacttggaacatcagcaagagctcttctgccctcccacccagactccccagccaaactcaggctatacctctcagctttaaaaattc

SEQ ID NO: 179111 - DNA, 601 bp, Human
aggccatccaaataaagcatccatcggggcagaggagaagctgtttccctgcagacactcctctgcccccaccaggaatgggaggggcaggaggaagagcttcccagagaggctccctactgggcccttcgtgccatcagcatctcccggatgttgtcctcagcttccttaacgcttcgctccaggtaggactttttctgctgcaatatgagagacagacaaaggttaggaccagagtgaatgggccgggctggaagacacagctttgatgtccaatggttatggcttttcctttgtgacrggcaactttcaggagtatactgcaagccaggtacacacacctgcccacagtgctcccctcacctccgaaccatgggtgatcacgggcaggcagcagggagaagatggctttggtagaagcaaaagtgctctgtggaggacaggcagtagcactcttcccccagaaggaagaagactctaaaaaacaggcgtctcagtacatgaagttatcccagacagacaaaggccaggaaattccaggacaaagctcctgtccgtaacagactatctcctctcaaggttttccatggcctgggccagg

SEQ ID NO: 179112 - DNA, 601 bp, Human; identical to SEQ ID NO: 116604

SEQ ID NO: 179113 - DNA, 601 bp, Human; identical to SEQ ID NO: 116605

SEQ ID NO: 179114 - DNA, 601 bp, Human; identical to SEQ ID NO: 116606

SEQ ID NO: 179115 - DNA, 601 bp, Human; identical to SEQ ID NO: 116607

SEQ ID NO: 179116 - DNA, 601 bp, Human; identical to SEQ ID NO: 116608

SEQ ID NO: 179117 - DNA, 601 bp, Human; identical to SEQ ID NO: 116609

SEQ ID NO: 179118 - DNA, 601 bp, Human; identical to SEQ ID NO: 116610

SEQ ID NO: 179119 - DNA, 601 bp, Human; identical to SEQ ID NO: 116611

SEQ ID NO: 179120 - DNA, 601 bp, Human; identical to SEQ ID NO: 116612

SEQ ID NO: 179121 - DNA, 601 bp, Human; identical to SEQ ID NO: 116613

SEQ ID NO: 179122 - DNA, 601 bp, Human; identical to SEQ ID NO: 21283

SEQ ID NO: 179123 - DNA, 601 bp, Human; identical to SEQ ID NO: 21284

SEQ ID NO: 179124 - DNA, 601 bp, Human; identical to SEQ ID NO: 21285

SEQ ID NO: 179125 - DNA, 601 bp, Human; identical to SEQ ID NO: 21286

SEQ ID NO: 179126 - DNA, 601 bp, Human; identical to SEQ ID NO: 21287

SEQ ID NO: 179127 - DNA, 601 bp, Human; identical to SEQ ID NO: 21288

SEQ ID NO: 179128 - DNA, 601 bp, Human; identical to SEQ ID NO: 21289

SEQ ID NO: 179129 - DNA, 601 bp, Human; identical to SEQ ID NO: 21290

SEQ ID NO: 179130 - DNA, 601 bp, Human; identical to SEQ ID NO: 21291

SEQ ID NO: 179131 - DNA, 601 bp, Human; identical to SEQ ID NO: 21292

SEQ ID NO: 179132 - DNA, 601 bp, Human; identical to SEQ ID NO: 21293

SEQ ID NO: 179133 - DNA, 601 bp, Human; identical to SEQ ID NO: 21294

SEQ ID NO: 179134 - DNA, 601 bp, Human; identical to SEQ ID NO: 21295

SEQ ID NO: 179135 - DNA, 601 bp, Human; identical to SEQ ID NO: 21296

SEQ ID NO: 179136 - DNA, 601 bp, Human; identical to SEQ ID NO: 21297

SEQ ID NO: 179137 - DNA, 601 bp, Human; identical to SEQ ID NO: 21298

SEQ ID NO: 179138 - DNA, 601 bp, Human; identical to SEQ ID NO: 21299

SEQ ID NO: 179139 - DNA, 601 bp, Human; identical to SEQ ID NO: 23234

SEQ ID NO: 179140 - DNA, 601 bp, Human; identical to SEQ ID NO: 23235

SEQ ID NO: 179141 - DNA, 601 bp, Human; identical to SEQ ID NO: 23236

SEQ ID NO: 179142 - DNA, 601 bp, Human; identical to SEQ ID NO: 23237

SEQ ID NO: 179143 - DNA, 601 bp, Human; identical to SEQ ID NO: 23238

SEQ ID NO: 179144 - DNA, 601 bp, Human; identical to SEQ ID NO: 23239

SEQ ID NO: 179145 - DNA, 601 bp, Human; identical to SEQ ID NO: 23240

SEQ ID NO: 179146 - DNA, 601 bp, Human
gtaacttattctctaagatatgagtgtcatataagaaagactcttctattgttttgctcagttcccagcaaacatactaacatactaggtaagaaaaaaagaaacaaggaaaagcaatatgagaatgatttagtaacttcactcaatggagtattaagtaacctttcaagcagtaattatgaccactgtgtagtactaggaaaaacaggcatgccacaccactttttgtgccccctatccactcgcgtacatacaaacacattattctcagtactatgatttattttggtctctgccttcaaaagtgcccaactttgatttgggagataaatatgtaaaacaattgcacaaaaataagtgtattgtatacagaactagagaaacactgtaatcccagcactttgggaggccgaggcaggtggaccacctgaggtcaggagctcgaggccagcctggccaacatggtgaaaccctgtctctactaaaaatacagaaattagccaggcatggtggtgcacgcctgtaatcccagctactcaggagactgaggcaggagaaccgcttgaacccgggaggcaaaggttgcagtgagctgagatca

SEQ ID NO: 179147 - DNA, 601 bp, Human
gcatggcagttctaaccggtatcgacgtttgaacaaagccagaaacatcaagtaacttattctctaagatatgagtgtcatataagaaagactcttctattgttttgctcagttcccagcaaacatactaacatactaggtaagaaaaaaagaaacaaggaaaagcaatatgagaatgatttagtaacttcactcaatggagtattaagtaacctttcaagcagtaattatgaccactgtgtagtactaggaaaaacaggcatgccacaccactttttgtgccccctatccactcgcgtayatacaaacacattattctcagtactatgatttattttggtctctgccttcaaaagtgcccaactttgatttgggagataaatatgtaaaacaattgcacaaaaataagtgtattgtatacagaactagagaaacactgtaatcccagcactttgggaggccgaggcaggtggaccacctgaggtcaggagctcgaggccagcctggccaacatggtgaaaccctgtctctactaaaaatacagaaattagccaggcatggtggtgcacgcctgtaatcccagctactcaggagactgagg

SEQ ID NO: 179148 - DNA, 601 bp, Human
tctgtaactacgctgatattttctaaagaaaactttgactgctctttacaaagaatagatatttaagaaagagcagaaacataatactaattaggagactatttcaatttataggaaagaaaagacaatagcgtgaacaagcgaaagaactggacagattccatatggaatttaaaattagagacaaaaggactttctgaagaattgaatttctggagagaaaaaacagagaaaaatgaagaatgacttctgcatgtttggcttgagcaaaagggtgaatgttggtgccatttactgagayaggcgagcccaggagaggaacaggtatgggcgaaaatccagagcttgtgtttgaacgttttatttgaaatatctgcaagccatccaaggggaggtgctaagtgggtggctgaatgcaggactctggagttcaaagagtggtcagggtgggagggcagggagtcattagcacacagatggtggttaaatccttgcaactcaatgagacctccaggggagagaccagtggcccatccaccttcattctttcctcacgctgagttctctgcccatgcaatgcgcttctctaactctctacact

SEQ ID NO: 179149 - DNA, 601 bp, Human
acatatgtagataatccatggtctctgacgtagatgagatttgacttcagtggatgcaggtatctgagttggggaggaatgggtctagaaactgcatggtgaagtccaccacatgcagaaggaagggtgcctccaccttagaatacagaagacaggagaagataaacatggacataagaatagatatgtttatatttatggggaaccgcatggcttactgagaggaagggatttagactagactgtgtactccatgtaatagatatgtttatatttatggggaaccgcatggcttactgasaggaagggatttagggactgtgcactccatgtgcaatgtggctcaaaggagagaaaaaggtttataatcatacttgagagggtagcagaagaagctaattaaagaatatctccctgagttacagggttgtgtggggatgccccaggaagggtgaagaagctgtggatatgctacagagatccagggttccataaaagttttgtctgtgggctggaccatgacaaggctctagataatgtaacctcaacaaggacaagttgaagtcggactttttttctccttgcttttggttctggaaat

SEQ ID NO: 179150 - DNA, 601 bp, Human
tagcaggggcagatttggtggaaaagtgagattgaaaaatagattgcagaaacttgagaaaaaatgtggaaaggagaaagataagatggtagctagaatgaaaccagcatcaatgaaaggtttgctttagaactggaagctgagcagatcaagccagtggagaggaataggctgaggttgtaggcaaatgagggaataactaattaacttggtttcaaaaatatttttgttgccgtgtttatatgccagggattatgacggatactgtgaccacatatgtagataatccatggtctctgaygtagatgagatttgacttcagtggatgcaggtatctgagttggggaggaatgggtctagaaactgcatggtgaagtccaccacatgcagaaggaagggtgcctccaccttagaatacagaagacaggagaagataaacatggacataagaatagatatgtttatatttatggggaaccgcatggcttactgagaggaagggatttagactagactgtgtactccatgtaatagatatgtttatatttatggggaaccgcatggcttactgacaggaagggatttagggactgtgcactcc

SEQ ID NO: 179151 - DNA, 601 bp, Human
gatgaaaggaaaataaaaacgcacatttgttagattcgcatttaggctattttagcttaaagagttcaaatcaatgtgtggataactgagaatcatttattttattttattttattttaattttttttgagacggagtctcgctttgtcacccaggctcgagtgcagtggtgcgatctcggctcactgcaagctctgcctcccgagttcatgccattctcctgcctcagcctccagagtagctgggactacaggcgctcaccaccatgcccggctaattttttttttttttttttttttgkatttttagtagagatggggtttcaccatgttagccaggatggtctcgatctcctgaccttgtgatccacccgactcggcctcccaaagtgctgggattacaggcgtgagccaccgcgcccagccggctaattttttttaagagacacagtctcactatgttgcccaggctggtttccaactcctggcctcaagcaatcctcccaccttgacctcccaaattgctgggattataggcatgagctactgtgcccagccaggatctaagagtttcacaaacccatttatgtttctaataatct

SEQ ID NO: 179152 - DNA, 601 bp, Human
ctagttttcacaagctgttcttctacaacaaagtacaacattctaagttacttgttaaaagtaattatagattcctgggcaagatggccaaataggaacagctccattatgcagcttccagcgagaacaacacagaaggcgggtgatttctctatttccaacggaggtaccggctcatctcattaggactggttagacagtgggtgcagcccatggagggcgagcagaagcagggtggggcgttgcctcacccaggaagcacaagtggttggagaactccctcccctagccaagggaagcygtgagtgagggacagtgctatccagcacagataactacgcttttcccactgtcttcgcaattggcagaccaggagattccctcgggtgcctacaccgccaggcccctgagtttcaagtgcaaaactgggaggccatttgggcagacacagagctggctacaggagttttttttttttttttttttttttttttgttgttgttgttgttttagatggagtctcgctctgtcgcccaacaaagatcaaaagagacaaagaaggggaatatataatggtaaagggttcaatgcaacaagaaga

SEQ ID NO: 179153 - DNA, 601 bp, Human
ccattcttttgaagggaatccataccaagtgttttcaagaacttcctgtcacttcaaagaaagttttagcgtgaatatatagagagggcatgagttgaaatggcaaggagcagatgcatggtctacaaaaaaatccacagaacaaatcctgacatgtcactaaagatgtagaatgaatctctgtctcttgagtaagcagtaacactgtaaccacaatagttttgactggaggctacactgtcaactgttgaaggccactgcacagaacattctcttttagaaatatatttgaaatcagttmtatctttggaatcaaggttttggccagccacaaagagtgttctctggccagcatggatatgtacttattagatgatggcttaatgttggtctgtagtaggtagcattcctggaggttaactcatttcagaggctggaaatgggtatgaagaaaacagtttgaacactaactgactgcgaggcatttccattagtgaaacaaatcattactgacaaatagaggctagtttacctccgtcacatgagctcatcactcccagcttctcctttgtggcccagggtccaagtcactaaacatcaa

SEQ ID NO: 179154 - DNA, 601 bp, Human; identical to SEQ ID NO: 30478

SEQ ID NO: 179155 - DNA, 601 bp, Human; identical to SEQ ID NO: 30479

SEQ ID NO: 179156 - DNA, 601 bp, Human; identical to SEQ ID NO: 30480

SEQ ID NO: 179157 - DNA, 601 bp, Human; identical to SEQ ID NO: 30481

SEQ ID NO: 179158 - DNA, 601 bp, Human; identical to SEQ ID NO: 30482

SEQ ID NO: 179159 - DNA, 601 bp, Human; identical to SEQ ID NO: 30483

SEQ ID NO: 179160 - DNA, 601 bp, Human; identical to SEQ ID NO: 30484

SEQ ID NO: 179161 - DNA, 601 bp, Human; identical to SEQ ID NO: 30485

SEQ ID NO: 179162 - DNA, 601 bp, Human; identical to SEQ ID NO: 30486

SEQ ID NO: 179163 - DNA, 601 bp, Human; identical to SEQ ID NO: 30487

SEQ ID NO: 179164 - DNA, 601 bp, Human; identical to SEQ ID NO: 30488

SEQ ID NO: 179165 - DNA, 601 bp, Human; identical to SEQ ID NO: 30489

SEQ ID NO: 179166 - DNA, 601 bp, Human; identical to SEQ ID NO: 30490

SEQ ID NO: 179167 - DNA, 601 bp, Human; identical to SEQ ID NO: 30491

SEQ ID NO: 179168 - DNA, 601 bp, Human; identical to SEQ ID NO: 30492

SEQ ID NO: 179169 - DNA, 601 bp, Human
ctgcagattctcaacatcaataaaagtgatgaaggtatatacagatgtgaaggaagagtggaggccaggggagaaattgacttccgtgatatcattgttattgttaatggtaagcagtaaataatttgtacatgttttatggattcattttagcaatgttttttattaaatggcaaccatgtgaactcaaaatacaagtcttatctaataaacctcttctataccaggaagaaatctttccatctttattatggcatctgtaacattgtattacagcctcaaggcaggatccatgacttakgttacattgtcattctcataacccttttcaaataggctatatgtgagtaattgccttttgctggaattgtagttgttgaaagaatatcaaataaacatagtacagtatcatactaaatgttacttttaaattacatgaattatttttgcttaaatttacatattttactctacatgtttctcaaatttaataattaaatttttaaggttatatttacaagtattaatggacattagtgactggttttatgaaatcatgatgaaatctcttcctccaaagttgcttctcctatatagttcc

SEQ ID NO: 179170 - DNA, 601 bp, Human
gattctcaacatcaataaaagtgatgaaggtatatacagatgtgaaggaagagtggaggccaggggagaaattgacttccgtgatatcattgttattgttaatggtaagcagtaaataatttgtacatgttttatggattcattttagcaatgttttttattaaatggcaaccatgtgaactcaaaatacaagtcttatctaataaacctcttctataccaggaagaaatctttccatctttattatggcatctgtaacattgtattacagcctcaaggcaggatccatgacttatgttayattgtcattctcataacccttttcaaataggctatatgtgagtaattgccttttgctggaattgtagttgttgaaagaatatcaaataaacatagtacagtatcatactaaatgttacttttaaattacatgaattatttttgcttaaatttacatattttactctacatgtttctcaaatttaataattaaatttttaaggttatatttacaagtattaatggacattagtgactggttttatgaaatcatgatgaaatctcttcctccaaagttgcttctcctatatagttccttcct

SEQ ID NO: 179171 - DNA, 601 bp, Human
tacatgttttatggattcattttagcaatgttttttattaaatggcaaccatgtgaactcaaaatacaagtcttatctaataaacctcttctataccaggaagaaatctttccatctttattatggcatctgtaacattgtattacagcctcaaggcaggatccatgacttatgttacattgtcattctcataacccttttcaaataggctatatgtgagtaattgccttttgctggaattgtagttgttgaaagaatatcaaataaacatagtacagtatcatactaaatgttacttttmaattacatgaattatttttgcttaaatttacatattttactctacatgtttctcaaatttaataattaaatttttaaggttatatttacaagtattaatggacattagtgactggttttatgaaatcatgatgaaatctcttcctccaaagttgcttctcctatatagttccttcctgtgttaacatgatattctatggagctggaaaatacattacagttatcttggctgtctcctgtactagcccattttcacactgctataaagaatactcgagactgagtaatttataaagaaagg

SEQ ID NO: 179172 - DNA, 601 bp, Human
atccatgacttatgttacattgtcattctcataacccttttcaaataggctatatgtgagtaattgccttttgctggaattgtagttgttgaaagaatatcaaataaacatagtacagtatcatactaaatgttacttttaaattacatgaattatttttgcttaaatttacatattttactctacatgtttctcaaatttaataattaaatttttaaggttatatttacaagtattaatggacattagtgactggttttatgaaatcatgatgaaatctcttcctccaaagttgcttctyctatatagttccttcctgtgttaacatgatattctatggagctggaaaatacattacagttatcttggctgtctcctgtactagcccattttcacactgctataaagaatactcgagactgagtaatttataaagaaaggagatttaattgactcacagttccaagtgactggggaggcctcaagacacaatcatggcagaaggcagaggagaagcaaaggcatgtcttacatgacagcaggcaagagtgcgtgagaaagactgaagaaatgccacacttaaaaccatcagctctcatga

SEQ ID NO: 179173 - DNA, 601 bp, Human
atttacatattttactctacatgtttctcaaatttaataattaaatttttaaggttatatttacaagtattaatggacattagtgactggttttatgaaatcatgatgaaatctcttcctccaaagttgcttctcctatatagttccttcctgtgttaacatgatattctatggagctggaaaatacattacagttatcttggctgtctcctgtactagcccattttcacactgctataaagaatactcgagactgagtaatttataaagaaaggagatttaattgactcacagttccaartgactggggaggcctcaagacacaatcatggcagaaggcagaggagaagcaaaggcatgtcttacatgacagcaggcaagagtgcgtgagaaagactgaagaaatgccacacttaaaaccatcagctctcatgagaactccctcgctgtcacaagaagagcatggggaaaaccgcctccatgatccagtcacctcccaccagttccttccctgggatacctgggaattattaatacaacatgggatgaaattttgttgaagacacagattttgttgaacaatttcatctccattttggca

SEQ ID NO: 179174 - DNA, 601 bp, Human
gaaatcatgatgaaatctcttcctccaaagttgcttctcctatatagttccttcctgtgttaacatgatattctatggagctggaaaatacattacagttatcttggctgtctcctgtactagcccattttcacactgctataaagaatactcgagactgagtaatttataaagaaaggagatttaattgactcacagttccaagtgactggggaggcctcaagacacaatcatggcagaaggcagaggagaagcaaaggcatgtcttacatgacagcaggcaagagtgcgtgagaaagastgaagaaatgccacacttaaaaccatcagctctcatgagaactccctcgctgtcacaagaagagcatggggaaaaccgcctccatgatccagtcacctcccaccagttccttccctgggatacctgggaattattaatacaacatgggatgaaattttgttgaagacacagattttgttgaacaatttcatctccattttggcagtctaatctgttatgaagacatatccattgtatattttaacatctctcaaacatactctattttctctatcatgttgttttccatgagagtggtga

SEQ ID NO: 179175 - DNA, 601 bp, Human
aaatgccacacttaaaaccatcagctctcatgagaactccctcgctgtcacaagaagagcatggggaaaaccgcctccatgatccagtcacctcccaccagttccttccctgggatacctgggaattattaatacaacatgggatgaaattttgttgaagacacagattttgttgaacaatttcatctccattttggcagtctaatctgttatgaagacatatccattgtatattttaacatctctcaaacatactctattttctctatcatgttgttttccatgagagtggtgatctaatttttttttcttgaattcatacaacttggtttctctacacttaatctcacaattctacctttctctccaccaagactttcaactgtaataattcttcagtgtttctcactactgtcaagacaaaatcaaaacgacttttcatggcatagaaaacccattatgatccaccccttccctaagcattctgccattagatgtcagtcatagggaaactgggtccttagaggagatctagtatttttcaatggtctttctagaagtacagagtccgatatttattaagggtgccataatcagtgga

SEQ ID NO: 179176 - DNA, 601 bp, Human
atctccattttggcagtctaatctgttatgaagacatatccattgtatattttaacatctctcaaacatactctattttctctatcatgttgttttccatgagagtggtgatctaatttttttttcttgaattcatacaacttggtttctctacacttaatctcacaattctacctttctctccaccaagactttcaactgtaataattcttcagtgtttctcactactgtcaagacaaaatcaaaacgacttttcatggcatagaaaacccattatgatccaccccttccctaagcattstgccattagatgtcagtcatagggaaactgggtccttagaggagatctagtatttttcaatggtctttctagaagtacagagtccgatatttattaagggtgccataatcagtggagtagttaaccttcagtgcgggaggaagatttcagtgcataaaggataggtttaaatagggagatgtctgtatctaacctttatctatatcaatatgtaactctttctctttattgtatacaataaacaagggtaataaatatatagtggctatttagtttgttaattattgaattgtctaccat

SEQ ID NO: 179177 - DNA, 601 bp, Human
aattctacctttctctccaccaagactttcaactgtaataattcttcagtgtttctcactactgtcaagacaaaatcaaaacgacttttcatggcatagaaaacccattatgatccaccccttccctaagcattctgccattagatgtcagtcatagggaaactgggtccttagaggagatctagtatttttcaatggtctttctagaagtacagagtccgatatttattaagggtgccataatcagtggagtagttaaccttcagtgcgggaggaagatttcagtgcataaaggataggtttaaatagggagatgtctgtatctaacctttatctatatcaatatgtaactctttctctttattgtatacaataaacaagggtaataaatatatagtggctatttagtttgttaattattgaattgtctaccatactttgtatccaaaaagatttatgatgaaatatgtaagtgtatttcatcatgagcagtctttgtgttaagtacgtacttatgaaaaagggaattataataaaaattaatatatgtaaaattctttaaaattggttaagtttataggaaacagtatataagtatttc

SEQ ID NO: 179178 - DNA, 601 bp, Human
tttgactttgactgctgccctattctgttcctctcagtttacattcccagccctctcacttaattgctactaatttttatctttaccaatttgacatttattctggtcctctttcattcatcttcttccacctcaagtataccgaagtcctacccaaatgccccagtcaaatgttttttcacatgcagcgcttccttgtcaaatcttggccttgtaggaggacctgccctttattctacgttttgttctttgcaaacttttccatcacatttctatcctaccaattcatactcttttgttkcaacaattagttgaaagatatccttgctggcttcctctgtagtaccagcaataatacatgtttaggatcttattacttactttattttttcttacctccctctgtgactttcttaatgtgtttttcaatgcctgggtattgtttttcacaaatattcttcccctcccttgaagaagattatacaccaatgcctttgatatgtgaagtatggcgcctccaaaggaaggattatgcatcttcacccagtcgatcatgtgacttgctctagccagtgacttagaagcaaacaaaatacacacc

SEQ ID NO: 179179 - DNA, 601 bp, Human
acacagcatcatttccctttagacacttagagttgtagctcaacaatctgtaagaatcaactttactaaagtcctttattgtttatggggtagctggattcaaaagcatttaacaaatgcagttttcctagatattcacagactattttttgagaatggaaacccaatgcagctgaagacaggagagtaccttggtattaaagataaatataatgaaggaaaactgttatttaggagaatagggcaataatatgttgcagacagaaagaccaacacttgtaaaacaaacaagagcataagktgtgaaaaaatccaagcacctaactgtgattgaaatatactgttttttgacaggaataagaacaatggtgtgttggttggtttggagattaggtggaggtgcagctgaaaagcaggtagcagtcaatcatggatgaccatcgatgctttattaaaaacctgatttatgggacaaggaagagctgccattgagaagcaagtaatccagagagcaagggagttgacacaaggatattggcagggagaaaaagtgagttcatgtgagagataattggggcctttactaaagggcaaggaaatg

SEQ ID NO: 179180 - DNA, 601 bp, Human
attaaagataaatataatgaaggaaaactgttatttaggagaatagggcaataatatgttgcagacagaaagaccaacacttgtaaaacaaacaagagcataagttgtgaaaaaatccaagcacctaactgtgattgaaatatactgttttttgacaggaataagaacaatggtgtgttggttggtttggagattaggtggaggtgcagctgaaaagcaggtagcagtcaatcatggatgaccatcgatgctttattaaaaacctgatttatgggacaaggaagagctgccattgagaagmaagtaatccagagagcaagggagttgacacaaggatattggcagggagaaaaagtgagttcatgtgagagataattggggcctttactaaagggcaaggaaatgaagaggaaggcgtacaataaaactagatttcaaagcaaaatcatcatgttatacctgtgtcacagaggcaagaggaatcaagggtaattttaagacttctagtgtgggttttagggcttccagttatccatgcaagcaaaaatgaccaatacagtgtgcacaaaaataagtgtgctgaatttagagattatgaggt

SEQ ID NO: 179181 - DNA, 601 bp, Human
gatattggcagggagaaaaagtgagttcatgtgagagataattggggcctttactaaagggcaaggaaatgaagaggaaggcgtacaataaaactagatttcaaagcaaaatcatcatgttatacctgtgtcacagaggcaagaggaatcaagggtaattttaagacttctagtgtgggttttagggcttccagttatccatgcaagcaaaaatgaccaatacagtgtgcacaaaaataagtgtgctgaatttagagattatgaggttgcaagagacattatggtagatgatactgcttawgttctctgtgttaaattcagattacaaggacttgaagcataaaggtacacatatattttttaaaggatgaaagctaaaaaaaagttaaagacctgctacctaaggtttttggacttagctattaaatggggaacatcacaaagttgagttaatgactataggatgttgttgaggctttaggacaatattaaggaatattaccttgaacataaggagaatatattttatattgagcctggaggaaatgagttaaaaaatgagtaaggacgtgcataaattcataggtagatttggtcaata

SEQ ID NO: 179182 - DNA, 601 bp, Human
atttagagattatgaggttgcaagagacattatggtagatgatactgcttatgttctctgtgttaaattcagattacaaggacttgaagcataaaggtacacatatattttttaaaggatgaaagctaaaaaaaagttaaagacctgctacctaaggtttttggacttagctattaaatggggaacatcacaaagttgagttaatgactataggatgttgttgaggctttaggacaatattaaggaatattaccttgaacataaggagaatatattttatattgagcctggaggaaatgakttaaaaaatgagtaaggacgtgcataaattcataggtagatttggtcaataatttgagagaaatcctgctacatgacttcagtattctattttcagttagctggttgccctcaccgaacaaacattgatataatcttgatagtcataaaaaaattttacttgcttatattaaactttttattggatcttcaggtaagctctccaacctgcctaaaacctttctgttcatgaacctctgagtaaatgctttcctcatatcatcataccttgtttcactctgacatactatgtgaaatcttt

SEQ ID NO: 179183 - DNA, 601 bp, Human
gtaaagagtgattcactaactgcaggttcaaattggggtaatggaggcaggaacaattgagattggataaaaaacacctagtaatgcaattgtaaagcaattgtttctttagtcgatctttgaacagtaaaatcaacagtgggtgataatggccagagatgtccgtacaaatgagtgtctgaatgtatagtgcactttgttatctcagtaacccccaggcagtaatttttgtattcctacctatttcttgcaatttcttgaagtcatgaaaatgaggcaaaaaaacttttctatttataawaaatgaaaagttaagtcaaaattttctctttaagttgtatgcagtgttttagaatgtaaagcatatacaagtatgaaagagtgaatttgtctcttgtagttgaatcatgtaattgaatcaaccatgcagacagctattttaagtcagtttaatgagtgcaaattatgagggaatttgtagtttgtaacaatgttatataatatacaatatataatttacccaaatcaataaatatttacccaaaccagagtattttatagttttattaattgtgtatccctaatgattttattaaatttc

SEQ ID NO: 179184 - DNA, 601 bp, Human
aatcaaccatgcagacagctattttaagtcagtttaatgagtgcaaattatgagggaatttgtagtttgtaacaatgttatataatatacaatatataatttacccaaatcaataaatatttacccaaaccagagtattttatagttttattaattgtgtatccctaatgattttattaaatttcaagaataggcaatctgggaacacaagaaaagaaaagtatatctttttctccttatctcttatataactgttacttcagaaatttttagtttatataaactagagaaatgatagatacagatagatagatagatagatagatagatagatagatagatagatgatagatagagataatctgcacagatctaggcacatctttctttgcttttctcttccatataagtaattgatttgagtatttaatacagttcttttccttaagtctctatttctcttttactcagattttctaagtacacttagtgtcataatatcatatttgaaaagctgtagaaaagcatgtattgatttttcaacattgtacttttaatccctgattaaatatatggcagaattttctcattgtttgaattg

SEQ ID NO: 179185 - DNA, 601 bp, Human
tgcagacagctattttaagtcagtttaatgagtgcaaattatgagggaatttgtagtttgtaacaatgttatataatatacaatatataatttacccaaatcaataaatatttacccaaaccagagtattttatagttttattaattgtgtatccctaatgattttattaaatttcaagaataggcaatctgggaacacaagaaaagaaaagtatatctttttctccttatctcttatataactgttacttcagaaatttttagtttatataaactagagaaatgatagatacagatagayagatagatagatagatagatagatagatagatagatgatagatagagataatctgcacagatctaggcacatctttctttgcttttctcttccatataagtaattgatttgagtatttaatacagttcttttccttaagtctctatttctcttttactcagattttctaagtacacttagtgtcataatatcatatttgaaaagctgtagaaaagcatgtattgatttttcaacattgtacttttaatccctgattaaatatatggcagaattttctcattgtttgaattggattcccat

SEQ ID NO: 179186 - DNA, 601 bp, Human
tcctcaaaatgtgctgcactagaggataacctatgaaaccatatcagtattttattcacactgaaattcacaaatgaccagtatcaccactatctcttgccttttttttttttgcttgtgtcatatcctatggcttttaataaaagcataggtattcggataatgtctgtttctgatggtgaaagtaataaagcagagagaattcaactcacgttacataaaaatgaaataaccactcagttataagtaaaactagttccatgtgctacatcatcttcttaagcatagtttgtttttcttkttatgcagatatgcttaatttctctaggatgagatttcacaatctccgtctaaaatgtgattctctctctctctctctttctctccttccctccttccctccctccctccctttttagccagactgattgctatttgtcttataaaacttagtccaagcatcatttctagaactagaaagcaattctaaatatgacctgccttattgcaagatttcttcccatgagatctcatagtactaggtccactctgtaaacttttcaacgcttaagtatttgaaaggactcagcaggcttcacaa

SEQ ID NO: 179187 - DNA, 601 bp, Human
gctacatcatcttcttaagcatagtttgtttttctttttatgcagatatgcttaatttctctaggatgagatttcacaatctccgtctaaaatgtgattctctctctctctctctttctctccttccctccttccctccctccctccctttttagccagactgattgctatttgtcttataaaacttagtccaagcatcatttctagaactagaaagcaattctaaatatgacctgccttattgcaagatttcttcccatgagatctcatagtactaggtccactctgtaaacttttcaamgcttaagtatttgaaaggactcagcaggcttcacaaagtacagttgttccttggtatctatgggaagttggttgtaggaccaacatccatgggataccaaatccatgaatgctcaagtccctttatgtaaaaaggcatagtatttgcatatagcctacacacattcttcccatatactttaaatcagctctagattagttataatacttaatacattgtagatgctgtgtaaatagtgttacactgtattttaaaaaaattgttctatttttattgctgtattggtattttaaatgattt

SEQ ID NO: 179188 - DNA, 601 bp, Human
ctctccttccctccttccctccctccctccctttttagccagactgattgctatttgtcttataaaacttagtccaagcatcatttctagaactagaaagcaattctaaatatgacctgccttattgcaagatttcttcccatgagatctcatagtactaggtccactctgtaaacttttcaacgcttaagtatttgaaaggactcagcaggcttcacaaagtacagttgttccttggtatctatgggaagttggttgtaggaccaacatccatgggataccaaatccatgaatgctcaartccctttatgtaaaaaggcatagtatttgcatatagcctacacacattcttcccatatactttaaatcagctctagattagttataatacttaatacattgtagatgctgtgtaaatagtgttacactgtattttaaaaaaattgttctatttttattgctgtattggtattttaaatgatttttaaaaatatttttgatccctgcttcgttgagtcctcagatgcagaacctggggatacagagggctgactgtatagtcatgtaaatgccctattcttaaaaaaaaggatatggtgca

SEQ ID NO: 179189 - DNA, 601 bp, Human
caaatccatgaatgctcaagtccctttatgtaaaaaggcatagtatttgcatatagcctacacacattcttcccatatactttaaatcagctctagattagttataatacttaatacattgtagatgctgtgtaaatagtgttacactgtattttaaaaaaattgttctatttttattgctgtattggtattttaaatgatttttaaaaatatttttgatccctgcttcgttgagtcctcagatgcagaacctggggatacagagggctgactgtatagtcatgtaaatgccctattcttaaaaaaaaggatatggtgcagccagaaaaagaatgcaaagtgtcagacctgtgagagacaatcccctgcacaagatttccaggggccctatttgcaaacaagatgatgtgtatgttcaccttgaaccacgaagatccaaatgaggcacctcaaagagactctcaggtagagttctttaagtaatttagccaagcttcacaaattgtttaggttgagtccaaactatcagtgcagaaaatgactttggaggttgccaggaaactttctggtccatcataaattccaatgtccttaccttggc

SEQ ID NO: 179190 - DNA, 601 bp, Human
gtgcagccagaaaaagaatgcaaagtgtcagacctgtgagagacaatcccctgcacaagatttccaggggccctatttgcaaacaagatgatgtgtatgttcaccttgaaccacgaagatccaaatgaggcacctcaaagagactctcaggtagagttctttaagtaatttagccaagcttcacaaattgtttaggttgagtccaaactatcagtgcagaaaatgactttggaggttgccaggaaactttctggtccatcataaattccaatgtccttaccttggccaaaagtcatccacrtatctttgaagatattgatagaacttttccagctgatccagaaaccaactccattccaacagcctctttaacaatgtacctttcacactgacttgaaattatccatttatgtgtgacattatctcacagataacaccattaatccttcaaggaaaaaggtgatattttataaccttaaggtatactgtagagatttgcatacaggaggcggtctataacttctggaaagatttctttaatttttaattattttgtgcaaatatgtgattatctcaatcacaaagatattttatttcataa

SEQ ID NO: 179191 - DNA, 601 bp, Human
ctatttgcaaacaagatgatgtgtatgttcaccttgaaccacgaagatccaaatgaggcacctcaaagagactctcaggtagagttctttaagtaatttagccaagcttcacaaattgtttaggttgagtccaaactatcagtgcagaaaatgactttggaggttgccaggaaactttctggtccatcataaattccaatgtccttaccttggccaaaagtcatccacgtatctttgaagatattgatagaacttttccagctgatccagaaaccaactccattccaacagcctctttaayaatgtacctttcacactgacttgaaattatccatttatgtgtgacattatctcacagataacaccattaatccttcaaggaaaaaggtgatattttataaccttaaggtatactgtagagatttgcatacaggaggcggtctataacttctggaaagatttctttaatttttaattattttgtgcaaatatgtgattatctcaatcacaaagatattttatttcataattattactacttagtttttttctctatccctttagattatataatccaagttattttactattatcttgaga

SEQ ID NO: 179192 - DNA, 601 bp, Human
ctataacttctggaaagatttctttaatttttaattattttgtgcaaatatgtgattatctcaatcacaaagatattttatttcataattattactacttagtttttttctctatccctttagattatataatccaagttattttactattatcttgagaacatttcctcctcaaactatcaatctagtaatgcacttccagatatcttgcatgtattttaagtttgtcatgtacaataatctgcatagatttaaaatttcaacatatatttattaatgtatgtgtatatatagatatgcrtttgtgtgtcggaaaaataatcaccacggatagtgaatatatcttcttttgagaagtatttgttcgagtcctttgcccatttctttaaatgggattgtttgttttttgcttgatgatctgtttaagtcccttagaggctctagatattagatctttgttggaggcatactttgtgaatatttcctcccattctgtaaattgtctgtttattctattgattgcttcttttgctgtgcaagagctctttagtttatttgggtccaacttgtcagtttttattttgttgcagttgtttctggg

SEQ ID NO: 179193 - DNA, 601 bp, Human
ggaaagatttctttaatttttaattattttgtgcaaatatgtgattatctcaatcacaaagatattttatttcataattattactacttagtttttttctctatccctttagattatataatccaagttattttactattatcttgagaacatttcctcctcaaactatcaatctagtaatgcacttccagatatcttgcatgtattttaagtttgtcatgtacaataatctgcatagatttaaaatttcaacatatatttattaatgtatgtgtatatatagatatgcgtttgtgtgtckgaaaaataatcaccacggatagtgaatatatcttcttttgagaagtatttgttcgagtcctttgcccatttctttaaatgggattgtttgttttttgcttgatgatctgtttaagtcccttagaggctctagatattagatctttgttggaggcatactttgtgaatatttcctcccattctgtaaattgtctgtttattctattgattgcttcttttgctgtgcaagagctctttagtttatttgggtccaacttgtcagtttttattttgttgcagttgtttctggggactcagccaa

SEQ ID NO: 179194 - DNA, 601 bp, Human
aagtttgtcatgtacaataatctgcatagatttaaaatttcaacatatatttattaatgtatgtgtatatatagatatgcgtttgtgtgtcggaaaaataatcaccacggatagtgaatatatcttcttttgagaagtatttgttcgagtcctttgcccatttctttaaatgggattgtttgttttttgcttgatgatctgtttaagtcccttagaggctctagatattagatctttgttggaggcatactttgtgaatatttcctcccattctgtaaattgtctgtttattctattgatygcttcttttgctgtgcaagagctctttagtttatttgggtccaacttgtcagtttttattttgttgcagttgtttctggggactcagccaaaaattatttgcgaaattggatgtctagaagggtatttcttaggttttcttttaggatttttatagtttggggtctttttttttttctattttttttttttaattatactttaagttttagggtacatgtgcacattgtgcaggttagttacatatgtatacatgtgccatgctggtgcgctgcacccactaactcgtcatctagcatta

SEQ ID NO: 179195 - DNA, 601 bp, Human
caccacggatagtgaatatatcttcttttgagaagtatttgttcgagtcctttgcccatttctttaaatgggattgtttgttttttgcttgatgatctgtttaagtcccttagaggctctagatattagatctttgttggaggcatactttgtgaatatttcctcccattctgtaaattgtctgtttattctattgattgcttcttttgctgtgcaagagctctttagtttatttgggtccaacttgtcagtttttattttgttgcagttgtttctggggactcagccaaaaattatttgygaaattggatgtctagaagggtatttcttaggttttcttttaggatttttatagtttggggtctttttttttttctattttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaat

SEQ ID NO: 179196 - DNA, 601 bp, Human
gaactcatcattttttatggctgcatagtattccatggtgtaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttgrtgggactgtaaactagttcaaccattgtggaagtcagtgtggcgattcctcagggatctagaactagaaataccatttgacccagccatcccattagtgggtatatacccaaaggactataaatcatgctgctataaagacacatgcacacgtatgtttattgcggcattattcacaatagcaaagacttggaaccaacccaaatgtccaacaatgatagactggattaagtttggggtcttttatttgaatctttaaaccatcttgagttaatttttgtatctgatgaaaggtaagggt

SEQ ID NO: 179197 - DNA, 601 bp, Human
cattttttatggctgcatagtattccatggtgtaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactrtaaactagttcaaccattgtggaagtcagtgtggcgattcctcagggatctagaactagaaataccatttgacccagccatcccattagtgggtatatacccaaaggactataaatcatgctgctataaagacacatgcacacgtatgtttattgcggcattattcacaatagcaaagacttggaaccaacccaaatgtccaacaatgatagactggattaagtttggggtcttttatttgaatctttaaaccatcttgagttaatttttgtatctgatgaaaggtaagggtccagtttc

SEQ ID NO: 179198 - DNA, 601 bp, Human
gaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattrgtgggtatatacccaaaggactataaatcatgctgctataaagacacatgcacacgtatgtttattgcggcattattcacaatagcaaagacttggaaccaacccaaatgtccaacaatgatagactggattaagtttggggtcttttatttgaatctttaaaccatcttgagttaatttttgtatctgatgaaaggtaagggtccagtttcaatcttctgcgtatgaccagccagttatcccagcactatttaatgaatagggagttctttccccaatgcttgtttttttggccttgtt

SEQ ID NO: 179199 - DNA, 601 bp, Human
gttggtgggactgtaaactagttcaaccattgtggaagtcagtgtggcgattcctcagggatctagaactagaaataccatttgacccagccatcccattagtgggtatatacccaaaggactataaatcatgctgctataaagacacatgcacacgtatgtttattgcggcattattcacaatagcaaagacttggaaccaacccaaatgtccaacaatgatagactggattaagtttggggtcttttatttgaatctttaaaccatcttgagttaatttttgtatctgatgaaaggtargggtccagtttcaatcttctgcgtatgaccagccagttatcccagcactatttaatgaatagggagttctttccccaatgcttgtttttttggccttgttgaagctgaaatgattctaagtgtatgatttttctattctgttccattgaactatgtgtctgttttttctgtaccagtaccacattgttttggttatgcttatcatcactaatcatcagatagatgcaaatcaaaaccacaatgagatactgtctcacaccactcagaaggctattattaaaaagtcaaaaaagcaacaga

SEQ ID NO: 179200 - DNA, 601 bp, Human
taaaaagtcaaaaaagcaacagatgttgaaggctgcagagaaaagggaatgtatataactattgttggaaatgtaagtcagttcagccactgtggaaagcagtttggagacttcttaagaaacttaaaacagatatactattcaacccagcaatctctttactgggtatatacccaaaggaatatagatcattataccaaaaaggcatagagacgtgtatgttcatcactgcactattcacaatagtacacacatggaatcaacctagattcccatcaatattggattggataaataaaaygtattacatatgcaacatgaaatactatgcagccataaaaagaatgaagtcatgtcctttgcagtgacatggatgaagctggagaccataatcgtaagtgatctagtgcaagaactgaaaaccaataccacatattttcacttgcaagtaagggctaatccttgaacacacatgaacctccgcatgggaaccatagacactgcagaatactagagcagggagggagaaagggaggcgtgggctgaagaacgaccttttgggtactatgcaaactgcttgggtgtaatgtgcccatgtgac

SEQ ID NO: 179201 - DNA, 601 bp, Human
aaaaagtcaaaaaagcaacagatgttgaaggctgcagagaaaagggaatgtatataactattgttggaaatgtaagtcagttcagccactgtggaaagcagtttggagacttcttaagaaacttaaaacagatatactattcaacccagcaatctctttactgggtatatacccaaaggaatatagatcattataccaaaaaggcatagagacgtgtatgttcatcactgcactattcacaatagtacacacatggaatcaacctagattcccatcaatattggattggataaataaaatrtattacatatgcaacatgaaatactatgcagccataaaaagaatgaagtcatgtcctttgcagtgacatggatgaagctggagaccataatcgtaagtgatctagtgcaagaactgaaaaccaataccacatattttcacttgcaagtaagggctaatccttgaacacacatgaacctccgcatgggaaccatagacactgcagaatactagagcagggagggagaaagggaggcgtgggctgaagaacgaccttttgggtactatgcaaactgcttgggtgtaatgtgcccatgtgaca

SEQ ID NO: 179202 - DNA, 601 bp, Human
ggataaataaaatgtattacatatgcaacatgaaatactatgcagccataaaaagaatgaagtcatgtcctttgcagtgacatggatgaagctggagaccataatcgtaagtgatctagtgcaagaactgaaaaccaataccacatattttcacttgcaagtaagggctaatccttgaacacacatgaacctccgcatgggaaccatagacactgcagaatactagagcagggagggagaaagggaggcgtgggctgaagaacgaccttttgggtactatgcaaactgcttgggtgtaatrtgcccatgtgacaaacctgcacatgtacccctgtatctaaagttgaaaaaaaaaagaatataaagctttaaaaagaagtcagaagtggaaatgaaaacatagtaaactttatgaaatgctaaaaaagatagtgactatagtgaatgtatctattatccataataatttctaaaaatgtcatataaccgtgcaatatgtattttcttttaagtggattcttacccttttttcactcaaaaattattttgagattcatttatgttatcccatgccataatatgtcatctctttttattgcta

SEQ ID NO: 179203 - DNA, 601 bp, Human
ccataatcgtaagtgatctagtgcaagaactgaaaaccaataccacatattttcacttgcaagtaagggctaatccttgaacacacatgaacctccgcatgggaaccatagacactgcagaatactagagcagggagggagaaagggaggcgtgggctgaagaacgaccttttgggtactatgcaaactgcttgggtgtaatgtgcccatgtgacaaacctgcacatgtacccctgtatctaaagttgaaaaaaaaaagaatataaagctttaaaaagaagtcagaagtggaaatgaaaayatagtaaactttatgaaatgctaaaaaagatagtgactatagtgaatgtatctattatccataataatttctaaaaatgtcatataaccgtgcaatatgtattttcttttaagtggattcttacccttttttcactcaaaaattattttgagattcatttatgttatcccatgccataatatgtcatctctttttattgctattagtattcaattttaagaagatttcacaattttcttacccattcaccaaaatggcttttgggaagtttcagatttttggcttacaaatatatacata

SEQ ID NO: 179204 - DNA, 601 bp, Human
ttattttgagattcatttatgttatcccatgccataatatgtcatctctttttattgctattagtattcaattttaagaagatttcacaattttcttacccattcaccaaaatggcttttgggaagtttcagatttttggcttacaaatatatacatatttatatattatcttggtatgggcatgtttttatatctcttggttaaatacctgtgagaggtaatggctggatcacatgccaagtgtatgtttatcacttttaaaaaacacttcctaaaagttttccaaagtgattgtactattttaccttccccaaagcagtgtacgggtatttcgggtatttcacttgctccacatcctcaccaaaacttgacatactcaggactttatgtttagacatcctaatacatgtttagtggtttcatgttgtggatttaatttgcatttccctaatgcctcaggatgttaaacatcttctcatatacaactcagcattgatcatttttggtaaaatgtcttttcaaatatttaacgtagttttaactgggctgttttcttattattgagtttactgaattctttatgtatttggaatgtaatcc

SEQ ID NO: 179205 - DNA, 601 bp, Human
acatgccaagtgtatgtttatcacttttaaaaaacacttcctaaaagttttccaaagtgattgtactattttaccttccccaaagcagtgtacgggtatttcgggtatttcacttgctccacatcctcaccaaaacttgacatactcaggactttatgtttagacatcctaatacatgtttagtggtttcatgttgtggatttaatttgcatttccctaatgcctcaggatgttaaacatcttctcatatacaactcagcattgatcatttttggtaaaatgtcttttcaaatatttaacstagttttaactgggctgttttcttattattgagtttactgaattctttatgtatttggaatgtaatccacttaccaaatatgtgatttagaaatatttttatccaatctgtggcttgtttttctattttttaaccactgcctttcagtgggtgaaagatgttgatgaggtttaatttttcttttttcatatgaatcatgcttattgtttcaaatctacgaatgtattgtgtaaaacaaatatgttaatactaagattttccccaattcttctttctagaagttttgtagttgttgttttt

SEQ ID NO: 179206 - DNA, 601 bp, Human
tgatttagaaatatttttatccaatctgtggcttgtttttctattttttaaccactgcctttcagtgggtgaaagatgttgatgaggtttaatttttcttttttcatatgaatcatgcttattgtttcaaatctacgaatgtattgtgtaaaacaaatatgttaatactaagattttccccaattcttctttctagaagttttgtagttgttgtttttaagtttagatttatgataattttttcttaatttcttacgatattgtgacaaattggcgaaaggttttgtttggtttgttgtattttttttttggcatgtgaatgtccgatttttcatcattggctaaaaacaccgtactttagcaacagaattgccttttcattatttaaaatatattttaatatatgtgttttagggaatctattctgttccattgatctatttatttgtccctttacaccaacaaaagccgttatgataagttggaataatgtattataagtcctccaactttgttcatcttttcaaagtagttttaatatagaataaaatactctaggttctgttcatttccatattaattttagaatcaagctttcaat

SEQ ID NO: 179207 - DNA, 601 bp, Human
ccaatctgtggcttgtttttctattttttaaccactgcctttcagtgggtgaaagatgttgatgaggtttaatttttcttttttcatatgaatcatgcttattgtttcaaatctacgaatgtattgtgtaaaacaaatatgttaatactaagattttccccaattcttctttctagaagttttgtagttgttgtttttaagtttagatttatgataattttttcttaatttcttacgatattgtgacaaattggcgaaaggttttgtttggtttgttgtattttttttttggcatgtgaaygtccgatttttcatcattggctaaaaacaccgtactttagcaacagaattgccttttcattatttaaaatatattttaatatatgtgttttagggaatctattctgttccattgatctatttatttgtccctttacaccaacaaaagccgttatgataagttggaataatgtattataagtcctccaactttgttcatcttttcaaagtagttttaatatagaataaaatactctaggttctgttcatttccatattaattttagaatcaagctttcaatttttacatatacatatgcac

SEQ ID NO: 179208 - DNA, 601 bp, Human
ttaaaaatacaaaaattagctgagcttggtggtgggcacctgtaatcccagatactcgggaggctgaggcatgagaattgcttgaacacgggaggtggaggttgcggtgagccaagattataccgatgcactccagcctgggcgatagagcaagactttgtctcaaataataataataataacaataaaaataataatatcactatgaataaagacacttttacttattcctttccaatctgtatgtttttccactttcgcttattatactgggtagacagactctcctggtgaatagaartgatacaattgaacacacttggccttgtccataaactttgggagacagggcattcattcttttaatatcaaatgtttttagatataggcttttcagggatttttaaaatcaggttgagaaactgaccttttcctaaattactgagtttttttatcaataatgaatttttctctgtctgcctcctttctgatcagactggatagagttttattagttatattgatctctcaaagaaacagcttttggtttttcttgattttatatttgtttttccttttcctattttatcagcgtgccatc

SEQ ID NO: 179209 - DNA, 601 bp, Human
caagattataccgatgcactccagcctgggcgatagagcaagactttgtctcaaataataataataataacaataaaaataataatatcactatgaataaagacacttttacttattcctttccaatctgtatgtttttccactttcgcttattatactgggtagacagactctcctggtgaatagaaatgatacaattgaacacacttggccttgtccataaactttgggagacagggcattcattcttttaatatcaaatgtttttagatataggcttttcagggatttttaaaatcargttgagaaactgaccttttcctaaattactgagtttttttatcaataatgaatttttctctgtctgcctcctttctgatcagactggatagagttttattagttatattgatctctcaaagaaacagcttttggtttttcttgattttatatttgtttttccttttcctattttatcagcgtgccatctgatctttattattttatctttctggcttatttggaggtatattgatctttttttctgttttctcaaggttaaacctgataatactgatttgaaatctttcttgtcttctaa

SEQ ID NO: 179210 - DNA, 601 bp, Human
catgtatttagtgctgaataattccctatatgtctacttcaactttatttcacaagttttgatatattgcatatacattgccattcattttaaaatgttttgtaatttcccttttgacttattatttatcccatgaaacatttagaagtatgcacttagcttccaattatatgtggattttccagagatagttctgtcatgaatttctaatttgattctaatgaggtcagagaacatactatgatttagatcaagtatattcctgatgcacttaaaaagaatgtgtattttgttgatgttrgttaatgttttggtaattatcagttaggttacagtcaattggtaatgttaatcaagtcttctgtatctttttaacctacttgctctattagttattgagaaatagctgtttaaactctaataaaattaagaatttgtctatttcttttcacagttctgtcagtttattctccatgtattttaagctctcttattatatagataaaagtttagaatcatgatgtcctcctgatgaattgacgtctttctcattaggaattgattctgtttattccggataatatttgctccaatacctgag

SEQ ID NO: 179211 - DNA, 601 bp, Human
agcaattcccttctgaaccttgaatgggaatctctaaagctctgtagcagcagtatgttaaatccaacccatacttggaatatttctgacacatctctcttctgctgcatctcttctgccttcctcttcttcttacagctgaagagaaatctctgcttttaatatcagatgaaaaggggatcatgtgattggtctcgcctagataattcatgataatttcctcacttaatgtctgtaactttaaaaaacacctgcaaagtctttttaaatcatgatatttaatgtgttcatagatggccargtgttagggcattgacatctttgggaagagacattattcttcccccaacaactgtgctatgcatacacacatacacacacacacacacgtacacacactatgtatagattcaaacttccaattagctcatattcataaattattacattaaaattaatgttaaagttattagaaaaaagtattttatatttatctacatagttactattcacaaggcttttcaatactttgtgtaaatccagatttctatctggtataagttcccagatgcttgaatgacttcctttagcatttcttgta

SEQ ID NO: 179212 - DNA, 601 bp, Human
atccaacccatacttggaatatttctgacacatctctcttctgctgcatctcttctgccttcctcttcttcttacagctgaagagaaatctctgcttttaatatcagatgaaaaggggatcatgtgattggtctcgcctagataattcatgataatttcctcacttaatgtctgtaactttaaaaaacacctgcaaagtctttttaaatcatgatatttaatgtgttcatagatggccaggtgttagggcattgacatctttgggaagagacattattcttcccccaacaactgtgctatrcatacacacatacacacacacacacacgtacacacactatgtatagattcaaacttccaattagctcatattcataaattattacattaaaattaatgttaaagttattagaaaaaagtattttatatttatctacatagttactattcacaaggcttttcaatactttgtgtaaatccagatttctatctggtataagttcccagatgcttgaatgacttcctttagcatttcttgtagtgcacttctgttgttaatgattcagttcacctactgtatgtctgagaaaaccttttttta

SEQ ID NO: 179213 - DNA, 601 bp, Human
ctgctgcatctcttctgccttcctcttcttcttacagctgaagagaaatctctgcttttaatatcagatgaaaaggggatcatgtgattggtctcgcctagataattcatgataatttcctcacttaatgtctgtaactttaaaaaacacctgcaaagtctttttaaatcatgatatttaatgtgttcatagatggccaggtgttagggcattgacatctttgggaagagacattattcttcccccaacaactgtgctatgcatacacacatacacacacacacacacgtacacacactawgtatagattcaaacttccaattagctcatattcataaattattacattaaaattaatgttaaagttattagaaaaaagtattttatatttatctacatagttactattcacaaggcttttcaatactttgtgtaaatccagatttctatctggtataagttcccagatgcttgaatgacttcctttagcatttcttgtagtgcacttctgttgttaatgattcagttcacctactgtatgtctgagaaaacctttttttacttttatatataaaatacatttttgctggatatagaattc

SEQ ID NO: 179214 - DNA, 601 bp, Human
gcctttaagctttgttaagtttgatcagaatagctctggactttctttgccccacccatgagataagaatgtttctgaattctttatctgtcatgcattaggagttgattttattctggctcatgagagtatgaacttttgtttgctctgtttgagcttggaagttgttccttccaattcttttgcacagttctttccctggcctcagttactttcctctcatgggtgcactcatcagtactcatctggaggctccagggttaatcactgcaaatctcagggaatcctcactttgccattmagtcctgtctggcactgtggcctgtgaactatagccaatatccacttctctgtactattagcactacctccgcactcagagagacctctaaactccaactgagatcctcattcctgtgctgcaatctagaaactctctctagacagtaagctgagacacagcaggactcacctcatttccccccatattttaggaatttctattgaatgatttcattgactgattcacaaagtcttgaaaaacagttgttttatacaatgtttctgacatttttagctgtttcaggtgctaagataaatt

SEQ ID NO: 179215 - DNA, 601 bp, Human
cttttgcacagttctttccctggcctcagttactttcctctcatgggtgcactcatcagtactcatctggaggctccagggttaatcactgcaaatctcagggaatcctcactttgccattaagtcctgtctggcactgtggcctgtgaactatagccaatatccacttctctgtactattagcactacctccgcactcagagagacctctaaactccaactgagatcctcattcctgtgctgcaatctagaaactctctctagacagtaagctgagacacagcaggactcacctcatttccccccatattttaggaatttctattgaatgatttcattgactgattcacaaagtcttgaaaaacagttgttttatacaatgtttctgacatttttagctgtttcaggtgctaagataaattgggtatacgtttctgcatcttggttggaaactgatatttttagatatatgtttcagtacagcaaacaaaatttcagtgttctaaggttttgaaaaatgtatcctagtaataggaagacctgacttctaaatattttaatctctcattctgtactaaactcaaagcaatttcagatagct

SEQ ID NO: 179216 - DNA, 601 bp, Human
attgactgattcacaaagtcttgaaaaacagttgttttatacaatgtttctgacatttttagctgtttcaggtgctaagataaattgggtatacgtttctgcatcttggttggaaactgatatttttagatatatgtttcagtacagcaaacaaaatttcagtgttctaaggttttgaaaaatgtatcctagtaataggaagacctgacttctaaatattttaatctctcattctgtactaaactcaaagcaatttcagatagctatgtctgaatttcactttcttcctactttatccatrcatcttgttctataataaattatttttattaattaattactttaattctccctcaggtttgccagtgaatttttaacagcagggtatcacaatggttttttcaaaatatgtagcactatgaactgaaacatggcccacattttaggtgtctcaggaacatgaagaatatacaaccagtgcaatctgaagttcataacaaagacaaacagtaggaagtgaaggaatcttcagaatactttgggtagatcagagcaatgatttaaagaaagagaagagtctgatgaactgaagtagaaacag

SEQ ID NO: 179217 - DNA, 601 bp, Human
gatttaaagaaagagaagagtctgatgaactgaagtagaaacaggcattccttgaagaagagtcatgattccctcaaataggcagaattaaaaatgtttttctgctttagatcaggaactgacttctccaggaggatgggctgtttcagagtatcagcttattgaatctgattgtaactgttacaaaacacaatgacaattttttaactatcaatatgatttttaatatttgcatgtttgttttcaagttaacatacagtaaaattcacttttttaattgtagaattctatgaattttaaygtatacatagattcatcttggctctactacagtcagtatacagaattgttctttcaccccaaatcactctctaatccctttatagtcacttcctctttcaacctctaaactctgacaaccaccacttctttccctgccattataattttatcttttccagagtgccatattagcacagctttagaacagctttatagtaagtcccacagttgagacctacttctcaggaaatatttctttcaaaatatcacagtgcactggcaatgcacttaaaatcaggtagtatcatttatccaactg

SEQ ID NO: 179218 - DNA, 601 bp, Human
acaatttgtctacacaaacatatcaagctgggattttaatcacaattgtaaaggagctttatattagttttaaaagaattttactttttttctatcttgagtctacaaatatattaacatggtatatatttttgttgttgttgttggcctagtgtttgggacatcaatatgcttttgttaaatgaatgaacgaataacaaaaatgactttatgcaaaagatggttacaaatatggggcatttttttttttttttttttttttgagacggagtctcactctgtggcccaggctggagtgcartgatgcaatctccgctcactgcaagctctgcctgctgggttcacgccattctccttcctcagcctcctgagtcgctgggactacaggcacccgccaccacgcccagctaatttttttgtatttttagtggagacggggtttcaccgtgttagccaggagggtctcgatctcctgacctcgtgatccacccacctcagcctcccaaagttctgggattacaggcgtgatccactgcgcccggcccatggtatgacttcttatttactaaagtcttcttttgtttccgttatcagatccttg

SEQ ID NO: 179219 - DNA, 601 bp, Human
gcatatgagatttgatttggggtgtttttctttaatcctttgactgtgttacactcaacaattagttctagcaatatttttgaaggttccttgagtttatattgtatataacaatctatttctaatttctgcaaattggaaaagatttctttcttttctgactgtacgtcttaaatctatttttacttgagtgctgtgttgttctttcagcatgaggtttaataggagagctgacagcgaatttccttacttgctcccagtcttacagataaagtattcacttctttacctatatatcaaygttaggtctaaattttttggcaggtgtttttcatcatgataaggaagtcttcctttattcatagtttgctcagagattttatcatgagtggatgaggaattttgttgtttttttgttttagcatcaactcatgttattacatgattttttctttaaactgttaagttggataaattaattgagtattgattaatatgcttaatatagttaatataatttaataatactcaatatacttaatataatttaattatcttcaattaatttatccacctaacagtttaaagaacaattatttaa

SEQ ID NO: 179220 - DNA, 601 bp, Human
atgggttgaaaaacattccctcctcttatattttctgaaagagattttacagaaatgctattgtttcttctttaaatattttttaaattcaacagataaactgagtctgaacatttcctttcaggagacttttgatttatctttaaataaatgtattttttatatttctttaataattataggattgtttttgttatatattttattttgagtaactttgtggtttctgattttcaaggatgtggttcgtattttcaacattgataagtttgtgtgcataatgttatctggattttttaawatatttttattagctgtacaatctgtgctgatatctcttctttcaatcctgatattggcaatatgtgtcatctctccttttttcatcctgagtcttgctggaggtttaatcattgtattcttattccaaataaacttcatttaaaaaaattttctctattttgttctgttttcaatttcattattatccttttattttatattgttttcttcctcctgcttaatttttgcttattttgctcttgtttatctagtttattaggctatcccaaagagtaattgtgaatttgttccaattttt

SEQ ID NO: 179221 - DNA, 601 bp, Human
tttaaaaaaattttctctattttgttctgttttcaatttcattattatccttttattttatattgttttcttcctcctgcttaatttttgcttattttgctcttgtttatctagtttattaggctatcccaaagagtaattgtgaatttgttccaattttttttgtctgtcagattttgctttatatattttgaagcactttttcaagttgaatgcacatgtaggattgtcatattttcctgcttaattggcctttttatcattatgtaatattctattttacatcttttaatttcatttkttctgaaacctacattttctgatattgacatagccactgcagctttcttttgattagcatttgaatggcatattttttctattgtttttattttattctagttttatcattacatttcaagtgatttcttatagacagcatatagttaggttatattttattcattatgccagtttctgtgtttttattcatgaaattaagccatttacacttcattcagatttacacatcattcatttaaaatgttattttagtctgttctttttgtctttcattcttctattttccctgctctaaatt

SEQ ID NO: 179222 - DNA, 601 bp, Human
ttatattgttttcttcctcctgcttaatttttgcttattttgctcttgtttatctagtttattaggctatcccaaagagtaattgtgaatttgttccaattttttttgtctgtcagattttgctttatatattttgaagcactttttcaagttgaatgcacatgtaggattgtcatattttcctgcttaattggcctttttatcattatgtaatattctattttacatcttttaatttcatttgttctgaaacctacattttctgatattgacatagccactgcagctttcttttgattarcatttgaatggcatattttttctattgtttttattttattctagttttatcattacatttcaagtgatttcttatagacagcatatagttaggttatattttattcattatgccagtttctgtgtttttattcatgaaattaagccatttacacttcattcagatttacacatcattcatttaaaatgttattttagtctgttctttttgtctttcattcttctattttccctgctctaaattcttgattattgaacattatttagaattgtattttactgtatctataatgtttctggc

SEQ ID NO: 179223 - DNA, 601 bp, Human
tattttcctgcttaattggcctttttatcattatgtaatattctattttacatcttttaatttcatttgttctgaaacctacattttctgatattgacatagccactgcagctttcttttgattagcatttgaatggcatattttttctattgtttttattttattctagttttatcattacatttcaagtgatttcttatagacagcatatagttaggttatattttattcattatgccagtttctgtgtttttattcatgaaattaagccatttacacttcattcagatttacacatcrttcatttaaaatgttattttagtctgttctttttgtctttcattcttctattttccctgctctaaattcttgattattgaacattatttagaattgtattttactgtatctataatgtttctggctatatctgttttcacaatttgtggggagggggtgttgccgttgtaattcaatgtccctatttaagttagaatcaatgtttaccatttcaatttgaatgtagaaagtatagcatcatataggtccctacatcttctctttatatcatacttttcctgtgtattatacctccattca

SEQ ID NO: 179224 - DNA, 601 bp, Human
tgttttgggtttttcttgggttcgatgctgttggcctatttgagaagttttcagatgtcagatgcattgatacatatacatatgtacacgtatatacctacattattttgtcctggtcgtctttctcttttccttcttggatttcatgacattttggtagtgtctaagaagttcctgaagtctattcactttttcctttaatatgtttccttttgttttcaaaattggataacttccatttgtaattctttatgtttgataactctctctgtcaatcaattcagcacatccatgaattttgttgttgttgttgttgttaacataagtagaatgctaatatttatttggggttttaaaaatatatcgtatgtctttggagagactttctatatttccatttatttcacctaattatttagaacatgttttaaacagttgctttaaaatagcttttagataatccaacatgtgtcagcatgccattggcatttccaatgacatgattttcctagttcttaacaggtaaaacaatagattatctttaggactttgaatattacataatcagactctggatcttatttcagtattacggaaaatg

SEQ ID NO: 179225 - DNA, 601 bp, Human
tgttgttgttgttaacataagtagaatgctaatatttatttggggttttaaaaatatatcgtatgtctttggagagactttctatatttccatttatttcacctaattatttagaacatgttttaaacagttgctttaaaatagcttttagataatccaacatgtgtcagcatgccattggcatttccaatgacatgattttcctagttcttaacaggtaaaacaatagattatctttaggactttgaatattacataatcagactctggatcttatttcagtattacggaaaatgctcaytttttttgttgtttttgtaggcaatcagtttgtttagatcagacaacaaattctgaccatctttcttggttttatattcagacgccattttcattacctttcagtgactgtcagatctgtcctgcatgtgtaccaatggccattccaggacccatatggaggtttaccttttagttaaattcacaaaatcttagcaatgtttagaatccgattcaataagcacaggtcaggacagagctcaagatttcctaaagaacttgctgtggatgccttcctaagaccttcctactctatgatctc

SEQ ID NO: 179226 - DNA, 601 bp, Human
catgattttcctagttcttaacaggtaaaacaatagattatctttaggactttgaatattacataatcagactctggatcttatttcagtattacggaaaatgctcactttttttgttgtttttgtaggcaatcagtttgtttagatcagacaacaaattctgaccatctttcttggttttatattcagacgccattttcattacctttcagtgactgtcagatctgtcctgcatgtgtaccaatggccattccaggacccatatggaggtttaccttttagttaaattcacaaaatcttrgcaatgtttagaatccgattcaataagcacaggtcaggacagagctcaagatttcctaaagaacttgctgtggatgccttcctaagaccttcctactctatgatctctgacatactttcctatttcttaggtcaccactttttagtcccctggccagaaagctgcgatcttatttatctctctctgccccaactatggccttattctggttcaactgatgagattaatgaggaggataaaagcaatgggagattttgctcttaggactacagtttatctgattgaagaagaatgtcatct

SEQ ID NO: 179227 - DNA, 601 bp, Human
agtattacggaaaatgctcactttttttgttgtttttgtaggcaatcagtttgtttagatcagacaacaaattctgaccatctttcttggttttatattcagacgccattttcattacctttcagtgactgtcagatctgtcctgcatgtgtaccaatggccattccaggacccatatggaggtttaccttttagttaaattcacaaaatcttagcaatgtttagaatccgattcaataagcacaggtcaggacagagctcaagatttcctaaagaacttgctgtggatgccttcctaagrccttcctactctatgatctctgacatactttcctatttcttaggtcaccactttttagtcccctggccagaaagctgcgatcttatttatctctctctgccccaactatggccttattctggttcaactgatgagattaatgaggaggataaaagcaatgggagattttgctcttaggactacagtttatctgattgaagaagaatgtcatctctcagagaattgggtgtttgcagctttcctctgttgacattgtcactgccagatttccttcctgcttcctgagtctgaactggaagg

SEQ ID NO: 179228 - DNA, 601 bp, Human
ttatattcagacgccattttcattacctttcagtgactgtcagatctgtcctgcatgtgtaccaatggccattccaggacccatatggaggtttaccttttagttaaattcacaaaatcttagcaatgtttagaatccgattcaataagcacaggtcaggacagagctcaagatttcctaaagaacttgctgtggatgccttcctaagaccttcctactctatgatctctgacatactttcctatttcttaggtcaccactttttagtcccctggccagaaagctgcgatcttatttatcwctctctgccccaactatggccttattctggttcaactgatgagattaatgaggaggataaaagcaatgggagattttgctcttaggactacagtttatctgattgaagaagaatgtcatctctcagagaattgggtgtttgcagctttcctctgttgacattgtcactgccagatttccttcctgcttcctgagtctgaactggaaggcttctctttcttggacatttctagagcagtgttgatgacaacttctgggttttgtgatgccttcaatccaggccatggaattctgaaaagaa

SEQ ID NO: 179229 - DNA, 601 bp, Human
tccgactgttttaaattaccctgcataagcctattttaaacatttacaatcagcctgctttggaaactgcaaaactgcacctaacttctgctagccatacacaaactccaagggcaatacaagacaccaagcccacagctgcccttctaccttctgagagagtctgagagacgctgctgtactgctgagtgacatcacgtggacacattatccccctctcagattcttcactcttccaggagtttccttccccttctcccactctctgagtggtgactggacatggtgtctttaaacagcytcctgctatcaggaacttccaatgtcaagcaacttgtatgagtagcacctaagtcaaactcattatgtgttaatgcctcctatcatcataagtttttccttgatgagtcctgaaatcttcacacttacttatactttccaacagattattttctgcagaattttgcaaaaatgagtactaccaactctaaaaatacgttctgaaatcttacacctttagattacttttaaatatacatcatgacttttattatacattatttttcttataagttttatatgattcttaaaattaattaat

SEQ ID NO: 179230 - DNA, 601 bp, Human
tgcataagcctattttaaacatttacaatcagcctgctttggaaactgcaaaactgcacctaacttctgctagccatacacaaactccaagggcaatacaagacaccaagcccacagctgcccttctaccttctgagagagtctgagagacgctgctgtactgctgagtgacatcacgtggacacattatccccctctcagattcttcactcttccaggagtttccttccccttctcccactctctgagtggtgactggacatggtgtctttaaacagcctcctgctatcaggaacttccmatgtcaagcaacttgtatgagtagcacctaagtcaaactcattatgtgttaatgcctcctatcatcataagtttttccttgatgagtcctgaaatcttcacacttacttatactttccaacagattattttctgcagaattttgcaaaaatgagtactaccaactctaaaaatacgttctgaaatcttacacctttagattacttttaaatatacatcatgacttttattatacattatttttcttataagttttatatgattcttaaaattaattaattattttttttgagatagagtc

SEQ ID NO: 179231 - DNA, 601 bp, Human
ctgagagagtctgagagacgctgctgtactgctgagtgacatcacgtggacacattatccccctctcagattcttcactcttccaggagtttccttccccttctcccactctctgagtggtgactggacatggtgtctttaaacagcctcctgctatcaggaacttccaatgtcaagcaacttgtatgagtagcacctaagtcaaactcattatgtgttaatgcctcctatcatcataagtttttccttgatgagtcctgaaatcttcacacttacttatactttccaacagattattttytgcagaattttgcaaaaatgagtactaccaactctaaaaatacgttctgaaatcttacacctttagattacttttaaatatacatcatgacttttattatacattatttttcttataagttttatatgattcttaaaattaattaattattttttttgagatagagtcttgctctgttgaccaggcagtgacacaatcacaggtcactacaacctcgacttcccaggctcaagctatcctcccatctcagcctcttaaatagctgggagtacaggcacacaccatcctatcctgctaatt

SEQ ID NO: 179232 - DNA, 601 bp, Human
ttttctttaatgtataggttgacataaaacaggtgaattctcagatcagtttctgcaatcagtctttcctgatatattttagaacctgagaaagacttttggataaggagataattgaactttttctccattagcacaatccaatagctgactttctcaaaagaaaatccatctgcacacagatacatggttggaaaaggggtgacccaagagagtttctgaaaggtgtttgggacctcaaggtttcttgaaatactctgagggcctttcatgtagaatattgttaactgtagaatatacrctgaaagaatataaaaattgccatgtttagtggtgaaattaactttcaagaattaaaggaacattcaagcttgaatttatttatttatatatttattgacttgagagatcttccatattaactatggccttttatttaattattatctcatactgtggaaagacttcttttgacaaaaataaagtcacagtaatgttttacctcctttcaactgtaacttttcacttagattttatttaataagccctttagattggtggtaaaatgtcgtagacatctagtgatggattagctttagta

SEQ ID NO: 179233 - DNA, 601 bp, Human
agtaagagtgaagacttatttatatattgacataaatatgtctcttacatgtaatgtcagcttgataaaagaaacagaatacagaagcaggcgtatttttaaaagaaagaaaaaatattgaaatattaatcaatatttgcataaataaatgcatatgctggccaggctctgtgagacactcctgaggcaggagtactgcttgagcccaagagttggagactgcagtgagaggctatgatcacaccactgcatgtcagcttgggtgacagagggagaccctgtatcaaaaagaaaaacaaamaaaaaaaaatgcaagcacagtcagctcttcatattcgtggtcttacactggtgttttcaaccaatttggatggaaaatattttttaaaatagcaataaaattaacaatacaaaaatgaaaacatacaaataaagaacaatatagtataacaactatctgagggagttcctagaatcaatcctctgtgaatacgagttaacaactgtaattaataaaaataactaaccaaggccagtgcagtggctcacgcctgtaatcccagcactttgggaggccaacacaggtggatcacgaggtcaa

SEQ ID NO: 179234 - DNA, 601 bp, Human
gtactgcttgagcccaagagttggagactgcagtgagaggctatgatcacaccactgcatgtcagcttgggtgacagagggagaccctgtatcaaaaagaaaaacaaacaaaaaaaaatgcaagcacagtcagctcttcatattcgtggtcttacactggtgttttcaaccaatttggatggaaaatattttttaaaatagcaataaaattaacaatacaaaaatgaaaacatacaaataaagaacaatatagtataacaactatctgagggagttcctagaatcaatcctctgtgaataygagttaacaactgtaattaataaaaataactaaccaaggccagtgcagtggctcacgcctgtaatcccagcactttgggaggccaacacaggtggatcacgaggtcaagagtttgagaccagcctggccaacatggtgaaaccccatctctactaaaaacacaaaaattagctgggcatgatggcgcgtgcctgtagtcccagctgctcaggaggctgaggcaggagaatcacttgaacccaggaggcagaggttgcagtgagctgagatcataccactgcactccagcctgtccgacag

SEQ ID NO: 179235 - DNA, 601 bp, Human
caattaaccagaagcaatattaatgaaaattgagagctgttagatcatattacagcatttgcagcagtagggaagagcagaacatacaaatttttaaaaaaagaaaacagatggatttcattgatgcctgatatgactatatgaaagtaacaatttcatgatcaaaatcatgatgaatgcattctccataattgagatgtcttattgtatattgagaggctatataatattaaaatactagtcattctttacctcatataagcaattaagtatttgaaaaattgtcaaagatgtaaattgwaaaatgagggtacttcatttgttatcaaaggaaggttcttaaaattaactgaaaacatgtaatttcttactatccatgagtaataaaaatagctttgcaaatgtggcttcccaggtgtttcacttttctaacttcatataataaaatgcaatggaaagagatgtgttaatgaaattatgggaagacccaaagaaataaactaatttgcttttcatgcagactgagaatataaatagagaatgttagaactatcaaataactttggtgttaatctgctctatctattctcttggccaggaa

SEQ ID NO: 179236 - DNA, 601 bp, Human
aggctatataatattaaaatactagtcattctttacctcatataagcaattaagtatttgaaaaattgtcaaagatgtaaattgaaaaatgagggtacttcatttgttatcaaaggaaggttcttaaaattaactgaaaacatgtaatttcttactatccatgagtaataaaaatagctttgcaaatgtggcttcccaggtgtttcacttttctaacttcatataataaaatgcaatggaaagagatgtgttaatgaaattatgggaagacccaaagaaataaactaatttgcttttcatrcagactgagaatataaatagagaatgttagaactatcaaataactttggtgttaatctgctctatctattctcttggccaggaaccaagatcacttctgtgactttctaatggacacacagccctaaatgtaaaatcatttttctgatgattagtgataacgagcattttttcatatgtttgctggttgcttttatgttttcttttgagaaatgtctgttcatgtcattttcccatttttaattggattattatttttttcttgttgacttgtttaagttccttatagattccggatatt

SEQ ID NO: 179237 - DNA, 601 bp, Human
taaattgtaacagacacatgcactcgtacgattatcacagtgctattcacaatagcaaggacatggagtcaaccttggtacccatcaacggtggactggataaataaaatgcagtacctatacaccatggactactacactgcaaaaaacaaacaaacaaacatgaaatcatgtcctttgctgcaacatggatgcaactgtaggccgtaatcctaagcaaattcacacaggaacaggaacagaaaaccaaatactgcatatcctcacattgaatgcccatggacataaagatggcagcaayagacactgaggactactagagaagggaaagagggaggtgggatggtctgaaaaactacctattgggtatcatgctaactatctggatgacagaaccacctttaccccaaacctcagaatcatgcaatatacccagttaacaaacctgtccatatgtcccctgaatccaaaaaaagaaaacgtaaaaagaagtaaagagaaaaaaagggttgtgagtcttaagattagcagtcctctgctaggtgaaaaatctatgtgtgcatttatttgttgctttatatttaaaacagaattggaattg

SEQ ID NO: 179238 - DNA, 601 bp, Human
tatacccagttaacaaacctgtccatatgtcccctgaatccaaaaaaagaaaacgtaaaaagaagtaaagagaaaaaaagggttgtgagtcttaagattagcagtcctctgctaggtgaaaaatctatgtgtgcatttatttgttgctttatatttaaaacagaattggaattgaattacaaatgagtatacttcctggctgtgcttgagtggagttagttttccttggctcaaataaatttgaaggaattagtgggtgccggttaatctgaaccaaacaagctgtgacatgaataggcawttcatggttggtatcatctttatcttctgagaaatatctgagggttgaggaaagacttggaagactcagaaaacatatgaaattgctgcatgccattattcataaaaggtaaatcagtctgtcaaattagtggtatatctgttgcctaagcaaccggtcaggagaattataacttgaaggtagtccaccacgtccatgttagtgggagttaatagaactacttcactatacatccccatgttccttccagctaaagaaaaaatagaaactttccaggaaacgttgactactcaacacata

SEQ ID NO: 179239 - DNA, 601 bp, Human
gattagcagtcctctgctaggtgaaaaatctatgtgtgcatttatttgttgctttatatttaaaacagaattggaattgaattacaaatgagtatacttcctggctgtgcttgagtggagttagttttccttggctcaaataaatttgaaggaattagtgggtgccggttaatctgaaccaaacaagctgtgacatgaataggcatttcatggttggtatcatctttatcttctgagaaatatctgagggttgaggaaagacttggaagactcagaaaacatatgaaattgctgcatgccrttattcataaaaggtaaatcagtctgtcaaattagtggtatatctgttgcctaagcaaccggtcaggagaattataacttgaaggtagtccaccacgtccatgttagtgggagttaatagaactacttcactatacatccccatgttccttccagctaaagaaaaaatagaaactttccaggaaacgttgactactcaacacatacagaatacaaatccatgaaagaattcatttcattgtaattctctaaggaatgaaaaacctttactgtaataaaaagagtaatactgctcttgcaa

SEQ ID NO: 179240 - DNA, 601 bp, Human
agctgtgacatgaataggcatttcatggttggtatcatctttatcttctgagaaatatctgagggttgaggaaagacttggaagactcagaaaacatatgaaattgctgcatgccattattcataaaaggtaaatcagtctgtcaaattagtggtatatctgttgcctaagcaaccggtcaggagaattataacttgaaggtagtccaccacgtccatgttagtgggagttaatagaactacttcactatacatccccatgttccttccagctaaagaaaaaatagaaactttccaggaarcgttgactactcaacacatacagaatacaaatccatgaaagaattcatttcattgtaattctctaaggaatgaaaaacctttactgtaataaaaagagtaatactgctcttgcaactaatgtataaataatgataggtaaaacatgcattttgtttaaaatgttatttcccataattacagaggaagaaaaacagggtacagatagtcaaatgacaatgtacttaaaattcagagttaatatctgaaaaagttctatcttttgtaatactagtaattattatgttactttagagacaaca

SEQ ID NO: 179241 - DNA, 601 bp, Human
tttatgatattcagcttaaaattataaaagtgtgcattgagtcacaatttatcctctactttgaaatttagcttctattgtggatgctagtgatttgtttattgcaaacagtgcatttcagtaacagtttcaacatgttccaaatgtgcagcatatacagtttttgcaatgtaattagttagaaattggagatgcttaattttaaaattgaacagttcatgaaaatctatttccattctctgtatggcttatgcagtttctcttcataaaatgttctatagctgcttgaagaaattaagtktagttaatcagaaagaacattatgttttgacacctaatttgaaagccctgttttgaagcagtgatatattgcttatggcattacacagaccaatgagaagccaaataggaaatccacttatgctcaaagtagatctccatattgatgtaagttagggtggtattgtctttttctgagacataattcctaaaagtatatatgtttgctaaaatatgtactttattgtttaacagatttagtagtgaaatagctttacaatgaattgatataattattgcacattagaacacagatcattga

SEQ ID NO: 179242 - DNA, 601 bp, Human
agatcagtgataaagttattttactgtgaaaccaaatcagtttcattaatataaatggagatgtgaaggatgacatttgaaagcttaaaatgtagcaaaaattctctaaatgatggtagtgaaggtgttttcgtctctatttattctgtattcatctctccttcagtgccgccagcaatctcaatgcctcagaaatcttttaatgccacagcagagagaggagaagaaatgacattttcctgcagggcctcaggctctccagaacccgccatctcctggttcaggtaggttatgcaccccsctccctctggcttgtgtccattatcaggcttatggaacagtattgggatcttaatcattttggtaaaaagcaaaccattgcattttagtttcattaaaaaaaaatcctggtgctatctttggggcttacggtggttagattaaactgctaaagagatcaacagtgtgaccccgctctaatattctgagtcaaaggctgtacccattatacttattctgtctgtaaaagcagacttttggaaaaatgggaccaggagcacctgtgacttattcaaacattttattatcattacaatttatc

SEQ ID NO: 179243 - DNA, 601 bp, Human
tattctagtgttattgacaccactgtcatatgtatacaatatcatattttattagaatataattgtgtatatttgtattatacacaaaatgttgtattatagaaaaaactgatttatagcattaaaattcaatgaatttaatgtgtaatttttaaaaattacctcatcaaatgaggaaattctgtattctaaatctataatttgatagtttatttttttagaattttaaaatactatttgatttttattaagttcaagaatatttttaaaatattccattcttttagattgtgtctcaaastacgaaattggagacgatgaactttaaaactggaccatcttgtagatatgcattagtaatgcaggttgctacagaagcattagctacaagtatttacagaatcatttcataaaccatatagtgaaaaattatttaaaaagattagtaaaatatacatcagaagtgcaaaagtgtccctactaagtattaggttgttgttttaaaagttctttgaaggacaacaattgaaatcccaaactaacttttattcttttttgcttgagcatgtactgatattaccttcaactttcaaccatttgt

SEQ ID NO: 179244 - DNA, 601 bp, Human
attttattagaatataattgtgtatatttgtattatacacaaaatgttgtattatagaaaaaactgatttatagcattaaaattcaatgaatttaatgtgtaatttttaaaaattacctcatcaaatgaggaaattctgtattctaaatctataatttgatagtttatttttttagaattttaaaatactatttgatttttattaagttcaagaatatttttaaaatattccattcttttagattgtgtctcaaactacgaaattggagacgatgaactttaaaactggaccatcttgtaratatgcattagtaatgcaggttgctacagaagcattagctacaagtatttacagaatcatttcataaaccatatagtgaaaaattatttaaaaagattagtaaaatatacatcagaagtgcaaaagtgtccctactaagtattaggttgttgttttaaaagttctttgaaggacaacaattgaaatcccaaactaacttttattcttttttgcttgagcatgtactgatattaccttcaactttcaaccatttgtttctactgcttatcattttaatataggatgtaacaataaatgaga

SEQ ID NO: 179245 - DNA, 601 bp, Human
aaactgatttatagcattaaaattcaatgaatttaatgtgtaatttttaaaaattacctcatcaaatgaggaaattctgtattctaaatctataatttgatagtttatttttttagaattttaaaatactatttgatttttattaagttcaagaatatttttaaaatattccattcttttagattgtgtctcaaactacgaaattggagacgatgaactttaaaactggaccatcttgtagatatgcattagtaatgcaggttgctacagaagcattagctacaagtatttacagaatcayttcataaaccatatagtgaaaaattatttaaaaagattagtaaaatatacatcagaagtgcaaaagtgtccctactaagtattaggttgttgttttaaaagttctttgaaggacaacaattgaaatcccaaactaacttttattcttttttgcttgagcatgtactgatattaccttcaactttcaaccatttgtttctactgcttatcattttaatataggatgtaacaataaatgagatgtttcttcaaatattgtgtgtttagatgttcttttcagacactaattttcttgggacaa

SEQ ID NO: 179246 - DNA, 601 bp, Human
aattcatcctgacgtgcacttcatcatttctgaggcagaaatacatggaaactgggtgtgtgattgttacagtgttagaacatatgtccttgaaaaatatgacaccaggtttaagaagaaaatctcctttacttctgagattacttgatcacaatgattccaagtttgatagtaatttcagattccccacctatttatgttgatgttaagttatgcagattcctcattagtcccatctttaggataatattagaacacttaccatcaagtcagaatagtaattgtgagactagatgctttyagtttggtcagtttagttgtctgcagcacaaccctttcaaataacagcttaccaattacttctcaccagaataccaagatcctccagcagctgggaagtgttagctggcttggtttttcagagagacttcttttctgcagagatttttttttcttaaagttttacattccttcaaaactgttttcttatatttaattagaaatagtattatatagactagtataaatcagattcaaagaataatataatgagtaatttaaatttatattttttcttctccatatcttcatatggtattag

SEQ ID NO: 179247 - DNA, 601 bp, Human
atgttgatgttaagttatgcagattcctcattagtcccatctttaggataatattagaacacttaccatcaagtcagaatagtaattgtgagactagatgcttttagtttggtcagtttagttgtctgcagcacaaccctttcaaataacagcttaccaattacttctcaccagaataccaagatcctccagcagctgggaagtgttagctggcttggtttttcagagagacttcttttctgcagagatttttttttcttaaagttttacattccttcaaaactgttttcttatatttaaytagaaatagtattatatagactagtataaatcagattcaaagaataatataatgagtaatttaaatttatattttttcttctccatatcttcatatggtattagtttcatcctttggatagaatgaaataacaatttattgaaaacctaaataattgttctagtctctggatataaaatatatactgggaggatgagaatgtgtggttgtaacattaacgaaggtaaaatttgtgttagagggaaattctgaccttgtatctgtacatatagacatgtcatgtttgtggaaaagaaaaaa

SEQ ID NO: 179248 - DNA, 601 bp, Human
ttgtactagtcagcttgggctgccaaaaccaaataccacccactgggtagttcacacaataggaattccttgatctcttgacttcgtgaaccgcctgcctttgcctcccaaagtgctgggattacaggcgcaagcaaccaccaacatggtgaaatcccatgcatggtggtacgcgcctgtagtcccagctactctggaggctgaagcaggagaatagcttgaacccgggagacggaggttgcagtgagctgagttcgcgccactacactccagccaggcaacagagcaagactctgtctcaaaaaaaaaaaaaaaaaaaaaaaatttcttttcccatatttctggacactagatgtttaagatcaagataccagcagggtggccttccctctgtgtacaaactcatggagagagagagttctggttatcttcctcctctttcagaaacagcaatccttttttgtttgtttttaataatttcaacttttatcttagattcgcaggtttgttacatgagtataatttatagaaaccgaaagtagataattggttgcctgggactggatatgagaacagagattaactgtgaatgggtataaga

SEQ ID NO: 179249 - DNA, 601 bp, Human
gaggttgcagtgagctgagttcgcgccactacactccagccaggcaacagagcaagactctgtctcaaaaaaaaaaaaaaaaaaaaaaaatttcttttcccatatttctggacactagatgtttaagatcaagataccagcagggtggccttccctctgtgtacaaactcatggagagagagagttctggttatcttcctcctctttcagaaacagcaatccttttttgtttgtttttaataatttcaacttttatcttagattcgcaggtttgttacatgagtataatttatagaaaccraaagtagataattggttgcctgggactggatatgagaacagagattaactgtgaatgggtataagagatctcttgtgatggttgaaccactcaatacagttactaaaacttcagccaaccaaacaaaaaccaccagttttatgggattaaggcctcactcttatactctcatttaaacttagtgtcctccatggaggccttattttcaaatacagtcattctgggggttaggacaccaacatgtgaatttgagggttgggaaaacccaatttagttcataacatcaataagataattaaa

SEQ ID NO: 179250 - DNA, 601 bp, Human
aaaattgactggggacatattttgtagaacatacccctgtggttaggcaatgcatgactgcattatcctttttatgcatggctggaatcaatgtgtcaataatttgttaagaattttttatattcatggttatgagaaatattgttccatcattttcttgttcttgactttttaggggtcagggcattactagtgtcagagaatgagtagtgaagtatttcttcctcttctgttttccaatataacttttatgtaatgtttattatttcttaaatttctggaaaaattgccagtgaaaccrtccatgtcataatttttcttaagttcacatttaagtacaaattcaataatatttttcatagaaatagggctattcaggtaattttctttagtgagcttagatgattaacgcaattccaggaatttgtccatttcttttaaatggtatttactggcattgtcattcatagtatccctttgttatacttcaatttgcatgttttctgtagtattctcccctctctcatcttgataacctcataactggttatttgttctactgtcttttttatcctgattattctagatgtaggtctatgca

SEQ ID NO: 179251 - DNA, 601 bp, Human
cctgctaattttgatatgtcatatttccaatttggaggggtttaaattttgtttttaattctcatgttatttttaatactattcatttagaagtatgctgatttgtttctaagtatttgggtatatttcataaatattactgctgttgatttttaactaaattctatacttatcaggaaatagactttttaatggtttcaatttatttaactttattgagtcttaaattaaagtatgtgtattccactattattgtatggagaaatccctaatattaaatagatcaactcccttgatagtrttgtggaagtcttctatatttttttgtaacgattcttctccaactttatttttaaatgtgtctatttttatattcagttctctctgttttgcttcatattttttgaagctctagtattatatgtttaaacatttattcacgtagatcagtactatgaaaattattatttaagggctttaaggatggaaaaaaatgataccatatagaactttgtttcagtctttttctgtttttcattttaccatgtcttcaagtgaactaagttacgtcactatgtcttcaagtttactaatattttct

SEQ ID NO: 179252 - DNA, 601 bp, Human
attactgctgttgatttttaactaaattctatacttatcaggaaatagactttttaatggtttcaatttatttaactttattgagtcttaaattaaagtatgtgtattccactattattgtatggagaaatccctaatattaaatagatcaactcccttgatagtattgtggaagtcttctatatttttttgtaacgattcttctccaactttatttttaaatgtgtctatttttatattcagttctctctgttttgcttcatattttttgaagctctagtattatatgtttaaacatttwttcacgtagatcagtactatgaaaattattatttaagggctttaaggatggaaaaaaatgataccatatagaactttgtttcagtctttttctgtttttcattttaccatgtcttcaagtgaactaagttacgtcactatgtcttcaagtttactaatattttctactgtaatatctaatgtttttaatcccatcagagtatttctcataattttatttttcttctctgagagtttcaaggagatgttttgtatgtcctccatgcctctcttaccattctcatgttttacttccttgaaa

SEQ ID NO: 179253 - DNA, 601 bp, Human
ctcctgaccttgtgatctgccctgcccgcctcggcctcccaaagtgataggattacaggtgtgagccaccatgcccagccaggaatttttaattgggttccagacattcagaattttgtgttttggggtgctgaatatttttgtattattttactttgttttatagatgcagttaagtgacttggaaaaagttttatttgagggagagcttccatttaggctcttttaggtggatccaaaccaccttcagtctagggttaatctggttccattactgatgcaatattattctaaggacatracttaagtcctgtgttttaggatatctttttactctggatggttgaattgcagattattcctggtgctgtgtgagcttctggaattattgtactttatattttctaatggttctttccctcatctgagaaggccttactggtgtacactcattgatcaatactcagttaaagatttgttgggaaccctctgcagatatctatagctctgttgtctgtgcagctgtcttctctcacattatctaacctgcaccttctgtcgctttgacctcccccaactgcacactctgtcttccaaccca

SEQ ID NO: 179254 - DNA, 601 bp, Human
tattattttttttttcggacacagtctcactctgtggccgaggctggagtgtagtggtgtgatctcagctccctgcaacctgcctcagcatcccttcggagtagctgggattacaggcgcctgctaccacgccaggctagtctttgtatttttagtagagatggagtttcactatgttggccaggctggtctcaaactcctaacctcaagtgatccaccggcctctgcctcccaaggtgctgggattacaggcatgacccaccacacccgacccatttgttattattttatgaatcctaaytttgcaatcttccactcctcttaagaaatgttgtgtacttcatggtacatttagagatgtcatgagaaactggaacaataaattctattgagtatagacatataaagattatgttcatatatgtgttagtggtttctggaaagtagaaccagaattcactggaaggaactgcttagtgtatcagagaaatgtttgattttattttagaaaatagttttaataatatttatagagatttttttaaatttacaattgtatggacaagcaaatgtctccataccaatggacaaattccagaac

SEQ ID NO: 179255 - DNA, 601 bp, Human
acctcaagtgatccaccggcctctgcctcccaaggtgctgggattacaggcatgacccaccacacccgacccatttgttattattttatgaatcctaattttgcaatcttccactcctcttaagaaatgttgtgtacttcatggtacatttagagatgtcatgagaaactggaacaataaattctattgagtatagacatataaagattatgttcatatatgtgttagtggtttctggaaagtagaaccagaattcactggaaggaactgcttagtgtatcagagaaatgtttgattttaytttagaaaatagttttaataatatttatagagatttttttaaatttacaattgtatggacaagcaaatgtctccataccaatggacaaattccagaactttccattagtggttttaaaatcaattcagtcatgcaaaatactattataagaaaaatacaggaggggatgcaaagaagagaaaagaggaaaaaagatgaataaaatgaaaggagaatacacaatataaaacgatttcacaaataccgagggaaatcatagaaatagttcagattttaatatattgaaaatatttcttactg

SEQ ID NO: 179256 - DNA, 601 bp, Human; identical to SEQ ID NO: 30493

SEQ ID NO: 179257 - DNA, 601 bp, Human; identical to SEQ ID NO: 30494

SEQ ID NO: 179258 - DNA, 601 bp, Human; identical to SEQ ID NO: 30495

SEQ ID NO: 179259 - DNA, 601 bp, Human; identical to SEQ ID NO: 30496

SEQ ID NO: 179260 - DNA, 601 bp, Human; identical to SEQ ID NO: 30497

SEQ ID NO: 179261 - DNA, 601 bp, Human
cctcacataatacagcttaaaaatgaaactacatatgagaatggtcaagtcacactcgtatgtgatgcggaaggggagcctattccagaaatcacttggaaaagagctgtggatggcttcacgttcactgaaggcgataaggtaaccacatctcaatatgtaatggtttccattaccatgcaatttcagtattttcaatatcattaaatcacaaattagtctccaatttacctagtaacttgtaggatcaaataaatggtttgatttttaaaaaggtaactaacacaatgtcggctttacmactttcgtgggaggggaaatgtcaatatgaaatatttaaagatgttctttattaagtcacaaacgtttaggctattggtattactagcattgcttaactagacttttgttatacgttgaatctataaagtatgttattgcagttttaacccctgctgtgtgagtatctggcctttgcaaattcactgaccatgagaaaagtgctaggacaaataatattgccattttaaaaacaggaataaagatttacaaaccagtacatttaactttaaacctcagcaatttcagtttcttaaagaaa

SEQ ID NO: 179262 - DNA, 601 bp, Human
tatcttctcaaagatagtttttactctgcatttaatgaatgttaccttatatattatgcagagaatgaaagataaattatactcagttatttcattaataaatgtcatcaagtaacaagaaagctgttatattttattcttggatctatgcctcaggccaccccaaactacacacagatacttattctgtagtaactgtgaaaaataatcttaaagcttttgtttcctaaggagtatattaaaaaacacatcttgttttaagaaaatctgacttggtttctttgcaataaacaattatagraactcaaatatgcttttctgcacaagtttaatccagtcaataaagaaattaagtctattgtatttctattatatttctccaaatatattttaagatccttgacttatttttctatactccagtacacttcttttcccctaatatttctagtttcctgaatagcataattcacaaatcaaatggttgagctgaactttgaagtaaagtttatctagttttgaatctcagctctgccatttatgatgcctcagcatgataaaattgagttcaaagagtccaaataacattaccagtgttatt

SEQ ID NO: 179263 - DNA, 601 bp, Human
atcctagagaaatagaaatatgtgaactttcagacagagaattcaaaatagttgtgttgaggaaactaaaaaaaatcaagatgacacagagttggaattcataattctatcagatcaatctaacagagattgaaataattacaacgaatcaagtagaaattctggagctgaaaaatgcagcaggcatattgaagaatgcattagagtcctttaatagcagaattgttcaagcagaagaaatagtcagcttgaagacaagctacttgaaaatacacagaggagaaaaaaagaataaaaaaartgaagcatgcctacaggatctagaaaatagcctcaaaatgaaaatcaagagttattgtccttaaaaaggagatagagaaagagataggtgtagaaagtttatgcaaagggataataggaacttcctaaacctagagaaaaatatcaatatctaaccgcaggaaagttatagaacacaaaagatttccctaaagaaggtactacatcaagggctttggtaagcctctgagacttgctgcgtccaaataatagcacaggcatttaatacctcaaggcatttaatactgaaactcccaatggt

SEQ ID NO: 179264 - DNA, 601 bp, Human
aaactctccaatcaaaagacatagactggctgaatggataacaaaaataagacccattgatctgttgcctacaagaaacatacttcatctataaagactcacatagactgaaaacaatattccatgccaactgaaaccaaaaaaaaaaaaaaaacaggagtcactatacttatgtcaaacaaaatagatttcaaaacaaaaactataagaaaagacaaagaaggttaatatataatgacaaatgtgtaaattcagcaggaggatataataatttaaatatatatgcacccaacatgggagmacccagatacataatggaaatattattagagctgaagagagaggtcccatcacaataatagctggagacttcaacacccaactttcagcattggacaaatgtttcagacagaaaatcaacaaagaaacttcagatgtaatctgcactatagatctaatggatctggtagatgtttatagaacatttcatccaatggctgcagaatacacattcttttcctcagcacatggatcattttcaaggatatattatatactatgttacaaagcaaatgttaaaatatttaaaaaattaatatca

SEQ ID NO: 179265 - DNA, 601 bp, Human
aaaatagaggagaaaagaatatttccaagctcattctacaaggccagtattactttgatacctaaaacaaagacacataaaaaaagtatctgatgaatattgatgcaaaaatcctcagcaaaatactagcagccaaattcaacaacacattagacaaatcattcatcatgacaaagtgggatttttccttgggtcaacatataaaatcaatgtgatacatcatatcaacaaagtgaagcataaaaaccatatgatcatttcatttgatgctgaaagagcatttgataaaatttaacatccrttcatgataaaaacactcaaaaaactgggaatagaaggaatatatgtcaaaataatagaagccatatacgacagacctacagctagtgtcatactgaatgtggaaaaattgaaagtgtttcctctaagatctggaacactacaaggatgcctactgtcaccactgttattcaacttaataatcaaagtaccaactagaacaataagacaagagaaagatctaagtgacatccaaattggaaaggaagaagtcaaattatccttgtttttagatgacatggtcatatatttggaaaaacct

SEQ ID NO: 179266 - DNA, 601 bp, Human
aatcaatgtgatacatcatatcaacaaagtgaagcataaaaaccatatgatcatttcatttgatgctgaaagagcatttgataaaatttaacatccgttcatgataaaaacactcaaaaaactgggaatagaaggaatatatgtcaaaataatagaagccatatacgacagacctacagctagtgtcatactgaatgtggaaaaattgaaagtgtttcctctaagatctggaacactacaaggatgcctactgtcaccactgttattcaacttaataatcaaagtaccaactagaacaatwagacaagagaaagatctaagtgacatccaaattggaaaggaagaagtcaaattatccttgtttttagatgacatggtcatatatttggaaaaacctagagacttcacaagaaaactgtcagaactgataaattcagtaaagttgcaagatacaaaatcaacatacaaaaatcagtagcatttttatatgtcagcagtgaagaatgtgaaaaataaaaaatatcccatttgcaatagctgcacatgaaattaaatacctaggaattaaccaaagaagtgaaatgtatctataatgaaaact

SEQ ID NO: 179267 - DNA, 601 bp, Human
tttgataaaatttaacatccgttcatgataaaaacactcaaaaaactgggaatagaaggaatatatgtcaaaataatagaagccatatacgacagacctacagctagtgtcatactgaatgtggaaaaattgaaagtgtttcctctaagatctggaacactacaaggatgcctactgtcaccactgttattcaacttaataatcaaagtaccaactagaacaataagacaagagaaagatctaagtgacatccaaattggaaaggaagaagtcaaattatccttgtttttagatgacatgrtcatatatttggaaaaacctagagacttcacaagaaaactgtcagaactgataaattcagtaaagttgcaagatacaaaatcaacatacaaaaatcagtagcatttttatatgtcagcagtgaagaatgtgaaaaataaaaaatatcccatttgcaatagctgcacatgaaattaaatacctaggaattaaccaaagaagtgaaatgtatctataatgaaaactttgtaaacactgatgaaaaaaatttaagaggacatcaagaaatggaaaaatattgtatgttcatggattggaagaa

SEQ ID NO: 179268 - DNA, 601 bp, Human
gtgaagaatgtgaaaaataaaaaatatcccatttgcaatagctgcacatgaaattaaatacctaggaattaaccaaagaagtgaaatgtatctataatgaaaactttgtaaacactgatgaaaaaaatttaagaggacatcaagaaatggaaaaatattgtatgttcatggattggaagaatcaatatttttaaaatgtccatattacccaaagcaatctacagattcagtgcaatccctatcaaaatttaatgacatttttcacagaaatagaaaaaactttctaaaatttatatggaacacaaaagactcataatagccaaagcaaaaagaataaaactggacaaatcacattacctgacttcaaatgatactatagagctatattaaccaaaacatcatgatactggtgtacacacagatacatagacccatggaacagaatagagaacccaaaaacaaatccacacaactacagtgaacccattttcaacaaaagtgccaagaatatacaatagggaaaagacagtctgttcaataaatggcgctggggaaactggatatccatatgcagaagaacaaaacttgacccctgtctctc

SEQ ID NO: 179269 - DNA, 601 bp, Human
acacacagatacatagacccatggaacagaatagagaacccaaaaacaaatccacacaactacagtgaacccattttcaacaaaagtgccaagaatatacaatagggaaaagacagtctgttcaataaatggcgctggggaaactggatatccatatgcagaagaacaaaacttgacccctgtctctcaccaaacacaaaaatccaatcaaaatggattaaagacttaaatctaagacctcaacttatgaatctactacaagaaatcattggggaaaatctccaggacattgacctgggcrtaattttttgagcaataccccacaagcacaggcaaccaaagcaaacgtagacaagtgggatcacatcaaattaaaagccttctgcacatcaaaggttacaatcaacaaagtgatgagataaccaacagaatgggagaaaatatttgtaaactacctgacaagggattaaccagaatatatatggagctcaaataattctatagaaaaaatataattatctaatcaaaaaatgggcaaaagatttgaatacacatttaccaaaagaagatacacaaatggcaaacagatatatgaaaaggt

SEQ ID NO: 179270 - DNA, 601 bp, Human
caaaatggattaaagacttaaatctaagacctcaacttatgaatctactacaagaaatcattggggaaaatctccaggacattgacctgggcataattttttgagcaataccccacaagcacaggcaaccaaagcaaacgtagacaagtgggatcacatcaaattaaaagccttctgcacatcaaaggttacaatcaacaaagtgatgagataaccaacagaatgggagaaaatatttgtaaactacctgacaagggattaaccagaatatatatggagctcaaataattctatagaaaawatataattatctaatcaaaaaatgggcaaaagatttgaatacacatttaccaaaagaagatacacaaatggcaaacagatatatgaaaaggtgctcaatgtcatggatcatcagataaatgcaaatgaaaactacaatgagatatcttctcactctgattaaaatggcttatatccagaaactatgcaataagaaatgctgacaaggacgtatagaaaagggaacctttgtacactctgagtggggaggtaaaatagtaaaatagcaatggagaacagtttggaggttcatctaaaaagc

SEQ ID NO: 179271 - DNA, 601 bp, Human
ttcctaattgtttttattttattattgggcacaattttatactacaatccaggacagcttcaaatagtgatagaattatattatttcacataaatgctactgggaaaaaaattatgccttttatatgaaatttctcatattctactggtttctgatgctaataacccttccttgctttgaggaagatattgaactgttgaactgtgcatatgaatacagcacaaaatagctttgcataatgtgatatccttcaaaaacaacagaattcacactggttaaaaacagagctattttaaactartgactattgttatctgtcatccaaagcattttatgtacatgtaaaataatatatgcaatttttaaaactgttcagatcaatttcagatatacatataagcgtatctattttccttagaaatgttttctaatatctaggtcgggtgcggtggctcacgcctgtaatcctagcactttgggaggccgaggcaggtggatcacgaggtcaggagatggagaccatcatggctaacagggtgaaaccccgtctctagtaaaaatacaaaaaaaaaaaaaaaaaggagagaaaagaaaaaaaatt

SEQ ID NO: 179272 - DNA, 601 bp, Human
ccggaggctgaagcagaatggcgtgaacgcgggaggcggaggttgcagtgagctgagatcctgccactgcactccagcctgggagacagagagagcgagactctgtctcaaaaaaaaaaaaaaaaaaaaaaaaagaaacttttctaatatccaatataatttcaagataatttttctctattttattgagttagttgtcactaacttttaattattagtttattttaaatttctaggcaatttattttagtgataactcaaatattattggcgatatttccattaaaatataattgatgtrcagtagtagggctatccaaaaataaatcaacagcttaaacttttcatagaaatttggcattttcttaagatgcacttgtgtttacaaattggaaaccctgacctctttatttaattaatgttgtgtacttaattgtaatatttaaatgtatataataaagcttaagacaaaccaaagctctttccacagaatatgaaatagccataagtcaaaattttgaattatcttgtacatactaagcaatatattgtttttattaaaaacttttctttattaaattaaaccatgctttttttcaaa

SEQ ID NO: 179273 - DNA, 601 bp, Human
gatctgagatatatgtgagattgtatgttcaaagtgttttaacataattttgtcacataacaaacacctactaaatattgccactttatataaacatctctcatctatttgttcatttgtttgtttctgttttgttttgttttgttttgttagacagagtctagctctgttgcccaagccagagtgcagtggcacgatctcggctcactggaacctctccctaccaggttccagtgattctcccgcctcagcctctggagttgctaggattacaggcacacgccatcacgcccggctaatwtttttattattattactagagacagggtttcaccatataggccaggctggtcttgaatacctgacttcaggtgatcctcccacctcagcctcctcaaatgctgggattgcaggctctcatctgtttttgaatcaaagttgtttggttgttattgtttccttgtttttttgagaaagggtcttgctttgtcacacaggctggagtgcagaggtgcaatcacagctcattcaagcttcagccccccagtctcaagcatcctcccacctcagcctcctgagtagcaggactacaggcacatgc

SEQ ID NO: 179274 - DNA, 601 bp, Human
gacttcaggtgatcctcccacctcagcctcctcaaatgctgggattgcaggctctcatctgtttttgaatcaaagttgtttggttgttattgtttccttgtttttttgagaaagggtcttgctttgtcacacaggctggagtgcagaggtgcaatcacagctcattcaagcttcagccccccagtctcaagcatcctcccacctcagcctcctgagtagcaggactacaggcacatgccaccatgactagctaaatttttgtaggtttctattttactttattttatttggctgttgttgktggtggtggtggtggtggtgttttgtaaagacagggttttgtcatgttgttcaggatggtcatgaactcctggactcaagcagtccacctgcctcagactcccagagggctgggattacagacatgagccaccttgcctggctccaaatttatttagatcgtctcttattatcattcttcttgatcaataaatgttagtatacatagaaatcacagatattgatgaattataatgggaagtcatggaaagtgtcacacaattaaagcttaattctgactttcttgcttttggtgtgtcat

SEQ ID NO: 179275 - DNA, 601 bp, Human
ttcaggtgatcctcccacctcagcctcctcaaatgctgggattgcaggctctcatctgtttttgaatcaaagttgtttggttgttattgtttccttgtttttttgagaaagggtcttgctttgtcacacaggctggagtgcagaggtgcaatcacagctcattcaagcttcagccccccagtctcaagcatcctcccacctcagcctcctgagtagcaggactacaggcacatgccaccatgactagctaaatttttgtaggtttctattttactttattttatttggctgttgttgttgktggtggtggtggtggtgttttgtaaagacagggttttgtcatgttgttcaggatggtcatgaactcctggactcaagcagtccacctgcctcagactcccagagggctgggattacagacatgagccaccttgcctggctccaaatttatttagatcgtctcttattatcattcttcttgatcaataaatgttagtatacatagaaatcacagatattgatgaattataatgggaagtcatggaaagtgtcacacaattaaagcttaattctgactttcttgcttttggtgtgtcattga

SEQ ID NO: 179276 - DNA, 601 bp, Human
gtatagacctacatccactagaaattaatcccactgtacattgaataagtatctgaaatgtacagcaataaattataactatcttaaggcagcatttctcaacttcagtcatttgataaccagcttcatctcttttctgtattcatgtgctgcctgaactgttacatgtcctctttcttctttaaattgaattgtttttatttattcttatctgtacccaaatgatcagtgaaattaaaagtatgatacatatgccagttatatttttaaatgcacattaaaattaatacaaaatatacartacaattgtttttcaaaatattacctaacctcagcgtatccaccctcccccagtggttcacagatcacatttttagaaattctgcttttgtgtccaaacatattttgaattaatgtgatacaaaatttagctatgaaatattgagtgggacatgtttaaagatgttgtaattaggatagaacctgttttccatcctcctgtttgtgggtccatgcacttttctccagtaaataatatgcttcacttcactaatgggcactgagtttattcacaaatcattgtaaaagaaactcatttact

SEQ ID NO: 179277 - DNA, 601 bp, Human
agtacaattgtttttcaaaatattacctaacctcagcgtatccaccctcccccagtggttcacagatcacatttttagaaattctgcttttgtgtccaaacatattttgaattaatgtgatacaaaatttagctatgaaatattgagtgggacatgtttaaagatgttgtaattaggatagaacctgttttccatcctcctgtttgtgggtccatgcacttttctccagtaaataatatgcttcacttcactaatgggcactgagtttattcacaaatcattgtaaaagaaactcatttamttccagtccttagcactaaatgattcttttaggatgagaccaataaactgaataaataaaacagcgggataagctttaaaagcaatttcttcccttttttctgctaaagtgaaataataaaatgctggccttggtcttagcctagatcacctgcataatttgtaatcaaaatagtagtattttttgtgattttgcatttattgagaaaatgtgtctttctgtgttaaataaaataaactgattcaactttaatttttgtactgtgagtccagttttaccttctcttccttccaataaata

SEQ ID NO: 179278 - DNA, 601 bp, Human
ccaggtttattggaagacagaaaacaatggagtgaacttttcacaatacaaaattcttagattatttttatttataaaatgtgaagattacattatattttttgtttctttttttattcttaagaaaatgtaacttctggaaaataaattttataaaatataagcagtgacttaatcagtcatagtaatttatgtaactaacatttcctttattactaaccccaattcacttaacaactatcaataaataatgaagacttttatattggcatgtgctaatctagacacaaggagtgtagcrctaaaaatataagtttcgccaggcacagtggctcacgcctgtaatcccagcactttgggaggccaaggaggctggatcatctgaggtcgggagttcgagacaaacgtggccaacatggagaaatcccatctctactaaaaatacaaaattagcagggcgtggtggcacatgcctgtaatcccagctactccgaaggctgaggcaggagaatcgcttgaatcccggaggcggaggttgcaggagccaagatcgcgccattgcactccagcctgggaaacaagagcgaaactccatcaataa

SEQ ID NO: 179279 - DNA, 601 bp, Human
agaaaacaatggagtgaacttttcacaatacaaaattcttagattatttttatttataaaatgtgaagattacattatattttttgtttctttttttattcttaagaaaatgtaacttctggaaaataaattttataaaatataagcagtgacttaatcagtcatagtaatttatgtaactaacatttcctttattactaaccccaattcacttaacaactatcaataaataatgaagacttttatattggcatgtgctaatctagacacaaggagtgtagcgctaaaaatataagtttckccaggcacagtggctcacgcctgtaatcccagcactttgggaggccaaggaggctggatcatctgaggtcgggagttcgagacaaacgtggccaacatggagaaatcccatctctactaaaaatacaaaattagcagggcgtggtggcacatgcctgtaatcccagctactccgaaggctgaggcaggagaatcgcttgaatcccggaggcggaggttgcaggagccaagatcgcgccattgcactccagcctgggaaacaagagcgaaactccatcaataaataaataaataaataaat

SEQ ID NO: 179280 - DNA, 601 bp, Human
aaaatgtaacttctggaaaataaattttataaaatataagcagtgacttaatcagtcatagtaatttatgtaactaacatttcctttattactaaccccaattcacttaacaactatcaataaataatgaagacttttatattggcatgtgctaatctagacacaaggagtgtagcgctaaaaatataagtttcgccaggcacagtggctcacgcctgtaatcccagcactttgggaggccaaggaggctggatcatctgaggtcgggagttcgagacaaacgtggccaacatggagaaaycccatctctactaaaaatacaaaattagcagggcgtggtggcacatgcctgtaatcccagctactccgaaggctgaggcaggagaatcgcttgaatcccggaggcggaggttgcaggagccaagatcgcgccattgcactccagcctgggaaacaagagcgaaactccatcaataaataaataaataaataaataaataaataaataaatgtttcttgcttcatggtccatgcaatttaagaggggagatgaaactaaactacatttaaaattagtagtcattttttatgaatatacact

SEQ ID NO: 179281 - DNA, 601 bp, Human
cccaattcacttaacaactatcaataaataatgaagacttttatattggcatgtgctaatctagacacaaggagtgtagcgctaaaaatataagtttcgccaggcacagtggctcacgcctgtaatcccagcactttgggaggccaaggaggctggatcatctgaggtcgggagttcgagacaaacgtggccaacatggagaaatcccatctctactaaaaatacaaaattagcagggcgtggtggcacatgcctgtaatcccagctactccgaaggctgaggcaggagaatcgcttgaaycccggaggcggaggttgcaggagccaagatcgcgccattgcactccagcctgggaaacaagagcgaaactccatcaataaataaataaataaataaataaataaataaataaatgtttcttgcttcatggtccatgcaatttaagaggggagatgaaactaaactacatttaaaattagtagtcattttttatgaatatacacttttgaaatatgcagttttcatatacaaaataccagttttgagtatacaagtgggctttcacaaggtcacaaatatagctttggcatatttctttac

SEQ ID NO: 179282 - DNA, 601 bp, Human
atcaaataaataaacttaataaaatactttagcaaataattgaaggaacaataatatgtttgttcagatattttagtcatacatacagccgaactagacacattgcttacttactgtgcatggtagtacatcaacagggttgtaattacgaaaacgcatagaatttgcaacagagattatagataatagcatgcattacattccaaacaagagaatgtctattcccttgaatttctctagcgtaatctgcaagatcatcaatgtctaagagaaaatattttcattcgatgtgatgttgccrtagaggatctcaaataatctatatttccctgatattctgtcttgtttaggatttagatctgtgagttagtattcagcgtagtgggactaactcacttttgtacgtaagaatcacataaggagctgtatacaagtaaacctgactgagcctcactccctaagatataactgcacctacctttcagatcttttgatacactaactttcagtggggattaaagagtttcattttgaaaatgtccagaaatggttcttgtgtatatgccctatagagatcctgtctttgaaattactttattta

SEQ ID NO: 179283 - DNA, 601 bp, Human
ccaaacaagagaatgtctattcccttgaatttctctagcgtaatctgcaagatcatcaatgtctaagagaaaatattttcattcgatgtgatgttgccgtagaggatctcaaataatctatatttccctgatattctgtcttgtttaggatttagatctgtgagttagtattcagcgtagtgggactaactcacttttgtacgtaagaatcacataaggagctgtatacaagtaaacctgactgagcctcactccctaagatataactgcacctacctttcagatcttttgatacactaamtttcagtggggattaaagagtttcattttgaaaatgtccagaaatggttcttgtgtatatgccctatagagatcctgtctttgaaattactttatttattctatcacagacacacacacatacactcaacacacaaaaatacacgcacatccactttcatgaaacatttgttacttagaaaaattattacggttttgatattaaatacaactacatatagaataagttacataaaacaaattagttcatatgactcatgtcttcctaatcatgatagttttggcattccaagtttatata

SEQ ID NO: 179284 - DNA, 601 bp, Human
attctgtcttgtttaggatttagatctgtgagttagtattcagcgtagtgggactaactcacttttgtacgtaagaatcacataaggagctgtatacaagtaaacctgactgagcctcactccctaagatataactgcacctacctttcagatcttttgatacactaactttcagtggggattaaagagtttcattttgaaaatgtccagaaatggttcttgtgtatatgccctatagagatcctgtctttgaaattactttatttattctatcacagacacacacacatacactcaacayacaaaaatacacgcacatccactttcatgaaacatttgttacttagaaaaattattacggttttgatattaaatacaactacatatagaataagttacataaaacaaattagttcatatgactcatgtcttcctaatcatgatagttttggcattccaagtttatataaaatagagcttaatgaactagtattacgtggtagttttaacactgatttatctgctctgtgatagcaggtaaattgttataactttttctggtacaagtctaccatttataaataagtttccttcaatctgc

SEQ ID NO: 179285 - DNA, 601 bp, Human
tttgaaaatgtccagaaatggttcttgtgtatatgccctatagagatcctgtctttgaaattactttatttattctatcacagacacacacacatacactcaacacacaaaaatacacgcacatccactttcatgaaacatttgttacttagaaaaattattacggttttgatattaaatacaactacatatagaataagttacataaaacaaattagttcatatgactcatgtcttcctaatcatgatagttttggcattccaagtttatataaaatagagcttaatgaactagtattaygtggtagttttaacactgatttatctgctctgtgatagcaggtaaattgttataactttttctggtacaagtctaccatttataaataagtttccttcaatctgcaacatccccttattctgtaagtcttccagttggctcggtaaatattacaaatttttagatagtttttaattcatataaatttgatatttactaactttttagttgatgattttctaataacattgtatagtgagggagtgtttcttcaattttcttctgtttagctttccatataaatcaattagtaaggaaagc

SEQ ID NO: 179286 - DNA, 601 bp, Human
catatagaataagttacataaaacaaattagttcatatgactcatgtcttcctaatcatgatagttttggcattccaagtttatataaaatagagcttaatgaactagtattacgtggtagttttaacactgatttatctgctctgtgatagcaggtaaattgttataactttttctggtacaagtctaccatttataaataagtttccttcaatctgcaacatccccttattctgtaagtcttccagttggctcggtaaatattacaaatttttagatagtttttaattcatataaattwgatatttactaactttttagttgatgattttctaataacattgtatagtgagggagtgtttcttcaattttcttctgtttagctttccatataaatcaattagtaaggaaagccaaggttatttggataatgtctttaaattgaaaacaaaagtcaacttctgattgtagagaagaatgctgaacaacataccaccagttcctggcacctgtagattttcacgctgtgtgtgtgtttttcttttttcttttttcaacagagataatggacttttctgaaggattttttatttgaatgaca

SEQ ID NO: 179287 - DNA, 601 bp, Human
tagtagctgtgtttatagagggtgaaaaactcttaggtaagaatctttcttcgctatgatattatattgtcatgatctatctcttatgatagcatcaatgcttctgttttgtaatccacaaagtttttgtctgactatctaagtctttctttctcagaagttacatgatttttagattgacaataatatatctacttataagataatgtatttcatactctttcaaataagtacgaatagtaaaattctagtatgcataaatcctaccattttacccctggttcatagcgcttaccttgtycactcctttcaatcaccaacttatattttactgtctattacaataatcagtgcattatgtatatgccagtcttttttttttcgcttaaagaaacatttctggcaaaacacaagtcatggtttaatttacttttctcctctttctccacatgcagtagcacagctgaatatagctgaagaaaatcccacagtaattttaagtggtctgtatttaaaattatgttccagaacataacgtaaattctttctgctgcctagaactcatcctaccttttcttggttcattttcttgaccactgtt

SEQ ID NO: 179288 - DNA, 601 bp, Human
tgcagtagcacagctgaatatagctgaagaaaatcccacagtaattttaagtggtctgtatttaaaattatgttccagaacataacgtaaattctttctgctgcctagaactcatcctaccttttcttggttcattttcttgaccactgttttagataactacttcataaatttttatctattctcaaatttacaaaactcctctatcatcaaaaagctcagctgatgattcacttcctcttttactaattagttggaaacagaagaaaatcttaataaatcctgactactacacctgcamacatacccagtggaacctgtatgttaccatgaatgaaatatctgagttttcatgtggagtctggatttcatccactctaacatcagtccagtaattcatctccctatatataatcatacctcattgatcattaccataacttttaaagctattcttatttctcttgatacacacacacacacaaacacatacacatccttcatacgtatgtgtatatttatgtgtgtgcctgttcttccaattatctcttgaacatactccagttagattttaccactccactgaaactctctggcaagc

SEQ ID NO: 179289 - DNA, 601 bp, Human
ttacaaaactcctctatcatcaaaaagctcagctgatgattcacttcctcttttactaattagttggaaacagaagaaaatcttaataaatcctgactactacacctgcaaacatacccagtggaacctgtatgttaccatgaatgaaatatctgagttttcatgtggagtctggatttcatccactctaacatcagtccagtaattcatctccctatatataatcatacctcattgatcattaccataacttttaaagctattcttatttctcttgatacacacacacacacaaacacayacacatccttcatacgtatgtgtatatttatgtgtgtgcctgttcttccaattatctcttgaacatactccagttagattttaccactccactgaaactctctggcaagcttaccaataaccttcactttatgaaacctaatggttgacctagttaaacaacctcttctgtttgtaccatgttttttttggcttctagtgaactctcttggtttttttcttactatgctgttcacttcctcaatctcttttgatcattctttgtcttctaattgacatctaaataattgggcaccctagt

SEQ ID NO: 179290 - DNA, 601 bp, Human
aatatctgagttttcatgtggagtctggatttcatccactctaacatcagtccagtaattcatctccctatatataatcatacctcattgatcattaccataacttttaaagctattcttatttctcttgatacacacacacacacaaacacatacacatccttcatacgtatgtgtatatttatgtgtgtgcctgttcttccaattatctcttgaacatactccagttagattttaccactccactgaaactctctggcaagcttaccaataaccttcactttatgaaacctaatggttkacctagttaaacaacctcttctgtttgtaccatgttttttttggcttctagtgaactctcttggtttttttcttactatgctgttcacttcctcaatctcttttgatcattctttgtcttctaattgacatctaaataattgggcaccctagtctgccattttttcttggatttctctaatgatgctgagtccttggtgatttcatctagtcttacggctttaatgatcaattggattctgtaatctccaaatttcaactgtggacctctctactgaactccagtcttctatgtccaatg

SEQ ID NO: 179291 - DNA, 601 bp, Human
ttctccctcaatcatcccattctcattaagtggtgtctttttctgtttaggaaaatgcttgaaaacatctttggcttttatttatttttattctggctagaaatacattttttaactgttacttttggttcagacatacacgtacaggtttgttatataggtaaattgtacattgtggggtattgaagcacagattatagaaattcatatttttagcaaattttattagccctactttaaatatatccataattcaattacttttcaacaaccagctgttactgccttggccgaaaccatygttacttgcctgcgttatttcagtaacttttttttttttggatgggttacagaccagcgtttgctttatttgaacagagtttgaacacaacagtgagttcttaatgcatccacccttgtgcctgttattttcattaaaatggttagattgattcacctgaaacaagccatataatataaatgttctgttcaaaagcctttaatagtctcatataatttggaattctctgctcttatttaatggctttacatgatagaccacttttccatttgctgtgacaacctgcttttcctcatattc

SEQ ID NO: 179292 - DNA, 601 bp, Human
acttgcctgcgttatttcagtaacttttttttttttggatgggttacagaccagcgtttgctttatttgaacagagtttgaacacaacagtgagttcttaatgcatccacccttgtgcctgttattttcattaaaatggttagattgattcacctgaaacaagccatataatataaatgttctgttcaaaagcctttaatagtctcatataatttggaattctctgctcttatttaatggctttacatgatagaccacttttccatttgctgtgacaacctgcttttcctcatattctacttttttttttttttaaacctgaaacagggtcttgctctttcacccaggctgagtacagtgctgcaatcaaggctcacggaagccttgaactcctgggtcaaccaatcctcccacctcagccttctgggtagctgggactacaggcacatgccaccatgcccagcttatcctactcttaagatcaattaatgaatcaatgaaatttcatgtttcctccataaatcctagggcattgcaaactcttcagtggtaatttatccatttagaagactgcaaattgcaagtcttaaattcagtaaaa

SEQ ID NO: 179293 - DNA, 601 bp, Human
tagggcattgcaaactcttcagtggtaatttatccatttagaagactgcaaattgcaagtcttaaattcagtaaaaactatttcaaaactttaatatgcttactgaagtttctaattattttttgtattttctgagagagtgcttgaactgtcaaactgaaatctatatgatagactattgatttttaacaggtaataactatgaatatgtttaggttaattgttggattctttagataaaaactaaggataaagttcagtccactgtcattcaacttacaaaatgaaaagtcaatgtacrtgacacactatagttgattttctatatggatatttgcatttaattccgaagttcactatacccagtagagtgacaagagctttgataatactggaaccaaaatttaaaacaaaacacaaatttatattaaatttttagtagcatattcattgataaacatatgaataaatagatgtaatttttgattgattagtgaataatttgtttataaactagaatctcttttggggccaaatgatagagaaagtgataattaacatatcatacacaagtttatagaagcaagagattaaagagcaa

SEQ ID NO: 179294 - DNA, 601 bp, Human
tttgtttagatcagcatcataagttgtcatattgcagatattaccactaggtagaatactttttaaatacccactcatacaatttgcctcaattttccctgtactataaatactcaacacttttcatacctgcatatcccaacacagtattacaagctggaaaaaggctgtttctcatcatttttatatcttagcaaagatacatataattttctagaccatttctgcttcgtgggtctttagctcccctgtcaccagacttacctttaatgaaaatatccatagtgttttattaatcatytggtgattgatatacgttaaagattcatcacagtctgacacatgattttctttgattttttatagaaaaggtatcatatagaaaatatactattcctggtactgttttaattattttttttacaaaatccatactctatcaatggtttatggttgttgcagcattgtatattttatcccacactgggaaggtgttttgataagactcctgattttgcttaaaaagcgtaacattttatcaacatttccaactctgtttctcctatacattattttatcttaataacttctgttagatcct

SEQ ID NO: 179295 - DNA, 601 bp, Human
gatacatataattttctagaccatttctgcttcgtgggtctttagctcccctgtcaccagacttacctttaatgaaaatatccatagtgttttattaatcatctggtgattgatatacgttaaagattcatcacagtctgacacatgattttctttgattttttatagaaaaggtatcatatagaaaatatactattcctggtactgttttaattattttttttacaaaatccatactctatcaatggtttatggttgttgcagcattgtatattttatcccacactgggaaggtgttttrataagactcctgattttgcttaaaaagcgtaacattttatcaacatttccaactctgtttctcctatacattattttatcttaataacttctgttagatcctctctgaagagtttcttctcttttaattgaaggcttctaacaatcacaaaaagcttgatttgtatatagagtgtttgtataaattacctgttcttcatggagggttgctttacactaagacaacaaaaagcaaaatcaaaactgaaaagcaactcagtggagttcatctatttgttttccacacttttagtttttagcc

SEQ ID NO: 179296 - DNA, 601 bp, Human
ttaaagattcatcacagtctgacacatgattttctttgattttttatagaaaaggtatcatatagaaaatatactattcctggtactgttttaattattttttttacaaaatccatactctatcaatggtttatggttgttgcagcattgtatattttatcccacactgggaaggtgttttgataagactcctgattttgcttaaaaagcgtaacattttatcaacatttccaactctgtttctcctatacattattttatcttaataacttctgttagatcctctctgaagagtttcttmtcttttaattgaaggcttctaacaatcacaaaaagcttgatttgtatatagagtgtttgtataaattacctgttcttcatggagggttgctttacactaagacaacaaaaagcaaaatcaaaactgaaaagcaactcagtggagttcatctatttgttttccacacttttagtttttagccactcatctcttagagataggttgtttctatgtctctataacaaaaataatttgatgaaattgcggttttcagattttaatttttttagtattttgatgtttctttcatgttctgtataa

SEQ ID NO: 179297 - DNA, 601 bp, Human
tcccacactgggaaggtgttttgataagactcctgattttgcttaaaaagcgtaacattttatcaacatttccaactctgtttctcctatacattattttatcttaataacttctgttagatcctctctgaagagtttcttctcttttaattgaaggcttctaacaatcacaaaaagcttgatttgtatatagagtgtttgtataaattacctgttcttcatggagggttgctttacactaagacaacaaaaagcaaaatcaaaactgaaaagcaactcagtggagttcatctatttgttwtccacacttttagtttttagccactcatctcttagagataggttgtttctatgtctctataacaaaaataatttgatgaaattgcggttttcagattttaatttttttagtattttgatgtttctttcatgttctgtataaaatatttccaataaatataggcatatttatttaaatataaatctgttatcaattatacatgagttaacaagacagcctgaggatcattcaaagctcacaatatagatatattttacccttcttgaacttctcacccaatgtgtagttataaggcatcat

SEQ ID NO: 179298 - DNA, 601 bp, Human
gttgctttacactaagacaacaaaaagcaaaatcaaaactgaaaagcaactcagtggagttcatctatttgttttccacacttttagtttttagccactcatctcttagagataggttgtttctatgtctctataacaaaaataatttgatgaaattgcggttttcagattttaatttttttagtattttgatgtttctttcatgttctgtataaaatatttccaataaatataggcatatttatttaaatataaatctgttatcaattatacatgagttaacaagacagcctgaggatcwttcaaagctcacaatatagatatattttacccttcttgaacttctcacccaatgtgtagttataaggcatcatgacaaataatgcatatgaatcattcagcatgtctccatattcaaaataaaacatatatttgctataataatatcagcacatacaacagtaattatacatatagactatataagatttcttatacatctaatgacataggtatgttaacatgtatttagcataatgtgattgtttaaaaagaaaatgtatgtgtagcctgtatatatacatatatacacatgtatata

SEQ ID NO: 179299 - DNA, 601 bp, Human
ttagtttttagccactcatctcttagagataggttgtttctatgtctctataacaaaaataatttgatgaaattgcggttttcagattttaatttttttagtattttgatgtttctttcatgttctgtataaaatatttccaataaatataggcatatttatttaaatataaatctgttatcaattatacatgagttaacaagacagcctgaggatcattcaaagctcacaatatagatatattttacccttcttgaacttctcacccaatgtgtagttataaggcatcatgacaaataawgcatatgaatcattcagcatgtctccatattcaaaataaaacatatatttgctataataatatcagcacatacaacagtaattatacatatagactatataagatttcttatacatctaatgacataggtatgttaacatgtatttagcataatgtgattgtttaaaaagaaaatgtatgtgtagcctgtatatatacatatatacacatgtatatacatgtatatgtatacgtatacataaatatgtacatatacatatacacatacatctatatatgtatatattgccagatactttt

SEQ ID NO: 179300 - DNA, 601 bp, Human
gccactcatctcttagagataggttgtttctatgtctctataacaaaaataatttgatgaaattgcggttttcagattttaatttttttagtattttgatgtttctttcatgttctgtataaaatatttccaataaatataggcatatttatttaaatataaatctgttatcaattatacatgagttaacaagacagcctgaggatcattcaaagctcacaatatagatatattttacccttcttgaacttctcacccaatgtgtagttataaggcatcatgacaaataatgcatatgaaycattcagcatgtctccatattcaaaataaaacatatatttgctataataatatcagcacatacaacagtaattatacatatagactatataagatttcttatacatctaatgacataggtatgttaacatgtatttagcataatgtgattgtttaaaaagaaaatgtatgtgtagcctgtatatatacatatatacacatgtatatacatgtatatgtatacgtatacataaatatgtacatatacatatacacatacatctatatatgtatatattgccagatacttttaattttatgg

SEQ ID NO: 179301 - DNA, 601 bp, Human
aggatcattcaaagctcacaatatagatatattttacccttcttgaacttctcacccaatgtgtagttataaggcatcatgacaaataatgcatatgaatcattcagcatgtctccatattcaaaataaaacatatatttgctataataatatcagcacatacaacagtaattatacatatagactatataagatttcttatacatctaatgacataggtatgttaacatgtatttagcataatgtgattgtttaaaaagaaaatgtatgtgtagcctgtatatatacatatatacacatrtatatacatgtatatgtatacgtatacataaatatgtacatatacatatacacatacatctatatatgtatatattgccagatacttttaattttatggtatcagtccaataaaattaatactttgaataaggatgtgttctataacataagaaatctcatattggtgacaaaatgtggtcactagatgtcactgacattaactatggaactagtgacaatttaaaatactttttagaacttccataatggatgaagtggggcctgatttgcacaatgaacttaaaaatcctcagcaaca

SEQ ID NO: 179302 - DNA, 601 bp, Human
caacaaaacaaaatgtacaatgtgatgggcagcacattgatccccaagagaagagaagcatgtgatgtaagctccattattgctcaagcctactgcctggagagagatttcaggcgggagcacagggatgaatgcttcaattgttttccctgttaggagacagtgttctgagtttgggtgacaacgtgtgctggaattctcacagtggggtagctgaaagggcagagccctgtggagatgacagaatttcacacacacacagagaaatacctccggagatcttcagtgctttccgttggakatttgagctaattattgcttagtgcgtgtgtgtgtgtgtgtgtgtgtgtgtgtgtgtgtaaaaacaatgcaaggccttggaaagaatcattggaatgctagaactgttgctttggttgtgtggccaaaatagccctaaactaaaagttgttcccaactcacctaacaaagcttcaaagcaaacctcaaaggaataaaattgttttcaagtaacttaatgtctcagaagagagactggacatacataaaggaatacaaaacatatagcactcaaaatatatcagttacaatgtctggcata

SEQ ID NO: 179303 - DNA, 601 bp, Human
atcagttacaatgtctggcataaaattaaaaaaatcgtggcatatgcaaggtgaaaaaaataacccataataagaaaaaacagaaacagtatcaatagaaacataccatcgatgacatacatgatggtagtaggcgagaacactacccgatcaattgttttaatgggccctgcatatgtatttagaagatacagaaaagcacaagcacaacaaggagagatgccgatgatataaaacagctcaaataaaaattgtatatattgaaaaaacaacattttcaatactgaaaatgaccttggaygggattagtagcatagtggatactgcagaaaatgactagcaaaatcaagacatagcaccataatctatccaaaggttaagtgctatgatttccttttgggggagtaggtacccagtagtgggattgctgtctcgattgatatatttagttctttgaaaaagctttgtactgtttcccgttttaggcaggaaaaaggtgaatatatcctttgacctgaactgtgtcttttccatgctgtgagtatggggtggacaaaggctcagaatgggacttttatttgttctggtagatagagcaaga

SEQ ID NO: 179304 - DNA, 601 bp, Human
caaaataaactgtcaattaaatagagtatgggaaagttattattttactttgagatggaatatatgtagaatgcttttggaaatcacaatgaaatagatgggtgtatgaaactcatatttattgcttagatctgcatatcagtagctttagccaatttattatgtactttacagatgctaaactccaaatattcactcatttaatctgcataggtatcctttgaaatctgtattcttatcatacccattatacagaaaagcaaactgaggtaccactaagtaaagtagttaatctcaggcyttagagattataggtgccacagccaggatgtaagcctatccattctggttctgcaatttatggtcctaactattatattacattaaagtaggtaggatgcctgtgcaataatataaatactcaggtcatgttttgaaaaccagcattttgacaactgtctgttggaacccacctagtctctagtctcatgttttaaatttaaaaataataatctctaaaaggtttattctacttaaagctttattatcataatattttaattttaaatattatttttaaagtattgaatatgaaatacgg

SEQ ID NO: 179305 - DNA, 601 bp, Human
ggaaagttattattttactttgagatggaatatatgtagaatgcttttggaaatcacaatgaaatagatgggtgtatgaaactcatatttattgcttagatctgcatatcagtagctttagccaatttattatgtactttacagatgctaaactccaaatattcactcatttaatctgcataggtatcctttgaaatctgtattcttatcatacccattatacagaaaagcaaactgaggtaccactaagtaaagtagttaatctcaggctttagagattataggtgccacagccaggatrtaagcctatccattctggttctgcaatttatggtcctaactattatattacattaaagtaggtaggatgcctgtgcaataatataaatactcaggtcatgttttgaaaaccagcattttgacaactgtctgttggaacccacctagtctctagtctcatgttttaaatttaaaaataataatctctaaaaggtttattctacttaaagctttattatcataatattttaattttaaatattatttttaaagtattgaatatgaaatacggaatagactttatacatgtattaaaatatgg

SEQ ID NO: 179306 - DNA, 601 bp, Human
aagcaaactgaggtaccactaagtaaagtagttaatctcaggctttagagattataggtgccacagccaggatgtaagcctatccattctggttctgcaatttatggtcctaactattatattacattaaagtaggtaggatgcctgtgcaataatataaatactcaggtcatgttttgaaaaccagcattttgacaactgtctgttggaacccacctagtctctagtctcatgttttaaatttaaaaataataatctctaaaaggtttattctacttaaagctttattatcataatattktaattttaaatattatttttaaagtattgaatatgaaatacggaatagactttatacatgtattaaaatatgggtacttattttaaaatataaatgtatacagccatagtataattttatgtagaggtaacaatctactaatgtagataacattttatacctaaagggtctgtgacagaatgcaagaaatatttcttttctcttttctttcatcaacactttctcatttggtcatttactaaaaacactttcacttccaccttaatatatttctggaatccactcactcttttccatttt

SEQ ID NO: 179307 - DNA, 601 bp, Human
aactttgaggggacccaaacattcagaccatagcaccctctctaatttactttttttcctgcagtgtgagtgatctttttaaatcacaagtgcatctactttattcctctgcctaaaacctatcctgtccatttccaattgttcgtaaaacacccaataaccttcaactgatatttaccttttcacagtgttatttatgtataagtcacatagcaaacaattcacccattaaactgtgcaattaaaagccttttttcctagagttgtgcaatcataaacacaatcaattttggatcatttratcacttcttttggtcatcaccccccaatctcctcaccaccacctcccattcccttgcctgccctaagcaaacattattctactttttgtatctatagatttgcctattctggaaatttcaaagaaattgaattattcaatactagtcctttgttatcagctttttcctcttactgtaacattttcatgattcatccatgttgaagcatgtgtgagtacttcattttggtttttctttggccaaataatattcctttgtatgtttataccacttgtttttttcaatccatgcaccagtaa

SEQ ID NO: 179308 - DNA, 601 bp, Human
attcccttgcctgccctaagcaaacattattctactttttgtatctatagatttgcctattctggaaatttcaaagaaattgaattattcaatactagtcctttgttatcagctttttcctcttactgtaacattttcatgattcatccatgttgaagcatgtgtgagtacttcattttggtttttctttggccaaataatattcctttgtatgtttataccacttgtttttttcaatccatgcaccagtaaataggcatttcagttgttttcactttttgacattattaataatgctgtyattagcatttatgtacaagtttttgtgtggacatatatcttcatttctctttggaatgtaattacaattctctgtttaacatttggaggaactgtcaaacattttatacaaaacatctgcaccattttacattcccactcacagggcatgagggtgccaatttcttcacatcctggccaacatgtgttactatctgactttttcatggtagccactccaatgaatgctaagtggtatcatgattttgatttaaatgtccttgatggctagtgagtttcagcatcttctcatgatcttatt

SEQ ID NO: 179309 - DNA, 601 bp, Human
atgaatgctaagtggtatcatgattttgatttaaatgtccttgatggctagtgagtttcagcatcttctcatgatcttattggtctttcttttgcttgggtacttcttattgtagtcttgtttatttctctaactctttcatatcttaccccttcaacctcatatttaatttgatagttccagtgagcccctttaaactctttcaacacagctttttttttcctcaagttcaagcccacacagttaccatttttttcctacttttcttacttttttattggtgagggctgactttgtaggrgtacaactcatgcaactgcacagattctgcactctttaacgaccccaagtttgagctaatatgctgcagtcatcgtcatcttggcattttaatagtttttaaatagaaactcccacattaaattttgcaattgccccctaaaattacatagccagtacagttcctgacttatcattttgacttgtccttccgttttggcataaatacctacgagaaactcttcctcacctttgtctaccaaattaggtttcctttctgaatgtcatctatatcagcatgcattataatttgtcatttttt

SEQ ID NO: 179310 - DNA, 601 bp, Human
tcatatcttaccccttcaacctcatatttaatttgatagttccagtgagcccctttaaactctttcaacacagctttttttttcctcaagttcaagcccacacagttaccatttttttcctacttttcttacttttttattggtgagggctgactttgtaggggtacaactcatgcaactgcacagattctgcactctttaacgaccccaagtttgagctaatatgctgcagtcatcgtcatcttggcattttaatagtttttaaatagaaactcccacattaaattttgcaattgccccytaaaattacatagccagtacagttcctgacttatcattttgacttgtccttccgttttggcataaatacctacgagaaactcttcctcacctttgtctaccaaattaggtttcctttctgaatgtcatctatatcagcatgcattataatttgtcattttttcctctgatccttatgacctgagagaccaagggctttgctttcttacccatttttctttttttatatgtaaaagtaaacgtgctaatttattcccattaaagcatcaaaaataaatgttttgtgtctaatttttgaaac

SEQ ID NO: 179311 - DNA, 601 bp, Human
cctcatagtgatgtcatggagattaaatacactagtaaatgtaaagctttttggatgttgtctaacaagtataatttatcatatgtatgtattgccttttataattattacattcaattcctatttgttgaataaattttttattttattatcaaagaaaagagaaagacaggaggacctaataagaaaactacctaagtgaagaactttgattgcatgtatttatctttctgacatcatttacactgctgggtgaaatggtaattatacaagaggtcagctcatgaaattgaaataagargaagattagaaagctaggagcaaatccagaggaaagaacattattgctaatagtaaagagaagaaacttacagggagggaaaacagtatttctgtttaaaattcttagtatgactgtagaaactggtggatttgatacattaaaacagttttgagaaggtagtttggataaattaattctaataacctttggagagtgttggtttttctgtctacatatttagcagttatgcattgtctttacctcagagtatttgaagttgagtttacttactcgatagagaaataatgccattaggaa

SEQ ID NO: 179312 - DNA, 601 bp, Human
atttctgtttaaaattcttagtatgactgtagaaactggtggatttgatacattaaaacagttttgagaaggtagtttggataaattaattctaataacctttggagagtgttggtttttctgtctacatatttagcagttatgcattgtctttacctcagagtatttgaagttgagtttacttactcgatagagaaataatgccattaggaatgaggcaaacagaatacctatagaaggcatccacaatggggtgcatattcttttgtgtatctgcattgatcttgcattctgcctatgrtccctatttacctgtccatcatcaggagaaccacatgaccccactgtcttctgtgcgtattcttgcttctctcatatctttcttatgtcctcttagggcatctgcctggaattcttccctcaacaccacccttctttcactatttacagatcacaatccacactttggtttgtcaggaaacatacctaccccattcctccacttactcctagaaagatatagtttgcctacctggtgcttttcacatttatttgaattgtactgtaaaattagtatctatcttgtttgtttaactttaat

SEQ ID NO: 179313 - DNA, 601 bp, Human
ctttcttatgtcctcttagggcatctgcctggaattcttccctcaacaccacccttctttcactatttacagatcacaatccacactttggtttgtcaggaaacatacctaccccattcctccacttactcctagaaagatatagtttgcctacctggtgcttttcacatttatttgaattgtactgtaaaattagtatctatcttgtttgtttaactttaatgccaccaagggtagaaactattacagtttgctcagcactgcatcgcagtgcctggttgcttattgtaaaataaatgcrcgtgcacacacacacacacacacacacacacgctctgacacaaaataattgttgaatggttaagtgagatgatccatcaatctcccaaaaggccaaaggatttaatgactctaaaagtgttccatgacacagtagaaagaatagaaagttttggaatactggccacctcaaatgtgctgtgaactctaattggattctaaatttgacaataaacgtctagtcaggtgaggccacaaaaaataacctataaataatgacacattatataatttcaattgtttgacaattaaaattgtcaac

SEQ ID NO: 179314 - DNA, 601 bp, Human
ttgaattgtactgtaaaattagtatctatcttgtttgtttaactttaatgccaccaagggtagaaactattacagtttgctcagcactgcatcgcagtgcctggttgcttattgtaaaataaatgcgcgtgcacacacacacacacacacacacacacgctctgacacaaaataattgttgaatggttaagtgagatgatccatcaatctcccaaaaggccaaaggatttaatgactctaaaagtgttccatgacacagtagaaagaatagaaagttttggaatactggccacctcaaatrtgctgtgaactctaattggattctaaatttgacaataaacgtctagtcaggtgaggccacaaaaaataacctataaataatgacacattatataatttcaattgtttgacaattaaaattgtcaacaaaaacttttagttgcaaataaactcaagaagtggttatcacatggatatttgattaagggatttttgaaaggacaataaactctaaaaataaccatattataaaaatattgaaataccatttaaataagcaattcttaaactgaccttctagaagggcaaagaacataacatc

SEQ ID NO: 179315 - DNA, 601 bp, Human
aatgcgtttctgtagcacaaagagacatgtcctttagaatgtcagaaacgaaaatagaaaatgaccttggacttttagtgcaagtatttgactcaaatgcatattgtgcatcattacagagccagtgatgaacctgagaatggcttctaactttcctaggaatcacacacttgggcacagtgtctgtttttccagaatttatgttaataatttcaggtatattgataataacttttaaatgcaaacatttttactaataacatctatatacaccaatagtttttcacaagtcaaagccatrtcatgtataacaggtaattacaagagaacatgtttattttcaagcgaagatcatgtaactttaaaatttacttttcaatactgtgaaataattacgtttcctttataaaaatgaataatttgctttgcattattaataatgtattttgttgttatattccaataaagttaattaagtacaagtgcttaactcatagtaaataatagctgaaggagtacattttctttactcaactgcatgtaaatttcactataacataatttgctttctaaaaatattagaatatactgtttctgtcct

SEQ ID NO: 179316 - DNA, 601 bp, Human
gagagatctttaaacatcaggctgagtgattgggttttgtttggagtcattgaaatgctttttatcattatacagccagggtacaggaaaccttcatgaagctatgagaatgtaaaaagtgtgctttttaaaaaaaacttattcttagctatacaagaaatactttctacatcaggaacagtttcttttttctttttgccagagaaacatgggaagtaacataatgttatatgtttggtcaccattttgcacacacaagcataaaatctttctttttcctgaatcgatgtaaacagagccyggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatgtaagttactttcctttgtattttcattaaaataactttgcatgctttgaaacatatgatttttcaataaagaccaaaatatatatgtagttcacatttcagtacttaatgcatagctttagaggaaatataggaatcattcagtcagttattg

SEQ ID NO: 179317 - DNA, 601 bp, Human
agggcagcatggaagctcatcactgcatattaaagatgtgaagttgtcagattcagggagatatgactgtgaagctgcaagcagaattggagggcatcaaaagagcatgtaccttgatattgaatgtaagttactttcctttgtattttcattaaaataactttgcatgctttgaaacatatgatttttcaataaagaccaaaatatatatgtagttcacatttcagtacttaatgcatagctttagaggaaatataggaatcattcagtcagttattggagacatctagtggaaattacrggatatttcacagtgctgtatatttcatcattttgatattgcttttcctgaaaatggtctttctttttttgcaacattgaactcaaaacacagtatcaactgaaaaatattaattatcagtaattggtcgatatcactttagattttttatttctttataatatttatgattatgtctcaaatatgtagtgtttacatttcttattcaaattgttttgttaggctattttacattttcataaactataaagagtattttaaatgcagtgaaatgtactaatatgctgtcttatcaaaata

SEQ ID NO: 179318 - DNA, 601 bp, Human
attgaatgtaagttactttcctttgtattttcattaaaataactttgcatgctttgaaacatatgatttttcaataaagaccaaaatatatatgtagttcacatttcagtacttaatgcatagctttagaggaaatataggaatcattcagtcagttattggagacatctagtggaaattacaggatatttcacagtgctgtatatttcatcattttgatattgcttttcctgaaaatggtctttctttttttgcaacattgaactcaaaacacagtatcaactgaaaaatattaattatmagtaattggtcgatatcactttagattttttatttctttataatatttatgattatgtctcaaatatgtagtgtttacatttcttattcaaattgttttgttaggctattttacattttcataaactataaagagtattttaaatgcagtgaaatgtactaatatgctgtcttatcaaaatagtgtttattttctgtctggaagaaaggagcatgacaaggatagtttttaaaataaatttaaaaatgtacataaccacgtgagttttgggaaatgggagggctaatgtaagtcaagctt

SEQ ID NO: 179319 - DNA, 601 bp, Human
atttatgaagcatcaatattggagagctctgatgcttgaaaggacatagctgttcttagtggatgtatgagatattcttattgccaaaatatttctattggagcatgtctagtacattaatattgatagaatgcaatggtaactgtgaaacaagatgcattctcttatcgagaatgccttcaaaaagaaaatattttctcaagaatagacataagttatccatattattttacattttatagactgtgcttgtcaagaaattcatggaaagaccaatcagaaacttctaaaagaaaaaagsactgttgtggggttgggggagaggggagggatagcattaggagatatacctaatgctaaatgaggagttactgggtgcagcacaccagcatggcacatgtatacatatgtaactaacctgcacattgtgcacatgtaccctaaaacttaaagtataataataataaaaaggaaagaaattcccataataggataaaaagaaaacaaaaacaaaaacaaaaaaaaaaacacccactgatatatttgttaaactatacaattcctggatctgtaacaacctttttaaaactattcatacagt

SEQ ID NO: 179320 - DNA, 601 bp, Human
aaaacacccactgatatatttgttaaactatacaattcctggatctgtaacaacctttttaaaactattcatacagttgttggaatttactaaacttcgtaactaaaagaaaaaaaaagaaaaaaggattatgaaaggcagtcaacaataaaaggcaacttgattctgacacaaattactgacttcatttgctgatattaggcagcttctaagaaagccactttatttccatcacactttctaaaaaaataaaaatggaaagcattgataatattgagaacacacaaaggaggaagtgatrccaataacttacttaacctttttcccttaataattttttctacttttttccattattacagtatatttctttttcagaccaacaacatcattagcaaattataaatactttacacttttacagtacatttgttatatttttaattaaaatttgtttatttaaaccaaaatttactttatgattttttttaatttttctaaatgtgaatctaaatgaagaaaaaaaaaacttaagcatgccaagatatgatttatatgagacctcctggcctcttccactgtcctacaaaagtgctaggct

SEQ ID NO: 179321 - DNA, 601 bp, Human
acaacatcattagcaaattataaatactttacacttttacagtacatttgttatatttttaattaaaatttgtttatttaaaccaaaatttactttatgattttttttaatttttctaaatgtgaatctaaatgaagaaaaaaaaaacttaagcatgccaagatatgatttatatgagacctcctggcctcttccactgtcctacaaaagtgctaggctgctaggcaacatattatcttaatgaaactatatttaggacttttattctttgcatttcattaatattttaaaacatttgctrtatcataggattagtactaaatgtctgttgcaggtcctcagaaaagtggagtttatgagaaatgaacactatggatatttccaaagcacagtaaggcagagtggctcgtacaagatatgctagtattagaataataggactagctaatatgttaattaatagtgtgttatgtgtccctgagtcctcaatttccttagttataagataagagggtttaaagaagagactgttgggacctatttatactcaagcatttaaagatacttttattcaagcgtatccacattctccagagatgcc

SEQ ID NO: 179322 - DNA, 601 bp, Human
cttaatgaaactatatttaggacttttattctttgcatttcattaatattttaaaacatttgctgtatcataggattagtactaaatgtctgttgcaggtcctcagaaaagtggagtttatgagaaatgaacactatggatatttccaaagcacagtaaggcagagtggctcgtacaagatatgctagtattagaataataggactagctaatatgttaattaatagtgtgttatgtgtccctgagtcctcaatttccttagttataagataagagggtttaaagaagagactgttgggamctatttatactcaagcatttaaagatacttttattcaagcgtatccacattctccagagatgccctgggatttctgaattattgtccatgcatgacagcataggtatttgtgtgaaacaaatgaaaaccgaaattaagattataattcatatatgtttatgttgtaaaacctcactgaaaatagttttaaaaaccatactaggtccaccttaagcttcaggttttgtgctgagtgataatggacacaaagatgaataaaacatagctcctcctttattagaagtctaccatcaacaggag

SEQ ID NO: 179323 - DNA, 601 bp, Human
cgaaaaaagtacattgggtactttatttttcaaggactgatttctaacaaagtacaagttgcttttgatcacattgcattccttctttataagtttaaatattggtttatgtttctgcttaattattccaaggtaaatgtgcagacttaagctcaccagaaaattatgtagtttagtttatcttatttaaacagggatgaaaggtcttgttttctaaaaggatgttttgagaattatttgagtatcccctgagattattattgccgccatcttgattagagggtagctagattaatatacwttgaaaaaaattttcttactattaaactatcatgtaaatataactactttttgttttccctaagcattgattatttttctgcaaatattgttgaaaatgagttgaatggctcttataacacttgatcatttttcctttttttccaaaatgaaacattcaaatttattctacttgagtggggataattagaaaaataaatatcatctcttgttaagacattattcaaatatatttaagtacaataaaagcccatatataatgtaaaatatgagttttgacctatgtatacaccactaaatc

SEQ ID NO: 179324 - DNA, 601 bp, Human
atctatccctcctttttacaactatccctaggcatccatttatctacttttgatcactacaatttagtttacatttacatgtaagaatgtatatacatagagtcatgcagtattatttttaatttactttattatctttgaaatgtacttatttacttttatttagttatagttgacaaataaaaattgtatatatttaaggtgtacaaatgtgatgcttttaaaaatttatcattagtattatttttgattggccaacaataattgtatccatttatggggtacaatgtaatttttgttrtatgtatatagtgttaaatgattcagttaagctcattaacatgtccattacctcacctaccttttttatggtgagacatttaaaatttactcttagttactttgaaaagcacattattgactgtagtgatccagctatgcaataactctcaaaacctatttctcctgtctatctgcctgtctaccctttgatcaataactccccatttccttccttcccatgcacccaccccagcctctgctgacatcattttactctgtttctgtgagttaaactttataagcttccacagttaaggaa

SEQ ID NO: 179325 - DNA, 601 bp, Human
aggtgtacaaatgtgatgcttttaaaaatttatcattagtattatttttgattggccaacaataattgtatccatttatggggtacaatgtaatttttgttgtatgtatatagtgttaaatgattcagttaagctcattaacatgtccattacctcacctaccttttttatggtgagacatttaaaatttactcttagttactttgaaaagcacattattgactgtagtgatccagctatgcaataactctcaaaacctatttctcctgtctatctgcctgtctaccctttgatcaataaytccccatttccttccttcccatgcacccaccccagcctctgctgacatcattttactctgtttctgtgagttaaactttataagcttccacagttaaggaagattatgaggtagttgtctttttgtgtttggcttatttaactgaacaccagtgtcctctagattcatccatgttgtgcaaatgacaagatttatcattttttaaatgctcaatagtattccactgtgtatctataccacatttcctttatcctttcattcattggtggacatttaggttgattccatatctaggctgtt

SEQ ID NO: 179326 - DNA, 601 bp, Human
ttaggcagcatatgatagaatattgctttctcattgactgtaaatctccttataattggagtgtttaacaagcagtcagtaattaacagggtcagggaataaatattttactttttctgggctacatacagtctctgccatatttttttttctcttgtaaaccatgaaaaatgtaaagaccatcctcatctctgagtcacatataaaagaagcccttgggcaagactttgcccatgggctataatttgccatccactggtttaggctattaagtttaatgccattgttgttactatttcawttaggcctacaatttttatttatattctgttttttttcctatgtttttttcacattctatgcccatttttctgccttctattgagttattcgaagttttagtatttgattttaatttatatattggcaatatttttggtttttgttttgtttcattttgttttgttttaagcgattctataggaattttaaaatacaaacctacattttcaaagtttccttgaaatagacttgagttcatattttgacactttacataaaatgtgaaacattgcaaccatttggattccttacacacacc

SEQ ID NO: 179327 - DNA, 601 bp, Human
agttgtatattgcaatcaaatgcccatgatatatgtggaagttgtctaataagtatattttttggcagttgaagcctggtttgttattagatattttatttcgcaacaaattcataatagtaataaaactcttagtaccttatgtgaaaggccacaaaaagctattgtcgtaattaaatatttacctattaataaagctcagaatacttttgttatgcatcatggccatcaaagttgtatggagacaaaaaattacaaagacattacacaatgttaaacacacacacacacacacacacayacacgcacacacacatacacacacacaattaccagaacagtcttataccacctgaaccaagcacctacagggtaatactgctaagagtgagtagaaaagagtcaaaccatttataatttgatagaagccgcatttactgtaatagcactaaacttaaggtgttagaaaattaagcctttttttgctcaaaacctcttttgtgtttcagcttaaacagatttcttggcattcttccagttcattttcaacatttccgaggcgttactttactaagaagcaggaattgaactaaacttccaa

SEQ ID NO: 179328 - DNA, 601 bp, Human
aacaaaggagaaaacaggcatgtgatatacagtttaatgcagtaagcactggttacatagtatgtttgattacaattagaatatcattaagttttgtgactaggtaatcattacatagtaactattaattagacttaattattttatgtataaatttaatttaacagttacatactaacaatgcatgctaagaaatattagaaattttcatttactttttttttctatttgagcttgctgcacctgcctttaattctccttagacataatggtgatttgtaaatgcattttctcctgtagyataaaagagagagttagcagtatcagatacattctaaggttatggttacattaaataatcccataacacagaatcatgttacttatttacatgctgtccatataattaatagatgtgtgctttattgagtaattcttatctcaaattctctgaatataacagtggatgtacattctctatatataaagtgattttactagcatgattggttagatgtataggatgaggtaaataagatgtgaacataatttaaacatataaagaagcttatttcagtaaacacttagaaattagaaaaat

SEQ ID NO: 179329 - DNA, 601 bp, Human
ttatgtataaatttaatttaacagttacatactaacaatgcatgctaagaaatattagaaattttcatttactttttttttctatttgagcttgctgcacctgcctttaattctccttagacataatggtgatttgtaaatgcattttctcctgtagtataaaagagagagttagcagtatcagatacattctaaggttatggttacattaaataatcccataacacagaatcatgttacttatttacatgctgtccatataattaatagatgtgtgctttattgagtaattcttatctcaaattctctgaatataacagtggatgtacattctctatatataaagtgattttactagcatgattggttagatgtataggatgaggtaaataagatgtgaacataatttaaacatataaagaagcttatttcagtaaacacttagaaattagaaaaattccttggtcatagcagacacacattttatatctgtgattaaaatcttgtcttatgaccctgacttttacactcaccatagtacatttaagccaatgaaactttaaagaagatggctcatttgcagacataaattggttctact

SEQ ID NO: 179330 - DNA, 601 bp, Human
tacatactaacaatgcatgctaagaaatattagaaattttcatttactttttttttctatttgagcttgctgcacctgcctttaattctccttagacataatggtgatttgtaaatgcattttctcctgtagtataaaagagagagttagcagtatcagatacattctaaggttatggttacattaaataatcccataacacagaatcatgttacttatttacatgctgtccatataattaatagatgtgtgctttattgagtaattcttatctcaaattctctgaatataacagtggatrtacattctctatatataaagtgattttactagcatgattggttagatgtataggatgaggtaaataagatgtgaacataatttaaacatataaagaagcttatttcagtaaacacttagaaattagaaaaattccttggtcatagcagacacacattttatatctgtgattaaaatcttgtcttatgaccctgacttttacactcaccatagtacatttaagccaatgaaactttaaagaagatggctcatttgcagacataaattggttctactgcctgcaactatttaggttttatgt

SEQ ID NO: 179331 - DNA, 601 bp, Human
cgtctgtttaacagtcagaaatactaaagtctacttgaatcttacccttgctttctgtcctttctctggaatgaagaccttgccctgggaatcccagttctcactgggacaatgaatatcttagttcaagctgctgtactaaaatagcacagatagggtgggttaaacaacaaacatttatttctctaaatctaggggctataagttggagattaggatgctagcacggttgggtgactggtaagggccctctttttggttatgtactggcatggcctttacttggtgcgcacacacacayacacacacacacacacacacacacacacacacacaaatctggtgtccctttctctttttataagggcagtaatcccatcacaggtgtttcaccctcataacgtcacttaaacctaattgctccccaaaggccctacttccaaataccattactttgagggttaggaatttaacatagcaatttagggaggacacaagcattcagtgagctttctgggtttaacagagaagacacctcatggataggacaagtacagaatttccacagcgtgaggggacagcaagtcatctgccacaaggt

SEQ ID NO: 179332 - DNA, 601 bp, Human
gtctgtttaacagtcagaaatactaaagtctacttgaatcttacccttgctttctgtcctttctctggaatgaagaccttgccctgggaatcccagttctcactgggacaatgaatatcttagttcaagctgctgtactaaaatagcacagatagggtgggttaaacaacaaacatttatttctctaaatctaggggctataagttggagattaggatgctagcacggttgggtgactggtaagggccctctttttggttatgtactggcatggcctttacttggtgcgcacacacacatccacacacacacacacacacacacacacacacacaaatctggtgtccctttctctttttataagggcagtaatcccatcacaggtgtttcaccctcataacgtcacttaaacctaattgctccccaaaggccctacttccaaataccattactttgagggttaggaatttaacatagcaatttagggaggacacaagcattcagtgagctttctgggtttaacagagaagacacctcatggataggacaagtacagaatttccacagcgtgaggggacagcaagtcatctgccacaaggtc

SEQ ID NO: 179333 - DNA, 601 bp, Human
cacacaaatctggtgtccctttctctttttataagggcagtaatcccatcacaggtgtttcaccctcataacgtcacttaaacctaattgctccccaaaggccctacttccaaataccattactttgagggttaggaatttaacatagcaatttagggaggacacaagcattcagtgagctttctgggtttaacagagaagacacctcatggataggacaagtacagaatttccacagcgtgaggggacagcaagtcatctgccacaaggtcttagtgtatctttcaggatattcaagacaaaaaaaaaactcagtgaagtctgtaacagctcagtatgatgtgatctcagcctcacactgttcatatggatctaatcctaaaacattggttaattcatttaaattaccaagtttcaatttcccattttgtaaagtgaaagagacatatctatgaattaaggcatactgaggttagggttgtaattaaattttttcaacaatatgaatcagccgtatggtacacaccaagccctcttctaggattttagtgtatagaattgaataaagcaaacaaacacccctgctttcatggacattggc

SEQ ID NO: 179334 - DNA, 601 bp, Human
gcttgccataataattatgcatcataaacacccaaaaacacagtgtcatacgataattatcacgttggaaactgctgatcaaagccaggtttgaataaggagcttggcttcaaacagcagtgcttgactcattggtatggatccagtaacacatataaccaggctgaagaggcaataagtacagagaggatatcatcttatggtgatggcagaagcacaagaaaacaagcccgacaacaaagacatatttaaagtgtttgttcacatcacatccaaaaatgtcatgtggctaagccaaacrtcagttcatcagggtaatacactagccttctatttggaggtcttttggagtgaaattttgctaaacagtttaatccatatcagacatatatgcttgtgggtgaaattttaggtagataaagaaaatatggtaagagagggacctgctgcaaatgtaggaaaagtacattccaggcagagggaacaagggcagattattcaagcaagagcaattctaggaaattcaagaggcagcgcagaggctaatgttgctgaagctgaataagcaagggtcagagaggaggggaagatgaggccatga

SEQ ID NO: 179335 - DNA, 601 bp, Human
acacccaaaaacacagtgtcatacgataattatcacgttggaaactgctgatcaaagccaggtttgaataaggagcttggcttcaaacagcagtgcttgactcattggtatggatccagtaacacatataaccaggctgaagaggcaataagtacagagaggatatcatcttatggtgatggcagaagcacaagaaaacaagcccgacaacaaagacatatttaaagtgtttgttcacatcacatccaaaaatgtcatgtggctaagccaaacatcagttcatcagggtaatacactagcsttctatttggaggtcttttggagtgaaattttgctaaacagtttaatccatatcagacatatatgcttgtgggtgaaattttaggtagataaagaaaatatggtaagagagggacctgctgcaaatgtaggaaaagtacattccaggcagagggaacaagggcagattattcaagcaagagcaattctaggaaattcaagaggcagcgcagaggctaatgttgctgaagctgaataagcaagggtcagagaggaggggaagatgaggccatgaagttaacaagctgccagatgttataga

SEQ ID NO: 179336 - DNA, 601 bp, Human
aaactgctgatcaaagccaggtttgaataaggagcttggcttcaaacagcagtgcttgactcattggtatggatccagtaacacatataaccaggctgaagaggcaataagtacagagaggatatcatcttatggtgatggcagaagcacaagaaaacaagcccgacaacaaagacatatttaaagtgtttgttcacatcacatccaaaaatgtcatgtggctaagccaaacatcagttcatcagggtaatacactagccttctatttggaggtcttttggagtgaaattttgctaaacartttaatccatatcagacatatatgcttgtgggtgaaattttaggtagataaagaaaatatggtaagagagggacctgctgcaaatgtaggaaaagtacattccaggcagagggaacaagggcagattattcaagcaagagcaattctaggaaattcaagaggcagcgcagaggctaatgttgctgaagctgaataagcaagggtcagagaggaggggaagatgaggccatgaagttaacaagctgccagatgttatagagatgtgctgtccagtccggcagccacttgttacatatggct

SEQ ID NO: 179337 - DNA, 601 bp, Human
tctagtggcttatttgagatatgctgtaagtgtaaagtacacaacaggttttgaactcttagaacaaaaaataaaggatataaaatatctcactaactatatctcactaattttgttacttatttttaatttatatggatatgtattagttgtatgtatttaagggatccatgctacattctaatgcaagcaaaagtgtgtaatcctcaaatctgggtaactgggatatccctcacttcaaacagttatcatttctttgtgttgagaactgtacgagtctgttctcacgttgctaataaargcataccgtagactggtcatttataaaagaaaaagatgtaatcaactcacagttccacatgggtggggggaagccttacaatcattgctgaaggcaaatgaggagcaaagtcatgtcttacatggtggcaggcaagagagtgtgtgcacgggaattccctttaaaaaagcatcagatgttatgagacttactcagtatcacaagaacagcactggaaagacccactcccatgattcagttacctcccaccaatccccttccatgacacatgggaattatggtagctacaattcaagatga

SEQ ID NO: 179338 - DNA, 601 bp, Human
gggaacattctaagtcttatagctattttgacatatacagtaagttattgttaactatagttgccctcttgtgctaccaatcactacgtcttattcctcctatctaactgcaattttgtacccattaaccaatctctcttcatttttccctgctcaatatcctttccagcctctggtaaccaccattctattcttcctccatgagatcagttttttcagctcccaaatataagtgagaacattgtcttttaccgcctgacttatttcactcagtgtcctctggtttcgtctatattgctgyaaataataagatttcattctcttttatggctgaataacattccattgtgtacgtgtctcacattttctttatccattcatgcactggtgaacacttaggttgattccatattatggctattattattattatgaggcggagtctcactctgttgccaggctatagtgcagtggcacgatcttggcttactgcaacctccacctctccggttcaagctattctcctgcctcagcctcccgagtagctgggactacagtcacgtgccaccatgcccagctaatttttgtatttttagtagcg

SEQ ID NO: 179339 - DNA, 601 bp, Human
ggctatagtgcagtggcacgatcttggcttactgcaacctccacctctccggttcaagctattctcctgcctcagcctcccgagtagctgggactacagtcacgtgccaccatgcccagctaatttttgtatttttagtagcgacaggctttgaccatgttgaccaggatggtctctatctcttgacctcatgatccaccctcctcggcctcccaaagtgctgggattacaggtgcgagccaccgcgccacctggctattatttttttttatattgactacgtgttgaaattataccactstaaatatattggcttgcattatgttattacaattaatttgacctttattctgtttctttttcagtatggctcttagaaaatttaacattgcataggtggctcccattgccattgtctatattagacagcactaatatagagctttataatatcaaggaggactttgaaaaggatgagaggccactggagagttctgatcggaggtacaagcagtcttctcagatcatattttaagtgaatgacctttgcttcagagctgagaatagactgaaaggggtacaaaggcagaagcaagggagg

SEQ ID NO: 179340 - DNA, 601 bp, Human
tttttatattgactacgtgttgaaattataccactgtaaatatattggcttgcattatgttattacaattaatttgacctttattctgtttctttttcagtatggctcttagaaaatttaacattgcataggtggctcccattgccattgtctatattagacagcactaatatagagctttataatatcaaggaggactttgaaaaggatgagaggccactggagagttctgatcggaggtacaagcagtcttctcagatcatattttaagtgaatgacctttgcttcagagctgagaatrgactgaaaggggtacaaaggcagaagcaagggagggacaccagtagggagactattgcaagacatcaagtgcatttcatagtgttattgtaatttacatcaccttaacataaatgtatataactattagtgaacatcgttttaaaaagaacaaataacatattcagtatatattaattagaatggattacattaaagacaagaattgagtttgttatatatttttctttattcaaatcatttcaagaatttataaaaacaactcgactgtatttttaagaaatgcatgcaattctagaaa

SEQ ID NO: 179341 - DNA, 601 bp, Human
aatttaataatatttagtcgagtgtggtagtgcatgcatgtaatcacacctcctcaggaggctgaggcaggaggatcatttgaacacagacgttcaagaccagcctgagcaatacagcaagaccccatctcaagtaataatagtaataatagaaataataataatatttattgtacaacactagaaatagactgttagtatttttcaaacatgcaaataattgaacatacttacaaatatttcaataagtctagggaaccggaatctacttatgtagaatagcttagaaagcatcataaaytaacatacaacttaatgtgcttataagaaaatatgtgtcatagatagtatacaaatgagcaataagagaaaaaactctttgaaaggtaacatcatcacagtattttgaagtagaacctaaggaggagataatattgaatctgagtctaatacaacattaaaacaataatgatcagataataattaatctgaatcaaatgtgatattaaaacatacatgactaattcagattagtgtatttattcacatagatcccttcattgcaaatttacagctcaccaacactaacatgtcttctctc

SEQ ID NO: 179342 - DNA, 601 bp, Human
tgtatttattcacatagatcccttcattgcaaatttacagctcaccaacactaacatgtcttctctctgctttagtattgtggacatgaaaaatttcctgcccttggaatgaagatgaaggcttaatcagagcaaatctcctctttaaatcattatttttagtactcttggtatctcagaattcttcacatgcaacagaatttgaaacattgctggttaggtacaagttattttatgataatcctctttgtttaaatgatctttgatgtttcttgggctgctaataattttgctaagattrtaagagcaattatcaatgagttcagtctaatgccaaaaaaaaattcttatttttaaaaaacttttaaattcaggggtacaagtactggtttgttacacaggtaaacctgagtcagagggtttgtgtgtctgtgtgtgtacagattatttcatcacccaggtattaagcctagtacctattagttatttttcctgatcctctccacctcccaccctccaccctttgatagttcccagtgtgtgttgttcccctgtatgtgtccatgtattctcatcatttaactccaacttataagtgaga

SEQ ID NO: 179343 - DNA, 601 bp, Human
accaacactaacatgtcttctctctgctttagtattgtggacatgaaaaatttcctgcccttggaatgaagatgaaggcttaatcagagcaaatctcctctttaaatcattatttttagtactcttggtatctcagaattcttcacatgcaacagaatttgaaacattgctggttaggtacaagttattttatgataatcctctttgtttaaatgatctttgatgtttcttgggctgctaataattttgctaagattgtaagagcaattatcaatgagttcagtctaatgccaaaaaaaawttcttatttttaaaaaacttttaaattcaggggtacaagtactggtttgttacacaggtaaacctgagtcagagggtttgtgtgtctgtgtgtgtacagattatttcatcacccaggtattaagcctagtacctattagttatttttcctgatcctctccacctcccaccctccaccctttgatagttcccagtgtgtgttgttcccctgtatgtgtccatgtattctcatcatttaactccaacttataagtgagaacatgcaataattggttgtctgttcctaagttagtttgctaag

SEQ ID NO: 179344 - DNA, 601 bp, Human
gctttttatcaaatgattgttggccacatgtatgtcctcttttgagaagtgtctgttcatgttctttgcccactttttaatggggttggtttttttcttgtaaatttgtttaagtttcttagagatgctagatattagacctttatcaaatgcatagtttgcaaacattttcttccattctgtaggttgttttattactctgttgatagtttattttgctgtgctagaagctctttagtttaattataccccgtcaatttttccttttgttgcaattgcttttggcatcttcatcatgaartctttgcccatgtctatgtcctgaatgatattatctaggttgccttccagggtttttatacttttgggatttacatataagtctttcatccatcttgagttaatttttgtatacagtataaggaaggggtccactttcagtcttctgcatatggctagccagttatcccagcaccatttattgaatagggaatccttttcccattgcttatttttgtcaagtttgttgaagatcaggtagttatagatgtgcattcttatttctgagttcccaattctgctccattggtctatatgtctg

SEQ ID NO: 179345 - DNA, 601 bp, Human
attctgtaggttgttttattactctgttgatagtttattttgctgtgctagaagctctttagtttaattataccccgtcaatttttccttttgttgcaattgcttttggcatcttcatcatgaaatctttgcccatgtctatgtcctgaatgatattatctaggttgccttccagggtttttatacttttgggatttacatataagtctttcatccatcttgagttaatttttgtatacagtataaggaaggggtccactttcagtcttctgcatatggctagccagttatcccagcaccmtttattgaatagggaatccttttcccattgcttatttttgtcaagtttgttgaagatcaggtagttatagatgtgcattcttatttctgagttcccaattctgctccattggtctatatgtctgctcttgtatcagtaccatgctgttttggttattgtagccctgtagcttttctgtgattttttccagatagtataaaatgtttaatttctatgatgcaaatactagggcgatcaatgctaaaacggttgtcctgtacaattttttcttaccataccaaaattttttcttatgactgt

SEQ ID NO: 179346 - DNA, 601 bp, Human
tttgtcaagtttgttgaagatcaggtagttatagatgtgcattcttatttctgagttcccaattctgctccattggtctatatgtctgctcttgtatcagtaccatgctgttttggttattgtagccctgtagcttttctgtgattttttccagatagtataaaatgtttaatttctatgatgcaaatactagggcgatcaatgctaaaacggttgtcctgtacaattttttcttaccataccaaaattttttcttatgactgtttattttaattattttaagagatctttattaacctartaagtattggatatgtaaaatttaaagataatatcttaataaaccaagattttaattttatttggatatatgcaggtttgttttgaaaggcaaattctgaaaaaacaggcattatattatttatgaaacaacttgaatactgatatatctatatcaccagtaattcttcctttgataactcagaagtttttatgaaagaggttcatttaatctttgttttctaaatacataggtgaaattatacttaaaaatgatacagctattcatgaaaaattcaaatatataacataaccaatagaa

SEQ ID NO: 179347 - DNA, 601 bp, Human
caccttacttatcaaatttttcttatgaccagtaaatgttttatcatgaatgaaagtcaaattagagagaaagccagtatgtgctaagaagtcacatataggtattccttaataaaaattactcttgtgactcaaggatcataaaatatgctgagatgtatgcataacttggctgtttaaaattagaacaaaaactgcatatccagtgttatggttaactggaaataagcacacatctaatttagtattccacatagccattagaattcccatggtacatggactgaatccagttaattgycatagctttttctacatatgacagaacacagagaactggatctatgaaatcattaattgaattaccctttaaatgtgccaaaagatatattagtttttactcccttggtagtttccctcagcataaatcaaatgagaaaatttaaatgactgaaaaaaaagaacagtgagtgttacaggttattttaaatgtgcagttagaccttagttaatttaaggggccagctttttttttttttttttttttttttttttttttttttgagacagagttgcgctctgttgcccaggctggactgca

SEQ ID NO: 179348 - DNA, 601 bp, Human
tagtattccacatagccattagaattcccatggtacatggactgaatccagttaattgtcatagctttttctacatatgacagaacacagagaactggatctatgaaatcattaattgaattaccctttaaatgtgccaaaagatatattagtttttactcccttggtagtttccctcagcataaatcaaatgagaaaatttaaatgactgaaaaaaaagaacagtgagtgttacaggttattttaaatgtgcagttagaccttagttaatttaaggggccagctttttttttttttttttttttttttttttttttttttgagacagagttgcgctctgttgcccaggctggactgcagtggtgcaatcttggctcactgcaagctccgcctcccgggttcacgccattctcctgcctcagcctccagagtagctgggactacaggtgcccgccaccacacccgctaattttttgtatttttagtagagacggggtttcactgtgttagccaggatggtctcgatctcctgacctcgtgatcctcctgcctcggcctcccaaagtgctgggccagcttctttacaaaataattataaagg

SEQ ID NO: 179349 - DNA, 601 bp, Human
ttctacatatgacagaacacagagaactggatctatgaaatcattaattgaattaccctttaaatgtgccaaaagatatattagtttttactcccttggtagtttccctcagcataaatcaaatgagaaaatttaaatgactgaaaaaaaagaacagtgagtgttacaggttattttaaatgtgcagttagaccttagttaatttaaggggccagctttttttttttttttttttttttttttttttttttttgagacagagttgcgctctgttgcccaggctggactgcagtggtgcaawcttggctcactgcaagctccgcctcccgggttcacgccattctcctgcctcagcctccagagtagctgggactacaggtgcccgccaccacacccgctaattttttgtatttttagtagagacggggtttcactgtgttagccaggatggtctcgatctcctgacctcgtgatcctcctgcctcggcctcccaaagtgctgggccagcttctttacaaaataattataaaggtctaagaaagacaatctattacaatagatataacactggattgaagtccaaatttctgtgtctttaga

SEQ ID NO: 179350 - DNA, 601 bp, Human
gttggccatgggtaggcctggaaaaagcaccagaagttatcactctgggccacgattccacccagaacttatagccctaactccaggcttcaggctctccttggcttgaaggtggaccctcagctttctgcccagaaggctgtctgcctcctgctgccatcaacatgttgtatatggcccccaggctgttcatgccaaggggtgcctataggcccctgctgagccacatttagtcttccctcagcctccctcctatgctcctaggtgcccaatgtccagagggggttgaggtagcaggggkctggtgtgtcagcacctccttgagtgtgcacacacctaggtgggatgggacggcacctgggctgggccacaactttgctccaaaatcggagcaggcaccaggaatggagagaggtcagggatgggagcaggcacttcccagcctttgggggaagggggagttcctcacctcctgagagcagagcgcgactgtgcggctgcacatgcaccagggagtgcagggctcccaccccacctactcggtaggaggcagggcttcttcctgttcctggcccctgccggctctgtggagtgcacaaac

SEQ ID NO: 179351 - DNA, 601 bp, Human
ggctgcacatgcaccagggagtgcagggctcccaccccacctactcggtaggaggcagggcttcttcctgttcctggcccctgccggctctgtggagtgcacaaacctggccagacctccccaactgcagctggcatcttcacagtggctgctccagatgggctgccactgccatcacaaccactatggaaaactgtgtggagattccttaaagaactaaaagtagatccactatttttccaacaatgccactactgggtcattatatgaaataaacacttgcacatgcatgtttatagcrgcacaattagcaaatgcaaaaatatggaaccagcccaaatgtccattaatcaatgagtggataaagaaaatgtagtgtgtgcgtgaatactattcagccatatgaaggaacaaaataatggcatttgtagcagcctagttggatttggagaccattattctaagtgacgtaactcaggaatggaatgccaaacatcaaatgttcatactcataagtgggaactaagctatgaggatgcaaaggcataagaatgatacaatggactttggggactgaagggaaagggtgagagtagggtga

SEQ ID NO: 179352 - DNA, 601 bp, Human
gtgagagtagggtgagggataaaatattagacactgagtacagtgtatactgctcaggtgatgggtacaccaaaatcccacaaatcagcactaaataacttatccttagaaccaaacaccacctgttccccaaaaacctattgaaataaaaaattaaaattaaaaagaagaaaaaaggtgattaggcagattgagacagctagtacaaagcaccgaaagcacaaaagagttcgggatgattaaggtttaagaagaagagttaatttaaatgtatgcaaggtcacaaataagcctaggttaktttatgtgaagctttgtaaagagtcataaaagtttggatttaaggagtgtgaataggatctttaaaaggttttaagcaggatagttacatttgcttaaagtagaaactggtaggtgagtaagtcagcaaggggcttctaaaactgaccaggtagtgactatgaactgggcaagagagctcatactaaatattgagagacatgaatgatatttctatatattgtgctttagtggtgagaaatcaatgacaaagcttttaaaattgacaccctattataaccaaatctaagttcagctgctc

SEQ ID NO: 179353 - DNA, 601 bp, Human
gtagaaagcttgcattaagcaagtaatcaagtcaagaaatctcatactgcaggagaatgcagtgatcagtactgactccaagttcacctctaaatctcagaataagaaaaaaaagaggcagggagggggcatttatcaaaacaagtataacttggtaccaagtccaaagacatgctttaaattgacaccctattatagtttctttggtgtctcctagtatggaaaggattgggctggaaataagcttgtcctgaatgaaacattgaggaaggtgacacattcagatgctggcatatgttaytgtttcatgtgatgctggcaatgtaatgtcagagattcagtcaagggcatggatttaagaataaatgttctaggtcagacttctgcctgtacagctgccatttaattaaatctaaataatttatcattagggatcatttcattgtgataacagctaaaagagcatagttccttgtttttaatgtctgtagacacattacatcttgtttgcagtattccttttcttatggtctatatagtaatgcacaatttttattaattatatacttattaagaagattttggagtcttaagataatac

SEQ ID NO: 179354 - DNA, 601 bp, Human
ctgccatttaattaaatctaaataatttatcattagggatcatttcattgtgataacagctaaaagagcatagttccttgtttttaatgtctgtagacacattacatcttgtttgcagtattccttttcttatggtctatatagtaatgcacaatttttattaattatatacttattaagaagattttggagtcttaagataatacatttaccaccaaggactactgcattatttaccctcatgtagtctctttttgtctgtttgaaagatattcacttattaaaatatttaccaaaaacttttttttttttttttgagatggagtcgcccaggctggagtgcactgatgcaatcttggctcactgcaacctccatctcctaggttcaagtgattctcatgcctcagcctcccaagtagcagggatcaaaggcaccttattgtacaaacatatgcgtatcaatgcctgcatttgtatgtagtaaactacaccagaggcttttataaacatgaaataattattatcccaagtggcttacatagttctttagaaaggcaaatgccaccttttatatggactagtgctactttatgtatcctaa

SEQ ID NO: 179355 - DNA, 601 bp, Human
ctcaatgaaaaaaatgtgaaaaaagcatacacaatatgcctactgccaaacacgttagtattaacaatgatgggagcattgtaatatattttaacctcttaatgcctcagcagagacttgggaagaggtaacaacctaatttcttcataaatgtcctaattgaaagttgattatagaacctaactttggcgaggtccagatgcatattcctgatgtaaaattatacagtaaaagtattttaaaataaaaagtataatttaaaaagtgtctttaaaatcaattattatatttgaagacgttrgtaagtatacttatttgggtattctttcttgagatgtcaaatgacattttccattattttaggcaaatatgttttaatgcagaagtttacttgttatgatcaagggcaaaagttctatgaatcaatttatttgtaatttcttaatcacaactgtgctagggagtacaattttgaaattcacctttgaaatccaaatcttgtctgtaaacaatattgcaacaaattttctacactagtttaacaatatttcttattaattcaaaatggaaggcattttaacatttctaaactacaatctag

SEQ ID NO: 179356 - DNA, 601 bp, Human
caagataaaaatgtttccatgcctattgccttttttctttcatatatatgtgaaagaatatagcataggcaaaagtatctttccacttctgcttatgctatattcttttctcctttttcccctgtatgtgtttctctaaccaccagtgtttatttcctctgtacatttgaaacctttcatgatgtaaagggccttcctgattttgaaaatgactatttttggtacaccaacatgacatatggctacattcttcagccacttcagatggtgctatgcaagagtcacatccctcataccacastggcccagtaccaagttgttaattgcattgacatgctaatcttgtgccagtgaatatcgctgccttgctactgtattgatatttacaaagcatatcctgtatagacatttagtttctgttttattatagaccggcgttatcaatattttcttgcttgataccacaaatacattttttaatgtggctttcagtatagcatgtattgcctgtagcaagtattgcattcaacactgataattctgagtaaaattcacactgagatcatcaggcaagcaattagtggcaattgctttctgttat

SEQ ID NO: 179357 - DNA, 601 bp, Human
gattattccttccttacaaggttattaaaaatattaaatataataaagtatataaacaacttaccttcatatagaaatgattcagtaagcatttcagacttgtatgtgagattgtcattaaaaacattcattaaagtaaaataggacaaggacttctaaatgattacttctgcatttgtactacagataagttacatatctgatatttatataattagtagatataacaaaactggatattgcttttttaagtagtttgcagtaataaaatatttaaaagttaaatgacttaaattgatawtttttgatgtgatattaagttctaagtagttaatattagtaacaataatcagcataaatatgagcaaaattttagctacagcttacttgagaattatgctttcatgtaaaaataattataaaatcttctcaaataattatgcaggcaggaaattgagaggttacaatatttggcatttgatttagatcgtagtcctggggtggaggaagagtgaaaacaacatttgtatgttttcacatttagatttttaaataaaattatacattgttttctcttaacttctgtgatagagatctagaa

SEQ ID NO: 179358 - DNA, 601 bp, Human; identical to SEQ ID NO: 30498

SEQ ID NO: 179359 - DNA, 601 bp, Human; identical to SEQ ID NO: 30499

SEQ ID NO: 179360 - DNA, 601 bp, Human; identical to SEQ ID NO: 30500

SEQ ID NO: 179361 - DNA, 601 bp, Human; identical to SEQ ID NO: 30501

SEQ ID NO: 179362 - DNA, 601 bp, Human; identical to SEQ ID NO: 30502

SEQ ID NO: 179363 - DNA, 601 bp, Human; identical to SEQ ID NO: 30503

SEQ ID NO: 179364 - DNA, 601 bp, Human; identical to SEQ ID NO: 30504

SEQ ID NO: 179365 - DNA, 601 bp, Human
ttcctgacttttaaaaaattaaattatatttcaagtaaagagagaatcctgatgaaaaaattaaaaagcaaaacactctgagaaaaaatgaactataataatatattttaaacttttagacttgaaagtacaaagagctatcttacttctgaaggaaaatagaaaattgaaggttacataaatttgttgaaaatattttattttgtatgtatatgttaatattctagttttacctctaaaacttaaagatatagaaataacaacatatagaataaaaaattcatacaaaccagaaagccaratattgtttacttatttataaaatttgccattatgttttacaagactgataaggaatcctaaaatacattttaaaaaatagtttatgtagctcaaatggaaaaaatgtgatttacagtcttctaagactaggtaaagtaatatcagaaaattattgtaatattatattttaacagacttaaaagcatctgtaaagaaattttataaccttttcaggtagagattttatttataactttaattttatattaagttcagaaaaatgttcatttttactgctgtataaatatattctaaatat

SEQ ID NO: 179366 - DNA, 601 bp, Human
tcaggattagcctgtataagtcatccttgagaacagagattggcttacaggttaaactggatcaattgaatagaattctaagatatggaattatggccgatctactggtctgtgtacctagattttatcttagccagacctttgctccataacacttgaaagcatgttaaaattagttcatttggtatcacactttcttcacctaaatataacggcaggattctttaacataatcagttttatgatctagcctggacaagtctacatcttgatttttcaaagaactcattaagcaaacagkgatattcagaaactattcataatatattcttggttttctcattctcatattgctatgaaggaaaggaaatcaggataacttgacattattttcagagaatccatgtttgcatcaattcctaatcactttttaattcattcactcaaaaaatataatgaatttctagtaggtaccacacattgttctagatcttgggaatctgaaggtaaataatacatggcatctggtctttacacataagttggagttcaaaagatataaggttgctgtagaagtgtgaatcaaaggtttgggagaaca

SEQ ID NO: 179367 - DNA, 601 bp, Human
agggtatattgtatgagaagaccagtgttggtaatgtgcttagagaggtagagagaagttaagttatagatcttaaaaacattcatcatgtttgcagggcaaggtggtttacgcctgtaataccagcactttgggaagccgaggcgggtggatcatctaaggtcaggagtctgagaccagcctggccaacatggtgaaaccccatctctactagaaatacaaaaaaatattagccgggtgtggtgatgggtgcctgtaatcccagctactcgggaggctgaggcaggagaattgcttgaayccaggaggcggaagttgcagtgagctgagatcacaccattacactctagcctgggcgacaaaagcgggactcttcctcctccaaaaaaaaaaaaaaaaaaaaaaaaaaaattcatcatgtttacattctgtctggtatacaacgagggaaatttggagatttttattcataaagcaacatgattcatgtatcttagaaaattatcttggtggtgttctagagacagatttcaacatagaataaaatgtacgtatgtaactaacctgcacgttgtgtacatgtaccctaaaatttaaagta

SEQ ID NO: 179368 - DNA, 601 bp, Human
cactcttcaaaatttttttctggctcataatagctctaaattgaatgtttgaatggttcattgtgttatatttgatttgcttatgacccattgttgaaatgcccagtactaaagataagtgaatctgggtgtccgtgagttgtgagaagagtcaagacatactcatatttggaggaaataatttccattgatatcttggtagtgaatgaacactgctatggagaatattagaggtaaaaatgggaaaaccaaggtcagatctctggacaacttcagtttaattcatggatgtataagaacaaaaaaaaaatgaaagaaatttttcagggagatagtgtatctattttgaaggataaatgtaaatataattggtcaaatattgtgaaaaagtctaaataataatttggatttggcaattggtaaaaactaggtgagtagtgaaatgagaaggaatttacagcatttcagatgtattgcaggttggctatataatattagattaagctcacaatgtttcttgctctattctggatgctatagcaaaatatattagactctgtaatgtattaccaacataaatatattgcttacagttctaggg

SEQ ID NO: 179369 - DNA, 601 bp, Human
tatgttctgtatctttgtatataatttttcattactgaaatatttaattcatcaagtatttcctgagaacttactatattccagtcactttgttctatgttacatgtatctatctgtatgcatgtataaatacatgtgtgcgaatgtgtgtttgtaaagtgttttatctctttcctcaagaaacttacaatttagtagtcagttgacagttggacttataaaaccaaaatgtaaaaaatatttagaaagagaatgaaagtcataagcatgcttttgctttaaaagaagtaatagaaataakaggccagtggaaaataatatgaaaaaaaggctacagtaagtgtcagcagatctgaaaacggactatataactagaagagactaggcactggcccatgttttgatgatggtggctttgtgctgaaagaaaaaacaaaggctcttctttctctgcaggtgcaccatgtcagggtgcacagttggtgaatggtgcaacctctgcagtcagagtaaaaacaaacaatcatgtttataccatatattcaaagatggaagcccaagaggatagataatatctccctctcatcccccagaatatact

SEQ ID NO: 179370 - DNA, 601 bp, Human
agagcttcttttcacttacgtaaaatttcatcgtcttatgaaaatgtagtttgttttctcattaggaggagacaaaactaaagcaggaaataataagaattaccagcgttggcctctgttgtttaagacacagaaccatactgagtgttccaaaagggaagcataaaatagtgaggaaattaatgttccataggtctgttctatgaggatcctaccttgaccctaacacatatggtgtaggggttcagtaaaaagcaagagccttcctgagaaagaaagagggaaccaattctagtgaacrtagagagaaagcaaatgaaatcatcctggtctcatctgtgttgaccctactttatcagtttgcactgagcataactatgggtttttgatagaagtatcagaaacattaatcagtcatctatcatgtaccatatacttcaaataatgttctcaaactgatgagctcatattatttattttaattatgaaatacttggattatattatctgtgcacattgtgtggtttaggagagatttataaagacagtgccccccaaaaacaatgagtgagacgaaggactatagtttttttttaaaaaa

SEQ ID NO: 179371 - DNA, 601 bp, Human
tccaaaagggaagcataaaatagtgaggaaattaatgttccataggtctgttctatgaggatcctaccttgaccctaacacatatggtgtaggggttcagtaaaaagcaagagccttcctgagaaagaaagagggaaccaattctagtgaacatagagagaaagcaaatgaaatcatcctggtctcatctgtgttgaccctactttatcagtttgcactgagcataactatgggtttttgatagaagtatcagaaacattaatcagtcatctatcatgtaccatatacttcaaataatgtyctcaaactgatgagctcatattatttattttaattatgaaatacttggattatattatctgtgcacattgtgtggtttaggagagatttataaagacagtgccccccaaaaacaatgagtgagacgaaggactatagtttttttttaaaaaattattaacctggatgcaggaatattgtgctactttaaattttgttttgttttattttattaaaagagagaaagggccaggagcggtggctcatgcttgtaatcccagcacttttggaggctgaggcaggtggatcatgaggtcaggag

SEQ ID NO: 179372 - DNA, 601 bp, Human
ttaaaagagagaaagggccaggagcggtggctcatgcttgtaatcccagcacttttggaggctgaggcaggtggatcatgaggtcaggagaccgagaccatcctggctaacatggcgaaaccctgtctctactaaaagtacaaaaaaaaaattagacggatgtggtggcaggcacctgtagacccagctactcgggaggctgaggcaggagaatggcgtgaacctgggaggtggagcttgcagtgagccgagatcgcaccactgcactccagcctgggcgacagagcaagactccatctcaataaaataaaataaaataaaataaaataaaataaaataaaataaaataaaataaaaataaaagagagaaaaaggagggtggtaggtgaaaaacagaaggaaaaaaggcattatttcctaaactgcataaaactcagtgtttgtgctcaagcacaagcacacagaaaattaatattaagtctgaatattatagaaattgaacacggcacaaaagtgctgctgcaccctagccctgccaaacccaggaaaaggttaataggctccctccagacttcttgcaaaggtgcagcacgatggagaa

SEQ ID NO: 179373 - DNA, 601 bp, Human
ctaacatggcgaaaccctgtctctactaaaagtacaaaaaaaaaattagacggatgtggtggcaggcacctgtagacccagctactcgggaggctgaggcaggagaatggcgtgaacctgggaggtggagcttgcagtgagccgagatcgcaccactgcactccagcctgggcgacagagcaagactccatctcaataaaataaaataaaataaaataaaataaaataaaataaaataaaataaaataaaaataaaagagagaaaaaggagggtggtaggtgaaaaacagaaggaaaaaargcattatttcctaaactgcataaaactcagtgtttgtgctcaagcacaagcacacagaaaattaatattaagtctgaatattatagaaattgaacacggcacaaaagtgctgctgcaccctagccctgccaaacccaggaaaaggttaataggctccctccagacttcttgcaaaggtgcagcacgatggagaatttatagtgcccttgatctggccaagttgatcaaggtaaaaatcctgacattttatcttacctgtccatctgtcagaggcagatcactatgtttataaaactgaaa

SEQ ID NO: 179374 - DNA, 601 bp, Human
aaacagttcagccatgcacagtttaaaacttataataatgtttaattttgcattcacattgtctctggcctccatgaaagataaacctcaacctggggagcttaatggtgaaatgaactgcatcttgtcttgggaaggtgaaagagatcaaatacctcatgtttctggtgctgttgacctcattgggctgtcgctgtcacctgccctctgtgggacaggcatctaagtacctgccccttggggatgtgtgactggagtgcaagcacaccagaaggagatagaatatttcatttttggagayagaatattcctttttggagacagaatattcatcatggggtgctgcttagcttgagctctttatacctttcctcaccctttacttcagcaggatttcttttaagtgtgaatgtcacccactaacattatgcaatttccacttgaccaagagaaatgctccacattctcacttagctaagatgtaagaaactgcatttctttgcagctgatctctttctcattttctttctcctcattttaaagagacatagtagatcaatcctctgtaaaagcagaagtccaaatttccaaattgcgatgc

SEQ ID NO: 179375 - DNA, 601 bp, Human
gggaaggtgaaagagatcaaatacctcatgtttctggtgctgttgacctcattgggctgtcgctgtcacctgccctctgtgggacaggcatctaagtacctgccccttggggatgtgtgactggagtgcaagcacaccagaaggagatagaatatttcatttttggagatagaatattcctttttggagacagaatattcatcatggggtgctgcttagcttgagctctttatacctttcctcaccctttacttcagcaggatttcttttaagtgtgaatgtcacccactaacattatgcmatttccacttgaccaagagaaatgctccacattctcacttagctaagatgtaagaaactgcatttctttgcagctgatctctttctcattttctttctcctcattttaaagagacatagtagatcaatcctctgtaaaagcagaagtccaaatttccaaattgcgatgcaaatatcatatctctcctctcatctcttgtgccaaacaattcagtgggttctgttcacctcttggacttaccttcacttactgggagggaagcatcactgcgctttcttctgggtggaagacttactagtt

SEQ ID NO: 179376 - DNA, 601 bp, Human
tgccccttggggatgtgtgactggagtgcaagcacaccagaaggagatagaatatttcatttttggagatagaatattcctttttggagacagaatattcatcatggggtgctgcttagcttgagctctttatacctttcctcaccctttacttcagcaggatttcttttaagtgtgaatgtcacccactaacattatgcaatttccacttgaccaagagaaatgctccacattctcacttagctaagatgtaagaaactgcatttctttgcagctgatctctttctcattttctttctcmtcattttaaagagacatagtagatcaatcctctgtaaaagcagaagtccaaatttccaaattgcgatgcaaatatcatatctctcctctcatctcttgtgccaaacaattcagtgggttctgttcacctcttggacttaccttcacttactgggagggaagcatcactgcgctttcttctgggtggaagacttactagtttcatcagtggattttttcctccgcctagttttctgcttacattgcggggagtgggaaggacagggggcatgggagttaattctcaaggcttgggttgcaa

SEQ ID NO: 179377 - DNA, 601 bp, Human
gggaaagaagctgagtaattccattgggaccacccctaacgttgtaagatatgtgtgtctggcacttattctttctttagccaagagatgtattattttgtaaagacatagtaaagatattcatcagaataacatgatttttgctgacagaaatatgaaatgtgatgttaatagtcataattatatttactgtaaattgacaggaatgatttgattattgaaacatatgacatagttttgactgaaacgttctactttaaccaaacatactttcattttgtttctgtgatttcaatgagtyactatgtcctttaaagtagcatttccaccttactcacattttcccatctgactgacttaggtccttttaatacttcccagaattattgttttaccctgaaccacttacaacatactttcacaatcagtccttgaaagtgctctcacagtaaaattccctcttcctccagaatgagtgactgccaagtggcactgtatttcagatgttatattgtattgtgcatattttaatatataacatattatattttatggtacttctcttacattataactctgaaggattttttctcctagttta

SEQ ID NO: 179378 - DNA, 601 bp, Human
tagtaaagatattcatcagaataacatgatttttgctgacagaaatatgaaatgtgatgttaatagtcataattatatttactgtaaattgacaggaatgatttgattattgaaacatatgacatagttttgactgaaacgttctactttaaccaaacatactttcattttgtttctgtgatttcaatgagtcactatgtcctttaaagtagcatttccaccttactcacattttcccatctgactgacttaggtccttttaatacttcccagaattattgttttaccctgaaccacttamaacatactttcacaatcagtccttgaaagtgctctcacagtaaaattccctcttcctccagaatgagtgactgccaagtggcactgtatttcagatgttatattgtattgtgcatattttaatatataacatattatattttatggtacttctcttacattataactctgaaggattttttctcctagtttataaactccatgagtggacctcgtatgccttgtttatgtcattgtttcaagtaccaaaagcatattagggtagagggaatactgaaatttggtggaggtaggagaatgg

SEQ ID NO: 179379 - DNA, 601 bp, Human
tttcagatgttatattgtattgtgcatattttaatatataacatattatattttatggtacttctcttacattataactctgaaggattttttctcctagtttataaactccatgagtggacctcgtatgccttgtttatgtcattgtttcaagtaccaaaagcatattagggtagagggaatactgaaatttggtggaggtaggagaatggaaaggattattttatagcacctctgactgggtcttaagtgaatccattatacatccccttccaataagtatgtgtctacagaagcaactttttttttcttttttttttttgagacagaatcttgctcttgtccaggctagaggacagtggcgtgatctcagctcactgcaacctccgcctgccgggttcaagcgattctcgtgcctcagcctccctagtagctgagattacaggtgtgcaccaccacacctggctaatttttttttttatttttgtattttttagtaaaaatgtggttttgccatgttacccaggctggtttcaaactcctgagctcaggcaatctacctgcctcatcctcccaaagtgctgggattacaggcataaac

SEQ ID NO: 179380 - DNA, 601 bp, Human
agggtagagggaatactgaaatttggtggaggtaggagaatggaaaggattattttatagcacctctgactgggtcttaagtgaatccattatacatccccttccaataagtatgtgtctacagaagcaactttttttttcttttttttttttgagacagaatcttgctcttgtccaggctagaggacagtggcgtgatctcagctcactgcaacctccgcctgccgggttcaagcgattctcgtgcctcagcctccctagtagctgagattacaggtgtgcaccaccacacctggctaatttttttttttatttttgtattttttagtaaaaatgtggttttgccatgttacccaggctggtttcaaactcctgagctcaggcaatctacctgcctcatcctcccaaagtgctgggattacaggcataaaccaccacgcctcgccagaagcaacttttaaatggaaactaaggttcaaagtgtttatgagagattaacacacttttgaaaagagtgaagatgaagcagaattcagccaatggagtgagctacagttcaggctccagtggtatgccgggagttgtcgttgttgttgttatt

SEQ ID NO: 179381 - DNA, 601 bp, Human
cagctttatttattctaatttatgtgagtttaatgtttagttacttttccttggtagtaaatatatatgattttgaatacacttattgatgtgtccaattctaattgctgatgtcaccacccagaagtaattatcagctcttggtggactgcaatgctatttaagatgaatattgtagcataaatactgtcctgttagtagattctaatcttaaataaatcattaacaaattcttattaattttaccttctcactgtgcacctggtcctaggtttaaggtacaatggaagccaggcctatyattatattctttttgaaggtttagctgaagccgtactaattatcccaaccaatgatgtgacatgaaactaattttcaaactgtaaggaattgtgaaccagtcacatatcaacaactcgaactatagagatatagaatgtgagtcagtgtgactcttcattttgagtgagaaacatgtatcacagctgtagcaagactttttggttggggaagctacaggatgtattcattgccaaatcatataatattttgtgggtttcatacacctcactggccacttaatgaagagaaaatactaatc

SEQ ID NO: 179382 - DNA, 601 bp, Human
attcaaaaaacaaattattcctatttctttaaatgatatgtgttgaaatgtttttatacctatgatacacattgtcaaagaaaactactcttgcatcctaataagcagctggggatgtacaaaatgtattcatttattcaagtatagaacacgtgtatgttcattcatatactgagtcattggtttcattagtgaaaaataagaggaggctaatgaaacttcccaaatctcttaaaacagaggaactgactcatggaatatgtgtaactcctactagcctagttgtgcagtcataaagttytgcgttagggctaaagttatggtagaatttctcttagtatatttggctcaacaaactttagttcgctgctgatgtagagatttcatgcttacatatttctaacagcttgacattttaaaaaatgtgtcattaaaataaccttttacttaaaaataatttgatttttatatatgagttcaaagatggtaccaaaagtattcagacacccttcacccaacctccccttataataacataccacagtacatgtatcaaaattaatgaattatcatgggtatattagtagtaaataaactacag

SEQ ID NO: 179383 - DNA, 601 bp, Human
atattgaaaataaataggcctggcacagtggctcatgcctgtaaacccagctcttagggaggccaaagtgggcagactgcttgagctcaggagttcaggaccaacctgggcaacatggcgaaacctcatattgacaaaaatacaaaaattagctgggtgtggtggcaggcgcctgtggtcccagctactctggaggctgagatgggaggatcacttgaacccaggaggcagaggttgcagtgagctgagattgcagcacggcactccagcctgggaaacagaaggaaatcctacaacagcracaacaaaaaaaagaaaagaaaagaaaagaaaaaacagagaaggagagaaaaagaaaaaagaaaagaaaaaaatggattaataagaatgcaaacatggaaaagttcatatcatttttacctgttaaagatttcagaaattctattcaacaagtaaaagctacatgtacttaccaagcttagtaaacattttagatgaattttacttttctgtttgtttaagacaatttttaggtagaaatataagtcaagttaacaatcaaactcatttgattgactcatttaaatgactcgaattagca

SEQ ID NO: 179384 - DNA, 601 bp, Human
ggcaggcgcctgtggtcccagctactctggaggctgagatgggaggatcacttgaacccaggaggcagaggttgcagtgagctgagattgcagcacggcactccagcctgggaaacagaaggaaatcctacaacagcaacaacaaaaaaaagaaaagaaaagaaaagaaaaaacagagaaggagagaaaaagaaaaaagaaaagaaaaaaatggattaataagaatgcaaacatggaaaagttcatatcatttttacctgttaaagatttcagaaattctattcaacaagtaaaagctacrtgtacttaccaagcttagtaaacattttagatgaattttacttttctgtttgtttaagacaatttttaggtagaaatataagtcaagttaacaatcaaactcatttgattgactcatttaaatgactcgaattagcagggtttcaaataaaaattaatgaaattcttcataaccctgtagtcttccaaatcaaaattttcaaacatacttttctctcttgctcatcatacttcactctcaatttgtagatttttaaattctggaagtgtttctgcttcagcagtagttaatatttacatc

SEQ ID NO: 179385 - DNA, 601 bp, Human
tttaagacaatttttaggtagaaatataagtcaagttaacaatcaaactcatttgattgactcatttaaatgactcgaattagcagggtttcaaataaaaattaatgaaattcttcataaccctgtagtcttccaaatcaaaattttcaaacatacttttctctcttgctcatcatacttcactctcaatttgtagatttttaaattctggaagtgtttctgcttcagcagtagttaatatttacatcaccttcaggtaaactttaatgcagttttcatgagaaacccatacatgtttcaygtctacaaaactaaaagacagttattattttacgaagcatggaataccaaaaacaaaaacaataccttttaagtgacatcctagtgaatctccatttgtcacgagacctcaagctttccagttctggcacaaagtgattactcataccatcacttcaaaatgatgattatcttcatttattttagttatattgaacaaaatatacatttaaaaaatctaattactaaatattctccaacaaatatatacttagtatatactattagtgatgcatgctttcaaatatttggactatatcaa

SEQ ID NO: 179386 - DNA, 601 bp, Human
attagtgatgcatgctttcaaatatttggactatatcaatgaatgaaacaaaaaattatttgcccttaaggagcttagattctaacagatggattcagatgatttttatgccttatttcgtaggtttaaaagagcaatggggaaaagggaagaagagagggattgaaaatattgagaaggttgggagacttagcaattttaagtaaggtagtgagggtaggttttattggcaaagtgatttttcagcagagactgggaaagatgaacgtggtatcctggaggaaagcctcccaggcagagttaagctgctaacaaaagtgcccttaggctggagtgggcttgtttgattaaggaacaaagaggtcagcatggttgcactagagagaaaaaatcagatggcgtaaggagatgaaatcagaaagatacgaggctaggcaaaggggtactctatgtaatgaacatgacctggcagtactgacatctcctgagggactgttagaagtgcagactcttgtatcttttctcaagtctatgaaatctagacttcattttaacaagatgacccgatatttacatacacattaaagttccagaagcactg

SEQ ID NO: 179387 - DNA, 601 bp, Human
ggattgaaaatattgagaaggttgggagacttagcaattttaagtaaggtagtgagggtaggttttattggcaaagtgatttttcagcagagactgggaaagatgaacgtggtatcctggaggaaagcctcccaggcagagttaagctgctaacaaaagtgcccttaggctggagtgggcttgtttgattaaggaacaaagaggtcagcatggttgcactagagagaaaaaatcagatggcgtaaggagatgaaatcagaaagatacgaggctaggcaaaggggtactctatgtaatgaayatgacctggcagtactgacatctcctgagggactgttagaagtgcagactcttgtatcttttctcaagtctatgaaatctagacttcattttaacaagatgacccgatatttacatacacattaaagttccagaagcactgatataacacattgtaagatcgcacaggacttcaattctttttctggtttttagaggcagtcctttggggtgttttgtgtagagtataatgacctgaaatatctaggatcactctagctactatcttgaggaaagagtgcaataaggcggaacagttcag

SEQ ID NO: 179388 - DNA, 601 bp, Human
tggcaaagtgatttttcagcagagactgggaaagatgaacgtggtatcctggaggaaagcctcccaggcagagttaagctgctaacaaaagtgcccttaggctggagtgggcttgtttgattaaggaacaaagaggtcagcatggttgcactagagagaaaaaatcagatggcgtaaggagatgaaatcagaaagatacgaggctaggcaaaggggtactctatgtaatgaacatgacctggcagtactgacatctcctgagggactgttagaagtgcagactcttgtatcttttctcaartctatgaaatctagacttcattttaacaagatgacccgatatttacatacacattaaagttccagaagcactgatataacacattgtaagatcgcacaggacttcaattctttttctggtttttagaggcagtcctttggggtgttttgtgtagagtataatgacctgaaatatctaggatcactctagctactatcttgaggaaagagtgcaataaggcggaacagttcagaggcaatggtggtcttctaaatgaaagacacacagcactcaaaccaggcagttgaggagggatgggaa

SEQ ID NO: 179389 - DNA, 601 bp, Human
tgaggaaagagtgcaataaggcggaacagttcagaggcaatggtggtcttctaaatgaaagacacacagcactcaaaccaggcagttgaggagggatgggaagaagttgtcaaattctagacatattttaaaggtagtgtccagagaatttccttagatgcgtaggaacatggaggataggacatagggtggaaataaacgaaataaagaaactgaagctgattctgacattttagacctaaaatctcaactaaaagttgccaagatgggaaaaactaggtgcatcttgtttggtgagtgkaaatcagccttgtgaattaagacttaaactgatgtctttaatcccgtagaaataccatgaaggcagtagaagatggctaaagagaggtctagactgtaggtacaaatttaaaagtcacttgcatttggatgcttaaagtcaggatattgtgaagtcaacagaggaataaataaatgcagagaggggaaagaaaaggcccatagactgagccattgtctggtttatttacatattagtatatattttcttaaagatgtttgctatataataatgagttacctaaagtgtgacttttctaaa

SEQ ID NO: 179390 - DNA, 601 bp, Human
gtcaacagaggaataaataaatgcagagaggggaaagaaaaggcccatagactgagccattgtctggtttatttacatattagtatatattttcttaaagatgtttgctatataataatgagttacctaaagtgtgacttttctaaatttatggggaattttctacattgtgttatggcactactaaaaataataaaagaaaatattgatatgagtctatgttacttgaaatattttttaaggggagatgtacctcaaaagatattccacaagaaatgatctttctctttatcccaccctygcccctcctacaaacactggattactttaactatacaaaaattttcctgctttctcttgtgggcatttagtgctataaattttcctctacacgcagctttaaatgtgtcccagagattttggtatgttgtgtctctgttctcaatatgcagccataaaaaaagatgagttcatgtcctttgcagggacatggatgaagctggaaaccatcattctcagtaaactatcacaaggacagaaaaccaaacattgcatgttctcactcataagtgggagttgaacaatgagaacacatggacag

SEQ ID NO: 179391 - DNA, 601 bp, Human
tacattgtgttatggcactactaaaaataataaaagaaaatattgatatgagtctatgttacttgaaatattttttaaggggagatgtacctcaaaagatattccacaagaaatgatctttctctttatcccaccctcgcccctcctacaaacactggattactttaactatacaaaaattttcctgctttctcttgtgggcatttagtgctataaattttcctctacacgcagctttaaatgtgtcccagagattttggtatgttgtgtctctgttctcaatatgcagccataaaaaaaratgagttcatgtcctttgcagggacatggatgaagctggaaaccatcattctcagtaaactatcacaaggacagaaaaccaaacattgcatgttctcactcataagtgggagttgaacaatgagaacacatggacagagggaggggaacatcacacaccggggactgccgaggggtgggagcctggggagggataacattaggagaaatacctaatgtaaatgacgagttgatgggtgcagcaaaccaacatggcacatgtatacctatgtaacaaacctgcacattgtgcacatgaacc

SEQ ID NO: 179392 - DNA, 601 bp, Human
tgtgtcccagagattttggtatgttgtgtctctgttctcaatatgcagccataaaaaaagatgagttcatgtcctttgcagggacatggatgaagctggaaaccatcattctcagtaaactatcacaaggacagaaaaccaaacattgcatgttctcactcataagtgggagttgaacaatgagaacacatggacagagggaggggaacatcacacaccggggactgccgaggggtgggagcctggggagggataacattaggagaaatacctaatgtaaatgacgagttgatgggtgcarcaaaccaacatggcacatgtatacctatgtaacaaacctgcacattgtgcacatgaaccccagaacttaaaagtataattttttttttcttttttcttcttctcttccctattgtgcttgctttctgtgttgtggaaaaatatattactgtgtatttttatgtatattagcagacatcttttataagcaatgagtaaaggattcatttggtccaatgacatgaatcaatgacaggtattgcatttttcaaatgctgtagcataccagatatgaagcttctttggataacagttctgatgg

SEQ ID NO: 179393 - DNA, 601 bp, Human
ttctgtgggatcagtggtgacattccctttatcttttttattgtgtctacttgattcttctctcttttcttctttattagactagttagtggtctatctattttgttaatttttcaaaaaaccagctcctggattcattgattttttggagtgtttttggtgtcactgtccccttcaattcttctctgatcttagttatttcttgtcttctgctagctttgtggttagtttgctcttgcttctctagctcttttaagtgtgatgttagggtgtcgatttgagatctttctagctttctgawgtagacaattagtgttgtaaatttccctcttaacattgctttagctgtgtcctagagattctggtacttcatctcttcattctcattggtttcaaataactttttaatttttgccttaatttcattatttacccaggagtcattcaggagcagattgttgaatgtccatttaattgtgtggttttgagtgagtttcttaatcctgagttctaatttgattgcactgtggcctgagaggctgttcgctatgatttcagttattttgcatttgctgaagattgttttacttccaattacgtg

SEQ ID NO: 179394 - DNA, 601 bp, Human
gatgtagacaattagtgttgtaaatttccctcttaacattgctttagctgtgtcctagagattctggtacttcatctcttcattctcattggtttcaaataactttttaatttttgccttaatttcattatttacccaggagtcattcaggagcagattgttgaatgtccatttaattgtgtggttttgagtgagtttcttaatcctgagttctaatttgattgcactgtggcctgagaggctgttcgctatgatttcagttattttgcatttgctgaagattgttttacttccaattacrtggtcgattttagaataaatgccatatggaactgagaagaatgaatattatgatgatttggggtgaagagttctgtagatatctattagtttcacttcatccagagctgagttaaagtcctgaatatccttgttgattttctgtcttgttgatttgtctaatattgtcattggggtgttaaagtctcccactgttattgtgtgggagtctaactctctttgtaggtctgtaagagcttgttttatgaatgtgggtgctcctgtattggatgcatatatatttagcatagttagctcttct

SEQ ID NO: 179395 - DNA, 601 bp, Human
aaagcttaacatcactgatcattagagaaatgcaaatcaaaaccataatgagataccatctcacactcgccagaatgttgattattaaaaagtcaagaaacaatagatgccagagaggttgtggagtaataggaatgcttttacactgttgatgggaatgtaaattagttcaaccatcatggaagacagtatggagattcctgaaagatctagaaccagaaatataactggacccagcaatcccattactgcatatatacccaaaggaataaaaattattctaccctaaagacacatgcayacgtatgtttattgcagcactatttacaatagcaaagtcacggagccaacccaaatgcccatcaatgatagactggataaagaaattgtggtacataaacaccatggaatactatgcagccatagaaaggaatgagaacatgtcctttgcagggacatgaatgaagttggaatccatcatcctcagcaactgacacaggaacagaaaaccaaacacctcatttcttactcataagtgggagatgaacaatgagaatacatggacacagggaggggaaagatacacaccagggcctgttga

SEQ ID NO: 179396 - DNA, 601 bp, Human
gccatagaaaggaatgagaacatgtcctttgcagggacatgaatgaagttggaatccatcatcctcagcaactgacacaggaacagaaaaccaaacacctcatttcttactcataagtgggagatgaacaatgagaatacatggacacagggaggggaaagatacacaccagggcctgttgagtgtgtgggggcaaaaggagggaacttagaggataggtctataggtgcagcaaaccatcatgccacatatatacctatgtaatgaacctgcacctgtatcctggaaattgaagtaaaaaaaataaataaataaataaataaataagtaaaataatcagtatttggtcttagctttaaactactatacagattttaaaatcttaatgagttacagtgcttttaaaatttttctactagagtattttctatgattacactatttctaacataaatgcccaaagaaaaaagactatcatttctaaatgactatatttcatatgataaaggagaaattgactataaaattcatctgactatgttaaatgaaactgcagtaaacttatgaattgcaaaaaagaagaaaagtaatccacactaat

SEQ ID NO: 179397 - DNA, 601 bp, Human
aatttaaaatttttttcttagagaagaggtcttgctgtgttgctcaggatggtctcaaattcctggcctcaagtggtcctcttgcctcagcctcccaaatcaccgggattataggcatgagccactgtgccctgccttagcctttcttttctgccttacctcatatcttttctctacataaatacttggcactttcatgtctgtccacttattatgtccaatatgcattttactttcttacagtcatgcatgaatttgtgttattcctcctccccatcatgtatgtatgtatgtatgtatacacacacacacacacacacacacacacacacacacacacacatatctcctgtcaccaaaggggattcccttttgtctttaatgttagaatacacagtagaagtagcacatgttacacacaggttaaatgctgcttttaatttaaagggtgggagaaagaagtaggaatatatatatatataggtccaatatattccaagcgtttatatgagaattcatgagattcatttttagtggaaatagttttctcttcctttggtaccctataggaactattgctcatacaggtattttgccagct

SEQ ID NO: 179398 - DNA, 601 bp, Human
tatataatatataatatataaaatatattatatattataaataaatatataatatatactatatatagtatatatattgtatatatattgtattgtacatataattgtatatatagtataatatatacaatatattatatattatatataaatatatatattatatatatttaatatgtattatatatttatatatcattttaaaaatataatatatattactttatatattatataatatatataatatataatatattactttatgtattaaaatatagtattactttatatataaaakatagtattactttatatattatataatatatataatatataatgtattgcattatatatgaataaacatttctatgaattacattatatattatataatatataatatatattactttatatattatataatatatataatataatttatactatatattatatattatatatattatatattatatattatattatataatatataatatataaaaatatataatatataaaaataatatatacatatataaaaatataaatatatttataaattattatatatttaatatattatatt

SEQ ID NO: 179399 - DNA, 601 bp, Human
tataaaatatagtattactttatatattatataatatatataatatataatgtattgcattatatatgaataaacatttctatgaattacattatatattatataatatataatatatattactttatatattatataatatatataatataatttatactatatattatatattatatatattatatattatatattatattatataatatataatatataaaaatatataatatataaaaataatatatacatatataaaaatataaatatatttataaattattatatatttaatatwttatattaaatatatattatatataataacaaaatatatatagtttatatataatgtttaatatatcaaaatttataattttaaaacagttaatgatataaagtatgaagaaaaatgaagcagagcaagatgctgtgtaagtgggggtgggaatggggactaattttataaagaggagtcagcagggtctgtgatgtttaagcagagtcccatatgaagtgagggcatgatcacataaatacctagggaagcctagccttggcagaggtcagtatgaagggcgtcctgcctggaatggca

SEQ ID NO: 179400 - DNA, 601 bp, Human
cagaaatgggcaccaaaaagtagaggtgctgctctaacaaatacctgaaaatgtagaagagggtttagaattgggtaatggctagaagctgtaagagttttgcagtacatgctagaaagtgttggcattgcctcaaatagactattaagggaaattcttgtgagggcccacaagggaaaaaagagctacatagaaagtctcagtattctttgtgaatacttctttgtgaagagaattctgttgatacaaatataaacagtaaaggacgttctgatgaggtctcagacaaaaattatgacaygtgttggacaatggaggaaagggcatcattgttaaaaagtggcaaagaggtctgacgcggtggcacacgcttgtcatcccagcactttggaaggccgaggcgggcagatcatgaggtccggagttcgagaccagcctggccaatatggtgaaaccttgtttctaccaaaaatataaaaattagctgggcttggtggcatgcgcctgtaatcccagctactcaggaggctgaggcaagataattgcttgaacccaggaggcagaggttgcagtgaaccaagatcatgccattacacaccag

SEQ ID NO: 179401 - DNA, 601 bp, Human
agaaatgggcaccaaaaagtagaggtgctgctctaacaaatacctgaaaatgtagaagagggtttagaattgggtaatggctagaagctgtaagagttttgcagtacatgctagaaagtgttggcattgcctcaaatagactattaagggaaattcttgtgagggcccacaagggaaaaaagagctacatagaaagtctcagtattctttgtgaatacttctttgtgaagagaattctgttgatacaaatataaacagtaaaggacgttctgatgaggtctcagacaaaaattatgacatrtgttggacaatggaggaaagggcatcattgttaaaaagtggcaaagaggtctgacgcggtggcacacgcttgtcatcccagcactttggaaggccgaggcgggcagatcatgaggtccggagttcgagaccagcctggccaatatggtgaaaccttgtttctaccaaaaatataaaaattagctgggcttggtggcatgcgcctgtaatcccagctactcaggaggctgaggcaagataattgcttgaacccaggaggcagaggttgcagtgaaccaagatcatgccattacacaccagc

SEQ ID NO: 179402 - DNA, 601 bp, Human
ataattgcttgaacccaggaggcagaggttgcagtgaaccaagatcatgccattacacaccagcctgggcaacagagcaagactccttctcaagaaaaaaaaaaaaagtggtgaagaactcaggtacactatgttagtatgctagtgtttttggtaagttacaacttgtgtgtgatggaatcagatattcgcctggaaatttctcaacaaagtgttgaagaagcagtctgatttttcctgactgcttatattaaagggctagagaaatacatgatttaaagatagaattattaatcaaaarggatgcagaactttttaccgtatccattttgtaacaaatgagaaaaactgggaaagaacattaagggtttggccaggaggacatttgatatagagattgattagcatggatcagccatctcagtcgaagctaggagttaatttttccagacaatggaggaatgtccatgaagcagatacaaagataattagagctgccactcccatcacaggatcagggttcaagtgcctaggagacaggaagtttcaaaggaaggtttgaaggtgcctacaggatctcctagtgccatctcacatcgtg

SEQ ID NO: 179403 - DNA, 601 bp, Human
agtctgatttttcctgactgcttatattaaagggctagagaaatacatgatttaaagatagaattattaatcaaaagggatgcagaactttttaccgtatccattttgtaacaaatgagaaaaactgggaaagaacattaagggtttggccaggaggacatttgatatagagattgattagcatggatcagccatctcagtcgaagctaggagttaatttttccagacaatggaggaatgtccatgaagcagatacaaagataattagagctgccactcccatcacaggatcagggttcargtgcctaggagacaggaagtttcaaaggaaggtttgaaggtgcctacaggatctcctagtgccatctcacatcgtgggctctgctcctgttacgccagcactacgcctctcattgtcccagctgtggccccactggggcctggtctcgggtaggacatggtgggtgccccttcagagaacataggcagcaaactttggtcatgttcctgtggaaccatctccaccagggcacaatgtgcccccaggccctgggagcgtggctgcctccacgtggatttcagaggaagggcctcttagcag

SEQ ID NO: 179404 - DNA, 601 bp, Human
gccaggaggacatttgatatagagattgattagcatggatcagccatctcagtcgaagctaggagttaatttttccagacaatggaggaatgtccatgaagcagatacaaagataattagagctgccactcccatcacaggatcagggttcaagtgcctaggagacaggaagtttcaaaggaaggtttgaaggtgcctacaggatctcctagtgccatctcacatcgtgggctctgctcctgttacgccagcactacgcctctcattgtcccagctgtggccccactggggcctggtctcrggtaggacatggtgggtgccccttcagagaacataggcagcaaactttggtcatgttcctgtggaaccatctccaccagggcacaatgtgcccccaggccctgggagcgtggctgcctccacgtggatttcagaggaagggcctcttagcagagctgcaggctcaggtccctagctctggagagccgctgggccccagcagagaactggtgtaggagtggggctcaggcactgagcacacttaggggcagtgtgggagtggagcaaatcaatgggagtggagccttcttagccttggaaa

SEQ ID NO: 179405 - DNA, 601 bp, Human
tatttatatgtacacacatatgtatatagacataaaaaagaattgctgcatgatctcacttatatgtggaatttaaaagaatcatactcatagaagcagtgagtaaaatggtggttgccaggagtgagagataagggaagtgaagaaatgttggtcaagggatacaaaatttcagttatgcaagatgaatgcattctagagagataatgtaccgcattgtgactataattaataatgccatattaatgatacatatggatatgtgctaagttaataagaaatgtaactatagttaacaatrcatattaaaatgtactaagaggctacatattaagtgtacaaatacaaacatattaaaaaactggtaaatatgagaattggtagatatgtttaattagcttgaatttatggtgattatttcagagtgtatgcatatatcaaaacatcaagttaaaccccttaaatatatataattttattggtaaattatctctcaataaagctgggagaaaagcatatacagtaatatcatttttcttatttatcatttttatttttgtttgtattgaatgttttattgggagataatacattttcctta

SEQ ID NO: 179406 - DNA, 601 bp, Human
caataatgagggtgtgatcaataactgagaaaaattatatagagatgttattaggaggttaaataggtaaaatggaggttagagtttccgtcagcacagaagagagaagagcatttaattacaaaaccttaactcatcccagttcacctggctaaaaaaaaaaaattaaaaagtttgtggcagaaaaagaatttggcagtatggacatttagggaagttagcaattttgtgagtgaaaaaatttagcaattttctggttatctgacatcatgaagatattttatgaatattttataaaaayctacgcatttagactatagaaggaaatgtttagtaattacacatttgtgatattttacgtactcagtggaccttgaaaaaacgtcagttgaatttttcttgcataaataattttacgtatactaagaagtattatatttgaaatgaaaaatactataaattgtttatgaaacatattttgttcaatgaaactgttatgtttttaaattaatgtttttatacaaggcaaagtttttctatttaaataggaagccatctgattttaagggtaatatgtacttcctgtataaaatctcgcagc

SEQ ID NO: 179407 - DNA, 601 bp, Human
caattttgtgagtgaaaaaatttagcaattttctggttatctgacatcatgaagatattttatgaatattttataaaaatctacgcatttagactatagaaggaaatgtttagtaattacacatttgtgatattttacgtactcagtggaccttgaaaaaacgtcagttgaatttttcttgcataaataattttacgtatactaagaagtattatatttgaaatgaaaaatactataaattgtttatgaaacatattttgttcaatgaaactgttatgtttttaaattaatgtttttatayaaggcaaagtttttctatttaaataggaagccatctgattttaagggtaatatgtacttcctgtataaaatctcgcagcaattaaactccaattgttaaattgtttattttgagtataacttatactcatgatggaaagttacataagcagtacaataaatatgttgtaaacatttggatgtgctgaactgtgatcttaaaataatgccatcaacatattgttttgatgaaagtcctagacaaatgacacatcattattagattaatttttctttccactgttcatcaaaatatatatcc

SEQ ID NO: 179408 - DNA, 601 bp, Human
atagaaggaaatgtttagtaattacacatttgtgatattttacgtactcagtggaccttgaaaaaacgtcagttgaatttttcttgcataaataattttacgtatactaagaagtattatatttgaaatgaaaaatactataaattgtttatgaaacatattttgttcaatgaaactgttatgtttttaaattaatgtttttatacaaggcaaagtttttctatttaaataggaagccatctgattttaagggtaatatgtacttcctgtataaaatctcgcagcaattaaactccaattrttaaattgtttattttgagtataacttatactcatgatggaaagttacataagcagtacaataaatatgttgtaaacatttggatgtgctgaactgtgatcttaaaataatgccatcaacatattgttttgatgaaagtcctagacaaatgacacatcattattagattaatttttctttccactgttcatcaaaatatatatccatataaatgttttattaaccaataatctatccataaaagttatttataccaaaatatgtatgcatacaggtaaaagtatgattcataaaatattt

SEQ ID NO: 179409 - DNA, 601 bp, Human
aattattttgtgtagttccctttaataaagtctggttctctaataaaaagagaataaactttcaaattcaaatttttctctctactatgatcatttccaaacttataaaaaatgtaaaaagatttatatttttctgtcatttttaagttaaagtgtttttaatgtatcttgacttttttgtcttttttgcctttatagacaggtgataaagcgttatttctaaaattcagttatatataaatgatgtagaaatattagtgcaggaaactagattctatagagaattcatttctgttgccgygttaaagaaaaattcatgattgtttataatttttggaagaaccgtgttaagatttgtaaatcgtgctgactaaatatagctctaaaataccttaatttatactttgtccttaaaagcttttactagtttgtaatctagatctgctttctcctaattctggagtttgaatttctagtaaattacaaggcaagaacccatcccacacttcagtttaaggttctgttgttctgtttgtatatgcagatttagggaaagaaagtctcacattaactatcttcataatttgaggtacaactctat

SEQ ID NO: 179410 - DNA, 601 bp, Human
tccaaatcttttccctctctcactttaatgtagtctcaatgtgtggagttctatttcacacaataatcttcatgttcacgcagtgttaataagcctcataataagagttattgtatcaaaacctgcattcacgaatcaaaaacaaactgacttcttgtatataaactttgcaaaacttacatcagtaggtttattttatacctcttccctataattttaaaggttatctataaaacctctctttggccagctttcagttttcatgttttagcccaggactgtaataacagtttagccatcrgtgtgccctcttcgctcctttcttctgccaactgatgtgaaactcggtcagtacgtgggtaagccttgaatctgagaacagaaacatgtgaggaaacagggaaattccattctgagttgatccagtgtaactaaggaaatacttacccttggcagaggtagtggggcatgcaaagctcctcatagcgcctgtgaaatgttgaaggaaggggattgctgacaatacaagccagaaagagcttttgcctgaaatactcagataattcaagtaagatctgcacttgatttttttttttgctgg

SEQ ID NO: 179411 - DNA, 601 bp, Human
ttggctatgccatttatccttgcagcttctaatcagtaggatttctgtgccaatcaatctattcccaattggcctcccttaaatctgaaataatgtattataatctgaggcttcaataaggcagtacactctaaaaagcaagttcagttttcttataaggttgagaaattgagaaatacgaaagtaaattttgccatttggaaatttaattttttttgttgattttagaacatctgtacaggattaagtaatgtctggttgatatgtgtgttgtggctattaatatttatctggtattaartaatttttatatattttttcttttaattttggacacagtacattcaacaatgtatttctttcttttctagaatgtgataatatagattaaatgattacaatacaaaatgctaagccagacctagtggcccactcctgaaatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaa

SEQ ID NO: 179412 - DNA, 601 bp, Human
ctattcccaattggcctcccttaaatctgaaataatgtattataatctgaggcttcaataaggcagtacactctaaaaagcaagttcagttttcttataaggttgagaaattgagaaatacgaaagtaaattttgccatttggaaatttaattttttttgttgattttagaacatctgtacaggattaagtaatgtctggttgatatgtgtgttgtggctattaatatttatctggtattaaataatttttatatattttttcttttaattttggacacagtacattcaacaatgtatttytttcttttctagaatgtgataatatagattaaatgattacaatacaaaatgctaagccagacctagtggcccactcctgaaatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagta

SEQ ID NO: 179413 - DNA, 601 bp, Human
caagttcagttttcttataaggttgagaaattgagaaatacgaaagtaaattttgccatttggaaatttaattttttttgttgattttagaacatctgtacaggattaagtaatgtctggttgatatgtgtgttgtggctattaatatttatctggtattaaataatttttatatattttttcttttaattttggacacagtacattcaacaatgtatttctttcttttctagaatgtgataatatagattaaatgattacaatacaaaatgctaagccagacctagtggcccactcctgraatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagtaaattataattatttagaaataatattaataaattatattacaatgttattgcatgtatatcatttctggtcatggtttat

SEQ ID NO: 179414 - DNA, 601 bp, Human
cagttttcttataaggttgagaaattgagaaatacgaaagtaaattttgccatttggaaatttaattttttttgttgattttagaacatctgtacaggattaagtaatgtctggttgatatgtgtgttgtggctattaatatttatctggtattaaataatttttatatattttttcttttaattttggacacagtacattcaacaatgtatttctttcttttctagaatgtgataatatagattaaatgattacaatacaaaatgctaagccagacctagtggcccactcctgaaatccmagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagtaaattataattatttagaaataatattaataaattatattacaatgttattgcatgtatatcatttctggtcatggtttatgtaaaa

SEQ ID NO: 179415 - DNA, 601 bp, Human
ttttgccatttggaaatttaattttttttgttgattttagaacatctgtacaggattaagtaatgtctggttgatatgtgtgttgtggctattaatatttatctggtattaaataatttttatatattttttcttttaattttggacacagtacattcaacaatgtatttctttcttttctagaatgtgataatatagattaaatgattacaatacaaaatgctaagccagacctagtggcccactcctgaaatcccagactttgggaggctgaggtgggcagtttgcttgagcccaagarttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagtaaattataattatttagaaataatattaataaattatattacaatgttattgcatgtatatcatttctggtcatggtttatgtaaaactatagttctgcaaagataatcttaattacctatgatttaatct

SEQ ID NO: 179416 - DNA, 601 bp, Human
ggacacagtacattcaacaatgtatttctttcttttctagaatgtgataatatagattaaatgattacaatacaaaatgctaagccagacctagtggcccactcctgaaatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcayataatacagagaatatgttatctagtaaattataattatttagaaataatattaataaattatattacaatgttattgcatgtatatcatttctggtcatggtttatgtaaaactatagttctgcaaagataatcttaattacctatgatttaatcttttatatctcctaatattaattgattatgtgacttggagttactgtgtaaaccagacataacttccttttgattttcatcaagatattgttatatcccctagctgagtttctgctttctttagcaaaagcatttaaagaaagt

SEQ ID NO: 179417 - DNA, 601 bp, Human
tagaatgtgataatatagattaaatgattacaatacaaaatgctaagccagacctagtggcccactcctgaaatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagtaaattataataatttagaaataatattaataaattatattacaatgttattgcatgtatatcatttctggtcatggtttatgtaaaactatagttctgcaaagataatcttaattacctatgatttaatcttttatatctcctaatattaattgattatgtgacttggagttactgtgtaaaccagacataacttccttttgattttcatcaagatattgttatatcccctagctgagtttctgctttctttagcaaaagcatttaaagaaagtggcaactataaaattctggtggctccatcagatgaat

SEQ ID NO: 179418 - DNA, 601 bp, Human
ttagaaataatattaataaattatattacaatgttattgcatgtatatcatttctggtcatggtttatgtaaaactatagttctgcaaagataatcttaattacctatgatttaatcttttatatctcctaatattaattgattatgtgacttggagttactgtgtaaaccagacataacttccttttgattttcatcaagatattgttatatcccctagctgagtttctgctttctttagcaaaagcatttaaagaaagtggcaactataaaattctggtggctccatcagatgaatttktgaagatgtaatattttgaaatctataattgcatccaaaattaacaagggtcaaataacaagggttgacatgacccagatatttctagtaacctttatttccttgtgccttttcatattcttccttagtgtcttattgaatccaggtctggtagagtatgtaaatgagaagaaactcagagtgaaaatacaagttatgagtaggcttcaaactagaattaaaacaacttgatttgatttgaaattgtagaataaactatttttgctgtagtttcaactttgtcacacttgtttgacatga

SEQ ID NO: 179419 - DNA, 601 bp, Human
aaaattctggtggctccatcagatgaatttgtgaagatgtaatattttgaaatctataattgcatccaaaattaacaagggtcaaataacaagggttgacatgacccagatatttctagtaacctttatttccttgtgccttttcatattcttccttagtgtcttattgaatccaggtctggtagagtatgtaaatgagaagaaactcagagtgaaaatacaagttatgagtaggcttcaaactagaattaaaacaacttgatttgatttgaaattgtagaataaactatttttgctgtaktttcaactttgtcacacttgtttgacatgactaaatcacctgacattggaagccaatctgcatattaaattccatgattctattaaatactatagaaataatctatgtagagtacttctacttgagacacatacagaatatatgcattttagcatcattaacatcattcttggtttttggatattaaaaagatttaactttctattttgagaatgtgtcacaaatgaaacgggtaattttctttgaaagtacgtggcttggaaagctaaaatagaggtgaagaagagaactattcacaaa

SEQ ID NO: 179420 - DNA, 601 bp, Human; identical to SEQ ID NO: 30505

SEQ ID NO: 179421 - DNA, 601 bp, Human; identical to SEQ ID NO: 30506

SEQ ID NO: 179422 - DNA, 601 bp, Human; identical to SEQ ID NO: 30507

SEQ ID NO: 179423 - DNA, 601 bp, Human; identical to SEQ ID NO: 30508

SEQ ID NO: 179424 - DNA, 601 bp, Human; identical to SEQ ID NO: 30509

SEQ ID NO: 179425 - DNA, 601 bp, Human; identical to SEQ ID NO: 30510

SEQ ID NO: 179426 - DNA, 601 bp, Human; identical to SEQ ID NO: 30511

SEQ ID NO: 179427 - DNA, 601 bp, Human; identical to SEQ ID NO: 30512

SEQ ID NO: 179428 - DNA, 601 bp, Human; identical to SEQ ID NO: 30513

SEQ ID NO: 179429 - DNA, 601 bp, Human; identical to SEQ ID NO: 30514

SEQ ID NO: 179430 - DNA, 601 bp, Human; identical to SEQ ID NO: 30515

SEQ ID NO: 179431 - DNA, 601 bp, Human; identical to SEQ ID NO: 30516

SEQ ID NO: 179432 - DNA, 601 bp, Human; identical to SEQ ID NO: 30517

SEQ ID NO: 179433 - DNA, 601 bp, Human
aactgaaatgtaaattccaggttctaattattattgtgacatatcatacacaaagtttctcatcgctcttgccatagggtattgcttaatttgtaaatatattttgaccccattaatagttggagtggtggagaaagaatgactaggagaacatagagagtaagagtgactgatgataatcaacgtgaaaagtgtctattgaggccatacgaaagctttgctaagaagacaatttctctgccaatcatgtggagactgatgatccaattcttgttagatttgaccgaaggtaatgatgagycaacctatgcctgaccaagcaagttgattttggaaacataaaattagtcacaaagaaaggcaggaacagccacaaatataattccataaagacctatacctagagttttaagaaggctcataaaatgggagaacactgtaaatcagcctttgcaacacactggttagattctaccattgataggtaacagtgcttacattgttacatcttagtatgttagtaatattatgaaagttcacaacagggatgttaaaacttttattcagataaatgctcttgaagtaaagatgcaaaaattta

SEQ ID NO: 179434 - DNA, 601 bp, Human
aaaatccttggaaataaataaacttactttgaaaaacattttcaccatttcttttggcctgccacatgtttgataacatttatatttaaccaaaaaagacgttagtatctttcagtaactgcttccttcttttcctgaagacatgtctaattttaatattgactatcaatataatttgatgacaataattctgttcaacattttttatattcaatgataaaataattctgccctctgggaacatgtaatgcatacataatacatacaaaatagttgtttagatttaacaagctaaaaaaartaatataaatcaccacaaaaaatattgctaaaatatttcagttactttgtattttcatgggcttttaatttgtacttccaatgaactatacagtaaaattattttgatcacctcaactctagtttcaagcaacactaataaatccttcatcactagataattcaacatgaacagaaaacaactttcaaacacatggcgaatatgaaaatattattttaggattacatttatggttgttttagaacataagtttaaaaattctaaaacaatggtgaaatagaagtccaattacctggggaa

SEQ ID NO: 179435 - DNA, 601 bp, Human
gcatttagtttagcatgtagtgaaaaagtaagtctaaaaaatattttcataatctttggttcctaaaattgttttaaaagagatgcagtgacatatgtctggagtttgcttatggccaataggttaatgcttctagcttctatgcttattgcaaattttaattatgtgaatatgcaattttcacttatatttgttggtagcttgtttattattaaaatagaatggcttttattaaatatatcctaagaaattacggtagaaaaaattaccatcaaacattgtgggatatattgagatcatrttaaaagtagcactgtgaattcaccaatagcacagtgaaatgactggtgacttttcccttgtaatttacattttcaacttataaatgaaagatattcacatgtaagggatcagtgacagaattaatttctgagtaatgcagaataaacatcaatattgacctttgtatgtttttaatatgtgacaatacatagaaatgttttatacaagattttagccattcttgttttgtatgaaagtattttttgtaggtttgcattaattgttaatgactttgtgtaaatcttgcattaattattct

SEQ ID NO: 179436 - DNA, 601 bp, Human
ctgtctacccatctaagtaaatgtgattactggtaagcaagacataaaaatttaaacttattttaagtatcttcctagtaccatccaatgatttttttttcatacaatggagttttacataaaattctgtctctgaagatgtataaatttgagcttgtgtgttgagtgtaagattagtcattatatataatcagaaatatatgtctatgtccaatggtgtgtgtattgtatcgttcactgttaaaatatttcaaaagattgttttgaccgtattaccagttatgaagctagattgatttayttatgcatgattgccattatctgcatgtggaatatcaggatttttaaaatatagatctggatatctccttctttctcctcccaatctcttctagtctgtcttctttcctccattttacagtcaacgttactggcctctctaccccaatcaaaactataattactcatcagttcacagtaagacccacaagtaccatgtttcagatatgctaacagagtaggcctaggaggtagcagtaaattctttcctataaaatgtattcttacgtggaaaaaccttaggtgagttgctatttttgtt

SEQ ID NO: 179437 - DNA, 601 bp, Human
tgttaactagtctccattgctagcaaaagtccataaaggaaatataaacacgtaaagtgatttttctccagttcctttggtcatttcttttgttttgggcaccaaatgaataaagttgcagaaattgattaacattctgtgcttatccactgcaaaggtatgaaacacaaatagtaagttgaaattttggaataatactataagtaatataaaaattatttaattagcttttatagtgtaaaaataatttttgacatagatataaacagaaaagtcatatttttcttttagagcaaaatgytacattgcctgataaatatgaaatgatgccaaaattcaaaagagaaaatgttcattttcaggattttggattgttttggagcatatttaatttctcttattccatgacagtccagtccaaaatgtatattttaatatatacattattatacaccttttgaaacatgcttgtgtatatttcaaaatgaaaattttaatgcatttataagtcttatatattgtaatacttatacttcttttaaatgatacaatagttatagtagtttgaaacatacaccagaacagttatttctttttatta

SEQ ID NO: 179438 - DNA, 601 bp, Human
ataataggatgatatcaaatggagggtatcttggaattcttaggaatttgtatgattactgttgtagtaaatatatattactttattaattttttattgttctactattctgggccattgtgaagaaactaaagagatttgagaaaatctgaagctattataaccaaactctattattttattatatcaacaaactgaggatcagaaaaaccaaatagtcattgatatagtcaagcaactttgattctcagttttcctcctatctttgttgtattacactaaatcaaagttggtacaagtmaatttctgacctataagttatatggtcatatgtcttaggtctagttcctttgctattttcttgattggcctgtggagaacaacaacaaaaaatccctatgtgtcagaggaaaggctatgtgtacaacaaccacggtttcatccattaatcacagtatttctattagtcagcttttatctttctcactcaaacttttacatatagctgcttccctatgaccaaggtaagtaagcacacattaagtttatggttttaaatgaatatcaaattaaattttcatcactttcttgttttttacac

SEQ ID NO: 179439 - DNA, 601 bp, Human
tctagttcctttgctattttcttgattggcctgtggagaacaacaacaaaaaatccctatgtgtcagaggaaaggctatgtgtacaacaaccacggtttcatccattaatcacagtatttctattagtcagcttttatctttctcactcaaacttttacatatagctgcttccctatgaccaaggtaagtaagcacacattaagtttatggttttaaatgaatatcaaattaaattttcatcactttcttgttttttacacatattttgataacaccttactaaattacttatttgcattkttggtagagataggtaatttttaattaatatatttttatttactgtccactaaaagtaagatattttcatctcaatatgcatcctttttattttaagaattcaaagtaaatagtttcaacacttacaatttgcatagcagctatgtgtttgcttctctactgatttcttatttaatattacaaagagaaacaaaatgttaaaaacaagtattcaagatagaggactttattttttctgtttaaatgtggttaaataaaaaataaattatcttcaaattggcatttctgttttaaagaatc

SEQ ID NO: 179440 - DNA, 601 bp, Human
catattcatgcaaatctttgaagctgccttttctactaatcaatacaaacactagttgttttatagcaaacaaactgcatccatcaaagtcaaccagaaatataaccaaatttaaacagtatttggaaaagtttagagttagtaagataatagcaaacatcaaaagaagaggttcaactggatagttaaagaacacaaaagatattttatatgtgccaaaatgatctcagttccaacatacataataatgtgaaatgtcagtgtagataagataatagatattttgttgtgcaaagacttyagatattttatgatttttcatggtttacagttgtaccacatttattaaaaggatattttaaaatatttatttttaaaatttttagtactttgtgatatttatcacaaaagagctgttatgtatgaatttgtttttagccaattttttttcaaaataagcacagctcagtttctttctttttcttatgttaaaatcagttactttaaaggataacaagaatttgacaagttctcatcaacatttctatacaagcataataaacttctattttagtggttcactttttacacaagattgttc

SEQ ID NO: 179441 - DNA, 601 bp, Human
aaccagaaatataaccaaatttaaacagtatttggaaaagtttagagttagtaagataatagcaaacatcaaaagaagaggttcaactggatagttaaagaacacaaaagatattttatatgtgccaaaatgatctcagttccaacatacataataatgtgaaatgtcagtgtagataagataatagatattttgttgtgcaaagacttcagatattttatgatttttcatggtttacagttgtaccacatttattaaaaggatattttaaaatatttatttttaaaatttttagtacttygtgatatttatcacaaaagagctgttatgtatgaatttgtttttagccaattttttttcaaaataagcacagctcagtttctttctttttcttatgttaaaatcagttactttaaaggataacaagaatttgacaagttctcatcaacatttctatacaagcataataaacttctattttagtggttcactttttacacaagattgttctaaaaggatagctaaaactataagagggattgtgtagatattttaaaaagcagggcggccatggggggctacttaaaattccattccaaat

SEQ ID NO: 179442 - DNA, 601 bp, Human
ggtagattgtataaagaaaatgtggcacatctgcaccatccaattctacacagccataaaaaaaatgacatcatgtcctttgcagcaacatagatagagcgggaggccatagtcctaagcaaattaactcagcaacagaaaacaaaatatcacatgttctcacttataactgggagctaagtattgagcacacatggacataaatatggggacaacagacactgtggactactagaggatggggtgtgggttaaaaaactaccaatcaatcaagctgtgtgctcgctatcagggtgatatracttccaaacctcagcatcatgcatttccgcatgtaagaaatctgcacatataccccctacatcaaaaataaaagttgaaattctaaaaggtatacagttttacaattataaatgccattcctataatctacttgtttatagttcccccatttttaaccaaatattctcaattagctactttttcttgccctgaatcagatattaagaaaaagcaaataaaaggatatggttatcggtgctacctttttactgttccgaatccctgataagcttcctaggattttgaagtgatttgaagg

SEQ ID NO: 179443 - DNA, 601 bp, Human
gtactagggggcaaaatgaattatagaagaagagaatgcctcccaaaatccagtatctccttatctcaaaactgagcaaaagccaaagtcatatatgagtgacagtaagagcattagtaaattatatggacttcctccatcttcacatgagttttaaaaagatgaagaaaaattttatagtgtcaattaggaatatagcaatgaccaaaaccaaaatttactagctaagaagtgaagaaataaaaaaggaataatattaaaatttttaaaaacttgttgattctggccacagtaaaatgcrtagctaaaagtagaagaatggaaatgatctgaagccttaagccttaatgaagataacatattaaacaaataacataatgttttgtttatttgtttgtttgagacagagtctcgctccaggctggagtgcagtggcgtgatctcggctcactgcaacctccagctcccaggttcaagcgattctcctgcctcagcctcccaagtagctgggactacaggcgcgtgccaccacgcccagttaattttttgtacttatagtagagacagggtttcactgtgttagccaggatggtctcgacct

SEQ ID NO: 179444 - DNA, 601 bp, Human
atgttttgtttatttgtttgtttgagacagagtctcgctccaggctggagtgcagtggcgtgatctcggctcactgcaacctccagctcccaggttcaagcgattctcctgcctcagcctcccaagtagctgggactacaggcgcgtgccaccacgcccagttaattttttgtacttatagtagagacagggtttcactgtgttagccaggatggtctcgacctcctgacctcatgatctgccctcctcagcctcccaaagtgctgggattacaggtgtgagctactgtgcctggccaatracaataaattttaaaacaaaatgtttgtacttgctaaaatctaggaaggttttgtataaaagtggagaagttctagtttaaaaaaaaatactgctataagcaacaagtaacaagaagctactctaaactgaatgtttttaaaataataggtttaacaaatgaaataataacatatgtatataatgacttggaattcccaaagtactttcttgcttgagcctaaaagagcattttcattaagataactagatatgtatatcaccattttaccaacaatgaaactgggaatgaaacaacaat

SEQ ID NO: 179445 - DNA, 601 bp, Human
tgttcagagaaatggaaatagtgttacattgtgctcggattgctagtatcagtggttccatataaaattcagtgaattttataacttgcgtaaatcaaaattttcattttccttttttctacctgtaattacaacacatgcaaatgcgatctgaaagtcatgttctttcaaatatataaagataaatattttggaataatttttttcttaccacccacaaatatataaagaaaacatttatacatatatttctaattatctatgtagtttaactgagagaagtctatcaaagtccaaacakgaatcttaactcatttaaactatttggtaagtaagtttgtgattaacatgtaaggtcttccctgtagaagataggaagttttgttaatataagacatctctcttcacaactccataatgttgaagagtactattttatttcgtgacaagtggcttctgttaagaaatgtaaaggatgctgtttggttttatactggaagaacattatgaatacagtttattctcaatatccccaccatttttaaagccgtgagcatttaattttaaaaaaattatttttgaacactattttgctcaccta

SEQ ID NO: 179446 - DNA, 601 bp, Human
atataaagataaatattttggaataatttttttcttaccacccacaaatatataaagaaaacatttatacatatatttctaattatctatgtagtttaactgagagaagtctatcaaagtccaaacatgaatcttaactcatttaaactatttggtaagtaagtttgtgattaacatgtaaggtcttccctgtagaagataggaagttttgttaatataagacatctctcttcacaactccataatgttgaagagtactattttatttcgtgacaagtggcttctgttaagaaatgtaaargatgctgtttggttttatactggaagaacattatgaatacagtttattctcaatatccccaccatttttaaagccgtgagcatttaattttaaaaaaattatttttgaacactattttgctcacctagtctagtatctgctttgattgattctttctacattctgctacacattgactctttgaactacattttactctttgtatattcaagggaattctatggaaaatgccacaaaacaaacatttaattcatcaatttaatataatatccaggtttataaggaataggtaatcttggt

SEQ ID NO: 179447 - DNA, 601 bp, Human
gctaaaaaggtcacaggatgaaatacttgtcatttaaaagctaactagccaaacctgaattattaaaaaaaaacttactttagcctcaagagaataatcattacttaataagagatagtcttccactttagattactgctgaaaagatgtgcttacagaatagtttaatgtttaacattagataatttttagttgaaatatcatttttataatactaaatatcaattttataatattaaaataattataagcagtacttgctagatttttactttgtactgggcaataagtgctggaggtwaagtacattaccacattcacacaatcttctcaacaaacttgtgacctatttttggttgttatttttattataactgtctccattttaataaagaggcacttcagtctgagagatactagatggcttaccccaaaagctaatgatggtaagtgatgaaaccaggcgtttcttactcctgatgcagtgtttttaagaacaaagcaagaatcttcatacttaggaaaggtaaatgggaatgtgtataataaatcagatatattgtcattgatctataggatttattgcctagaactatctgca

SEQ ID NO: 179448 - DNA, 601 bp, Human
catacctgtgagtatcaggcatctacatcatgtcatattaaacaagcgccacagtcaagctcgagtgctttacctgagggcgttgtagggtaaaggagtagggtaaagagtttgattatgcaacattggacactgcactgcctgctctctgaccttgaaactatgtatccttatatataacctagaacaaagtgactttgacaacagtttattcaaaattaaacctcacaatgggatcttcactgaaaagaatcactaccatgatttatagatgataaacatatagatggatggatagttrtgcaaatgtattccattttgatttattccaccggttttgtttatattaaataaaagaaaggcttcaacaataatctgagctaaaaactcagttgaactgagttaaaaacaacaaaattgtggcaacttctacaaacgtaaggcatgattacaacaggcttcatgattttttgtatagaaaatatgatatgtgctataaaatacaatattacagattctgaatatactattctaaaatttgatcaaaagttgattacttgttagaatttggagctctctgtgtagttctatttagttaagc

SEQ ID NO: 179449 - DNA, 601 bp, Human
cactgcactgcctgctctctgaccttgaaactatgtatccttatatataacctagaacaaagtgactttgacaacagtttattcaaaattaaacctcacaatgggatcttcactgaaaagaatcactaccatgatttatagatgataaacatatagatggatggatagttgtgcaaatgtattccattttgatttattccaccggttttgtttatattaaataaaagaaaggcttcaacaataatctgagctaaaaactcagttgaactgagttaaaaacaacaaaattgtggcaacttcyacaaacgtaaggcatgattacaacaggcttcatgattttttgtatagaaaatatgatatgtgctataaaatacaatattacagattctgaatatactattctaaaatttgatcaaaagttgattacttgttagaatttggagctctctgtgtagttctatttagttaagcagatataattttcaagaaagtatgtagatcgattttttagaaaattattttgtcctgtaaaagggaaattacaatgttttaatatttccattttgttttattgtgtttgtctttacatagatatagatct

SEQ ID NO: 179450 - DNA, 601 bp, Human
acaaagtgactttgacaacagtttattcaaaattaaacctcacaatgggatcttcactgaaaagaatcactaccatgatttatagatgataaacatatagatggatggatagttgtgcaaatgtattccattttgatttattccaccggttttgtttatattaaataaaagaaaggcttcaacaataatctgagctaaaaactcagttgaactgagttaaaaacaacaaaattgtggcaacttctacaaacgtaaggcatgattacaacaggcttcatgattttttgtatagaaaatatgwtatgtgctataaaatacaatattacagattctgaatatactattctaaaatttgatcaaaagttgattacttgttagaatttggagctctctgtgtagttctatttagttaagcagatataattttcaagaaagtatgtagatcgattttttagaaaattattttgtcctgtaaaagggaaattacaatgttttaatatttccattttgttttattgtgtttgtctttacatagatatagatctaatttcaaaagtagaatatgatcaatgcaaaaaattcagcaagcacaggaaatcat

SEQ ID NO: 179451 - DNA, 601 bp, Human
taccaccacattctggaagttctctcatttccttatccagtccacccacattaacctccctcacccaggccattgctattcctgatttttcaccacagatagtttttgcttattttggaacttcacataaatggattcctgcagtgtctacccttctgtatctgacatcttcaaaaatgttgtattaggaccattcatgttttgtatttcaaggactgatgcttttttattgttgaatcatttatattctttttctatgcatctgttgaagcgtggaaggtctcatactgttttatagacmcatttgtcttggctttatcatataattttgttccattgtatcatttacaccttaaattttaaggataattcttttatttgaaaagtttttactttaaagttttggcttttaaaatatatgccaaaatatatatcattttttacatatttctgcgtttttgctaattgttttaacatttttactctcatggaagtataatattctaaaaggcttagctattatcagtgtacagtttaataaatattcacaagctgagcatgcccatttttaacgctcaaatcaagaaaaagaactttatta

SEQ ID NO: 179452 - DNA, 601 bp, Human
tctgcgtttttgctaattgttttaacatttttactctcatggaagtataatattctaaaaggcttagctattatcagtgtacagtttaataaatattcacaagctgagcatgcccatttttaacgctcaaatcaagaaaaagaactttattatctacgtctcctttcctgtccctattcaatctcgtgctaagcaatatcctgacttcatagcaccatagattactttttcctgttttgtactttacataaatgagtttatacttgttgcatatggggtattttgatacaggcatacaatrtgtaataatcaaatcagaataattgtggtatctgtcacttcaaacctttatcaattctttgtgctaggaacacattccaattctcctcctttagttatttgtaaatatctgatacattatttttggctgttgtcaatctattgtgacaccaaatactgaatcctattcattctgtctaactgtattttcatacccattaactgttcctacttaatcccccattcccccttccttgttacctttgctagcctctgctaacaattattcttttctctttctccatgagtttaagttgttgtt

SEQ ID NO: 179453 - DNA, 601 bp, Human
tctcatggaagtataatattctaaaaggcttagctattatcagtgtacagtttaataaatattcacaagctgagcatgcccatttttaacgctcaaatcaagaaaaagaactttattatctacgtctcctttcctgtccctattcaatctcgtgctaagcaatatcctgacttcatagcaccatagattactttttcctgttttgtactttacataaatgagtttatacttgttgcatatggggtattttgatacaggcatacaatatgtaataatcaaatcagaataattgtggtatctrtcacttcaaacctttatcaattctttgtgctaggaacacattccaattctcctcctttagttatttgtaaatatctgatacattatttttggctgttgtcaatctattgtgacaccaaatactgaatcctattcattctgtctaactgtattttcatacccattaactgttcctacttaatcccccattcccccttccttgttacctttgctagcctctgctaacaattattcttttctctttctccatgagtttaagttgttgttgttgcagctcccacatatgaatgaaaacacacaa

SEQ ID NO: 179454 - DNA, 601 bp, Human
gtacagtttaataaatattcacaagctgagcatgcccatttttaacgctcaaatcaagaaaaagaactttattatctacgtctcctttcctgtccctattcaatctcgtgctaagcaatatcctgacttcatagcaccatagattactttttcctgttttgtactttacataaatgagtttatacttgttgcatatggggtattttgatacaggcatacaatatgtaataatcaaatcagaataattgtggtatctgtcacttcaaacctttatcaattctttgtgctaggaacacattcyaattctcctcctttagttatttgtaaatatctgatacattatttttggctgttgtcaatctattgtgacaccaaatactgaatcctattcattctgtctaactgtattttcatacccattaactgttcctacttaatcccccattcccccttccttgttacctttgctagcctctgctaacaattattcttttctctttctccatgagtttaagttgttgttgttgcagctcccacatatgaatgaaaacacacaatatttttctttctgcactgacttatttcacttaacataattttc

SEQ ID NO: 179455 - DNA, 601 bp, Human
ttttgtttattatacctttgtagtataatttgaagttaggtaatgtcattccttcacttttgttcttttgagtcaggatggttttggctcttgtgggtcttttgtgtttccatatacattttacgatctttttttctatttctgtgaagaatgtcattggcattttgataagaattgcattgaatctgtagatttctttgagtagtatggacattttgacaacatttattgttttaatccaccaacataaaatgccttttaatttttgtgtcatcttgaagttttcatcaatgttttatcrttttcattgtagagatgttttacttattcacttaagttaattcctaggtatttcaatttatttgagcttttataaatgggattactttattggtttctttttcaaattgtttcctgttgacatgtggaaatgttactgattattgtacgttgattttttatcctgaaacattactgaatatatttgttagttctaatagtttttttggtggagtttttagcattttctaaatataagatctgtcatcataagaaggattatttgactccttcctttccactttggatacattttatttct

SEQ ID NO: 179456 - DNA, 601 bp, Human
actccttcctttccactttggatacattttatttctttatctttcttaattgccctggctaggacatccagtactacgttaataccagtggtgaaagtagacatccttgtcttgttccagatcttagaggaaaggctgtccatttttcctggttcagtatgatactagctttattatttattttcttctactaattttgggttgggttagctttggctcttccagttctttaagatgcattgtaaggttatttagttaaagtttttctgctattttggtgtaggtgtttattgctgtaatrtgccactcagtactacttttgcagtatccaataggttttggtatgttgtgtttccattatcatttgtttcaataaatttttaattttcctttttaatttcattgacttaatggtcattcaggagcatattttttttaatttccatgtgtttctattgtttccaaagttcctctttttattgacttttagtttattgttttccgttgtcagaaaatatgcttgatatgatttcaattttttggaatttttcaagaattgttttgtggcctaacatacgatctattcttcagaatgtttcat

SEQ ID NO: 179457 - DNA, 601 bp, Human
gaaagtagacatccttgtcttgttccagatcttagaggaaaggctgtccatttttcctggttcagtatgatactagctttattatttattttcttctactaattttgggttgggttagctttggctcttccagttctttaagatgcattgtaaggttatttagttaaagtttttctgctattttggtgtaggtgtttattgctgtaatatgccactcagtactacttttgcagtatccaataggttttggtatgttgtgtttccattatcatttgtttcaataaatttttaattttccttyttaatttcattgacttaatggtcattcaggagcatattttttttaatttccatgtgtttctattgtttccaaagttcctctttttattgacttttagtttattgttttccgttgtcagaaaatatgcttgatatgatttcaattttttggaatttttcaagaattgttttgtggcctaacatacgatctattcttcagaatgtttcatgtgctgaggagaagaaagtgtattcttaaaaacgtggatgaaatgttctttaaatgtttattaggtccatttggtctatagcatattttagg

SEQ ID NO: 179458 - DNA, 601 bp, Human
ttgtgtgagctttgtaaataatctagatttacttatgaagtgaaatttttaaagtaccttattctttcacatgcagtccttttgggttgctgaatatgtttaagcagatgttgttctgcacgagtccaaagagggctattcatgagggtcatgacaccacttgacttgtgagaaaatgagtgcagtaaccttaggaccaattcccttacttcagtaaagagttattcattagaatgcattataactaaacaataaattttttaaaaaatgtttctacctataaccacttgtcttaaaatayatgtactcatgaaacatagtgaaatcatcaagatagtctctaaattttaaacataattatttttattttttgttagaaccaaagcaaattgctttcctaacaagatattatctctaatgtactttttaagtttgaaaaaatgctgacttttcccaattctcatttcattgaataaagtaatttcgatagaattaattcagtggaaaatttaatttactacctgtaataccataattaaaatccaatatattatggacattcaccctgggtatgaccatgaactaatactgataagacact

SEQ ID NO: 179459 - DNA, 601 bp, Human
atgaaacgccatatgccaactgagatttatttttcaaaattgaaaaacaaaggcttttaatccactttttaaatattgaaattcttctgaatttctatgtgcctaaaattcaagaaacttaactgttaaatgttcctgtaatatcacattttattttgtataccagtgtttttttctcttctcttttttcgaatctggctctttctattgagaaaatctagaagtcaaccatctgtattttttttccactttcaacttcctccctcactgcttaatctcttctatttttggcttatgcttyactaaagctgctcttttcagtcgagagattttatgttgatcaaatctcatgtcttactttggttttcaaattctcaaaccatcttggagaatgtgatattgtttacatgttccctcaccgacattctaccatccccttccaagactctgtatcatcttttttctctgtgtttcctcctcagttctctttctttatgtataatttatcccataactccaaatatcacctctacatgtgtgaataccaaataaatgtctgcgtctggtccttatcattctcttgggcatcaggatgcctgtg

SEQ ID NO: 179460 - DNA, 601 bp, Human
ataaaatgagaatttacagttctgctccacatgttgtgtgacataagtaaagaaatgcatgcaatatatgtaaaattacccttataatgcctggcatttaataataatttatgcatcagggttagaaatacaggagaatcgattcttcctagctacattttttttacatcaccaagcctttttcaactttactagattgtttgtctatgaccatttgttatgtatgttctgtaagggatatttttacttcatgagatgataattagataacatatttcagttcaaaaattagattcaactrttctcaaacaaaatgcaaactgcatatttattggacatggaataaactaaagaacaaacataaattagcctctactgcacactaaatgagatacaaataagagacatggtaaatacagtggaatcaattcatttccaatattttttgctttcttcgtcattgccttttatgcctcctaataattttctgtacttttacattgtcttcctaactaaacaaacagatcacaaagcttagttttagttgttttatttaaatagaggcacaagataaaaacacatagaataaatattatatata

SEQ ID NO: 179461 - DNA, 601 bp, Human
tagaacttaggaacaaattagtaagcaaagcaaacaataattttgttcacatggagttcaagttattgtggaagatggcagttaataaacgttaactaaaaatgaaatgtccagtagtgataagcactaaatgaatgaaaggcaggatgttaagttgttatttgatactgtgtcataaatacctctcagggaggtgacattaagcttaagggtgggtaataaggagctggtaatacaacaatcaagggacagaacattctaggcaggtgtaaattaatgtaaagattctaacatggggatragcttgctatgttcaaaggcaaatgacgcttattggtgagagtcagagaaagagaaactggtataaatatcagattgggaaattatctaggggccaaagtattattccatcttcttgggtcaatgaaaagggtctgaattttgtttgaaatagaagactactagaagagttttaagaagatgacttttgctattgtgtgaagaatgggttattggacataataggtttaggggaatgatttaaaatcagggagcccagttaagaggagcttgaagtaatccagatgaaaaaagttggggt

SEQ ID NO: 179462 - DNA, 601 bp, Human
ttcctttctatcaggaaacttttattctggcaggaaccacattttaatttaaaaaaatcaaatgataaataatttttataaatgttatgtaaaataaataatttacctactcatatttatgtaagcaagttgtgaagaactaaagcataaggaagagtaggaattaactagctcgtgtgtgtctggtggggtgtgtggaagatggttcttcaggcagagggaatggactgtgtaaaaggctttgttataagagaaagtaagatttgatacaaaaactgaagaaatatgtatgaaatatcarttgtattttctgaataacagtgacaaaacaaaccaaaacaatactcccggttttcagcccagcatgcaaagagattaaaagttgccactctctcctaacaaaccaaaagctaaacaaactgaaatcaacaattcttagattcataagaaaaatgtggtgttagtgcaaactaccgtcctgaaaattgaagaggcagagaggcagatgcagaaaatcacaacttatcagagcagaaacctgtaagcagaaacgtctgtgagaaccagttcaggaataggaaaaaaatgtaaaatgttattg

SEQ ID NO: 179463 - DNA, 601 bp, Human
attgacttcattcagttcattgtaaatgtatattgaaaattcttgaacaacaaataaacaagttaaagaaagataactgatatactaaggaaagaaaattaaatcatataaaatgctcaattgaaatagccaaagacagaaaaatagtgaaagacaaaaactgaaataaagaataagggcaacaaataaaatagttacaaatatagtatatattaatctattgtatcagtaattacctgaaaattataattatctaaatagctcaattgaaaggtagagactgtcagagtaaataaaaaawaacgagacccaaccagatattgtccacacacacacacacacacacaataagaataatgacacgtgaattaaagataaatagatagaaaaagacatactatgctaacatgaatcaaatgaaagcaggaatggaaatattgatgccagatgcagtcaacttcagagcaaggaaagttatcaggtttctaaacgggtattacctattatcaggtttctaaacgggtattacctaatcataatggggtcatttctcaaggaaaatatagtgatctttaacatgtatatgtttaacaacaaagca

SEQ ID NO: 179464 - DNA, 601 bp, Human
ctgtcagagtaaataaaaaaaaacgagacccaaccagatattgtccacacacacacacacacacacaataagaataatgacacgtgaattaaagataaatagatagaaaaagacatactatgctaacatgaatcaaatgaaagcaggaatggaaatattgatgccagatgcagtcaacttcagagcaaggaaagttatcaggtttctaaacgggtattacctattatcaggtttctaaacgggtattacctaatcataatggggtcatttctcaaggaaaatatagtgatctttaacatgyatatgtttaacaacaaagcataaaaatatgtgaggcaaaaattaatacaacttaatgagaaatacaggtgtccacctttatagctggagactttaacgctgccctataaggaactcattcagcaagcagaaaaaaaaaaaaaaatggaatacatgaacccaggaggcagaggttgctgtgagctgagatcgggcaattgcactccagcctatacaacaagagcgaaactctgtaacaaaaaaaaagggggtgtggggggagaatacaaagataaaaagaaaaaaagtaagaaaaaatggg

SEQ ID NO: 179465 - DNA, 601 bp, Human
agtttattacatagagaggcaaaaagacccacaataaccaaagtaatattgaaagtgtaaatgtgtaggattgacactatccaacttcaatacttactataagctacgataaacaagactttgtgatattggccaaagagtaaacaaataaattaatggaacccaataaaaacctcagaaatagacctacataaatatactcaagtaaactgacatgtcacacatagttaaggcagtactatggtaaaaagatgttattttcaacaaatggtactggaacaactgtaatccataagaaaawatatatctagccacagacattatgcacttcataaaaattaactcaaaatgtaatattgacctaaatataaatcaaaaaattataaaactactagaataaaacatggcagataatctagatgaccttggttttggtagtgaatttttggattcaacaccaaaagcacaatccatgaaagaaagattttttttttttttttgagatggagtctcgctctgttgcccaggctagagtgcagtggcctgatctcagctcactgcaacctccacctcccaggttcaagtgattctcctgcctcaa

SEQ ID NO: 179466 - DNA, 601 bp, Human
gtagagatgaggtttcaccatgttagccaggatggtctcgaactcctgacctcatgataagctggactagtataaaattaaaaatttatgctctgcaaaagacattgttaagtgaatgaaaagacgaatcacggaatgggaggaaatatttgcaaaacacataactgacaaaggactattatatgatgtatacaaataattcttaaactctatataataaaaagaagagcccaattagaaagtgggccaaaatacttaatacatacctaattaaagaacatatacaaatagtaaataagcytatgaaaagacatttcaaatcctatgaatcagggaaatgaaaattaaaatgagctactgtaccactgcaagcctatcgaaatggtcaacatctagaacattgacaacaccaaatggtagatgtgaagcaacaggacatctcattcattgctgatggaaatgcagtgatacaatcactgtggaagacaatttagcagcttctcaagaaaataaatatactcttaccttaaaatttattatttgagctccttagtatttacccaaagaagttgaaagtgtatgtctacaccaaaaccgcaca

SEQ ID NO: 179467 - DNA, 601 bp, Human
aattaaaaatttatgctctgcaaaagacattgttaagtgaatgaaaagacgaatcacggaatgggaggaaatatttgcaaaacacataactgacaaaggactattatatgatgtatacaaataattcttaaactctatataataaaaagaagagcccaattagaaagtgggccaaaatacttaatacatacctaattaaagaacatatacaaatagtaaataagcttatgaaaagacatttcaaatcctatgaatcagggaaatgaaaattaaaatgagctactgtaccactgcaagcctrtcgaaatggtcaacatctagaacattgacaacaccaaatggtagatgtgaagcaacaggacatctcattcattgctgatggaaatgcagtgatacaatcactgtggaagacaatttagcagcttctcaagaaaataaatatactcttaccttaaaatttattatttgagctccttagtatttacccaaagaagttgaaagtgtatgtctacaccaaaaccgcacactgatgttttcagaagcttgtttcataactgccaaaacttggaagcaattaaaacatccttcagtaggtaaatga

SEQ ID NO: 179468 - DNA, 601 bp, Human
ccttacattctggcagggtgtgcttattaattaatcaataatatcacctctcatgatataccagatgacatctgacaggggcagagtgcatggacatttactgtctttaatgtggaaactctctctctctctgtgttaatattaataaaacataacatagtattagtgtttctttaagtaactaaatattttagttacaaaagcagtaccaacatatataatttatatttaataatatcaccttttatgatagactggatgacatttgacaggggcagaatgcatttagacattcacagtgttaatgcaaaatctctccctctctgttgataaaacataacatatattagcgtttccataagtaaccaaatattttagtttcaaaagcagtatctatatgtaattttatatttaattaaataaaaatatatatactttaaataaaattatataatttaatttaatttaattatatataatttaatttaatttaattatatatgatttaatttaatttaattatatatgatttaatttaatttaattatatatgatttaatttaatttaattatatataatttaatttaatttaattatata

SEQ ID NO: 179469 - DNA, 601 bp, Human
tatttttatctgcaagtttatgaatttcataaatttttttcagtgttgacattttcatttttaaaaaatttcttaaaattgaaagtttcagtaatatatttccaaatgtaaattctccatgcatgccacgacagtgatgcaggtaacactgattgagtgtggcacatgcatcagctattacaagtaacctacaggaattagtttggcactattaccatctttgttttattaactaagcaattcgaaggatggggagttttatgcaatgagttagtgggagagccagctaatttagttctgrtacacctccctttaaacattatgctatgcttgttattatttcctatttaatagtaagttctaaaatatggcaggaatttatataatgttaaccagtctatacattgtgaaacttatccacattacattttgtgactattttgacaaacaattgcctcatttactctttttaattctacagacaatatcaataatgattctggtattacttaatataacttacacgaggtcaggagatggagaccatcatggctaacgcggtgaaaccccgtctctactaaaaaataccaaaaaaaaaaaa

SEQ ID NO: 179470 - DNA, 601 bp, Human
gattgagtgtggcacatgcatcagctattacaagtaacctacaggaattagtttggcactattaccatctttgttttattaactaagcaattcgaaggatggggagttttatgcaatgagttagtgggagagccagctaatttagttctgatacacctccctttaaacattatgctatgcttgttattatttcctatttaatagtaagttctaaaatatggcaggaatttatataatgttaaccagtctatacattgtgaaacttatccacattacattttgtgactattttgacaaacarttgcctcatttactctttttaattctacagacaatatcaataatgattctggtattacttaatataacttacacgaggtcaggagatggagaccatcatggctaacgcggtgaaaccccgtctctactaaaaaataccaaaaaaaaaaaaaaaaattagccgggcgtggtggtgggcgcctgtagtcccagctacttgagaggctgaggcaggagaatggcgtgaacccaggaggcggagcttgcagtgagccgagatcacgccactgcacaccagcctggacgacagagcaagactccg

SEQ ID NO: 179471 - DNA, 601 bp, Human
atttagttctgatacacctccctttaaacattatgctatgcttgttattatttcctatttaatagtaagttctaaaatatggcaggaatttatataatgttaaccagtctatacattgtgaaacttatccacattacattttgtgactattttgacaaacaattgcctcatttactctttttaattctacagacaatatcaataatgattctggtattacttaatataacttacacgaggtcaggagatggagaccatcatggctaacgcggtgaaaccccgtctctactaaaaaataccaaaaaaaaaaaaaaaaattagccgggcgtggtggtgggcgcctgtagtcccagctacttgagaggctgaggcaggagaatggcgtgaacccaggaggcggagcttgcagtgagccgagatcacgccactgcacaccagcctggacgacagagcaagactccgtctcaaaaaaaaagaaaaatattatatatatatcttacaatggataggagattcgacatgtaaattatgtgtgtttcaaatatagccaaccaaggttaagtaaaatattcacttgataatacttatggtatttattata

SEQ ID NO: 179472 - DNA, 601 bp, Human
acattatgctatgcttgttattatttcctatttaatagtaagttctaaaatatggcaggaatttatataatgttaaccagtctatacattgtgaaacttatccacattacattttgtgactattttgacaaacaattgcctcatttactctttttaattctacagacaatatcaataatgattctggtattacttaatataacttacacgaggtcaggagatggagaccatcatggctaacgcggtgaaaccccgtctctactaaaaaataccaaaaaaaaaaaaaaaaattagccgggcrtggtggtgggcgcctgtagtcccagctacttgagaggctgaggcaggagaatggcgtgaacccaggaggcggagcttgcagtgagccgagatcacgccactgcacaccagcctggacgacagagcaagactccgtctcaaaaaaaaagaaaaatattatatatatatcttacaatggataggagattcgacatgtaaattatgtgtgtttcaaatatagccaaccaaggttaagtaaaatattcacttgataatacttatggtatttattataataaaaaagttaaaaataacctaaatg

SEQ ID NO: 179473 - DNA, 601 bp, Human
ttctcttgttaatcttgaatgtcctttcagtaatatttaattatttttaatttaaagatatttgtttgcatattaattcttagtaagaaaaagaattaaaatcagaattcactagttctgtcttctctctgcattgtgctttagttcatcgtatatttgtaccaattgttaatataagaaaatgtttgaatcattttcttgctaagaatcatcaatagccacatttccacaaatagtatactcctgtatgtcatcacaaacactggcataatgcagaattttttaaaagaatcaattgaakaataatgaaaactaacacacaaacagaccaaacaacattaagatccagtggtggtgggctcttcatccatctttacttactctgtagatcttacttacttggggcccttgatcagataatgttgctaaatctgtgtgaatcactgtctcttacagacatctgattttcagagctaaaaaagtttattcacttctagatttcttctattcttataaacacccattcttcaaattatgatgcatgtgtatgtgaggtacctacatactcagataagaggaatgatatggaactgtgatctga

SEQ ID NO: 179474 - DNA, 601 bp, Human; identical to SEQ ID NO: 30518

SEQ ID NO: 179475 - DNA, 601 bp, Human; identical to SEQ ID NO: 30519

SEQ ID NO: 179476 - DNA, 601 bp, Human; identical to SEQ ID NO: 30520

SEQ ID NO: 179477 - DNA, 601 bp, Human; identical to SEQ ID NO: 30521

SEQ ID NO: 179478 - DNA, 601 bp, Human
aacagattacaaaactgccttggccaggcacagtggctcacacctgtaatcccagcactttgggaggccgaggtgggtggatcacaagattgagaccatcctggccaacacggtgaaaccacgtctctactaaaaatacaaaaattagctgggcgtggtggcacacagctgtagtcccagctactcgggaggctgaggcaggagaatcacttgaccctgggagtcagagggtgcaatgagccaagactgtgccactgcactccagcctggtgacagagcgagactccgtatcaaaaaaatraaaaataataaaaaaactgccttgtaggaaaaaatgtttcatcacttacattagttaatagttaagaaccaaatacatgtgggatgactttactgtggtgggataatttacttcagaacataagttactctgctaccatcgtcggtatctggaaaaccctctggtaatacaacagagggtaaaaaaaccagtccaggtattggagattgagtagaaatttccttttgaaataatctcaggttaaaaccagatcttatgcaaaaggaaatgctactgttgcaaagtatacttttcatctaa

SEQ ID NO: 179479 - DNA, 601 bp, Human
tacttgacaggtaacagctgatttcacagggaaccagctattagggaagacctaataatattgataaaagctccccagaatgatcatcttcaagtacttaaaaaggtttttatttgaggaaattcagccttaccaaagtaaaggaagttgtattagttcagaatttcccagctataatctcctatagtactaccataggtaagacaaaacatgcctgcccagaaacgacctggaagatgatttttaaagttagtattttgtatctaggagttcattttttaaacattttttgttcatctgwattttcaaacttttctaaataaatatacattacttttgtaaattaaagttttttaaatattagtttaatttccaactcaggataactacataccatggaattgacctcctagaacagtcacaccatctattacagattgtgaaagtttctcactgctgggcctaggaaagaaaaggaagaaaataatatatcccatcctgaaactggcagggttgctggttctgcaagcaaatgcaaaaattacatgctacaaatttcaaaatagtaagttcctggtatctgaactgaaagctatgaact

SEQ ID NO: 179480 - DNA, 601 bp, Human
gaaatggtaccttatgaaggcaaccttagctctggtataatgatgagatgggaggagatggagaagctcaaaaaatacaaataagagcttagattagtttaatggaagtgtttactagaggaacccattattctaaaagacatgctaaagtaagaaacaaaataattttgtgaccaatatcaaaattaccaaataaacatttactaaatgactagtatatatacccagtgaaaagcattatctatccaactcatcaactcagaaacctggaatgtgttcttcacagttctgttctccccayatatcacaaaatcctttgaatgcaataccaatttttcaagagcggcctagctggtctgtttccctttcttaacaactttcctttcccttctctctgtgacaaacagagggactggcttaaatgaaaatgtgatcatatcactctcttgcataaaatccttcaatggagtcccattgcatctggaatagagcccaagttcttgccatgacctccaagatttgtatgaattagtcccaccttacctccctactctcttctcctagcccctcttctccctatgttgcagctacattaaccttt

SEQ ID NO: 179481 - DNA, 601 bp, Human
atgcaagcttcaggaaagcaaggactatggttttgttcatactgtagtcccaaagcctagagcatagagagtaagagctcagtatttaagaaatggataaataagtggcagaactgaactgtcaagtaaatgtcaaaacaagcaattcaatgaaaaggagctcaaattggttgactacactgacattttaaatgcttactaagtaaagcataataacatgaatgaatgaggcaactggatgaagtctgtagagttccagaatgcatgtcctattttaggggagcagcatctatctgactgyagtggactaatgccatgtgtgaacattttctgattttggtaaagagatgctagagattccaatatataagagaagtcacggaatttttaaacagtggcacacagacaaacacacaaatgcagccagccaaacaaaacatatctgcaagtcaggtttggcctaagcaaataatttagggtctataatgcagataaatccagaacacctcttactacaactaaaatctgaagaaaagtcttcctcctattctgcactgagtggaaaacactgattgctaacaactgtataagcagagttaca

SEQ ID NO: 179482 - DNA, 601 bp, Human
taccctcatgtttcctctcagtaatttttcatccactgaccaccccccacacaccctgctccttggctataaagccctacttttccttactatatttggagttgagcccaatctttctcctaccactgcaaaactccatcacattagtccctgtacctatcacaacagtcctgaatcaagtctgccttaccattttaacaagtgtcatgaattattttttctttaacactagtcctcaaataggaaaacttgaaaccaccatttgtcacacacatagtttatcctaaacttacttggtaayagggatggccacctgtgttaactgcccttctctaaaggagtaataaaacttttcatacctctgtgacaggtagatagttacaaattggacgcaaacacctaagttaaactctcctgagactgggagataggtgagctatcttccttgatgtttatatttgaaattggtgactctaggcccttaaagaaaagtattcctgagctataaaactggcttattaggcctttagaaagacttacattcattacaaaggcacagagaaagaattccaagttttctaaaggaaaactccaagaaaag

SEQ ID NO: 179483 - DNA, 601 bp, Human; identical to SEQ ID NO: 35419

SEQ ID NO: 179484 - DNA, 601 bp, Human; identical to SEQ ID NO: 35420

SEQ ID NO: 179485 - DNA, 601 bp, Human; identical to SEQ ID NO: 35421

SEQ ID NO: 179486 - DNA, 601 bp, Human; identical to SEQ ID NO: 35422

SEQ ID NO: 179487 - DNA, 601 bp, Human; identical to SEQ ID NO: 35423

SEQ ID NO: 179488 - DNA, 601 bp, Human; identical to SEQ ID NO: 35424

SEQ ID NO: 179489 - DNA, 601 bp, Human; identical to SEQ ID NO: 35425

SEQ ID NO: 179490 - DNA, 601 bp, Human; identical to SEQ ID NO: 35426

SEQ ID NO: 179491 - DNA, 601 bp, Human; identical to SEQ ID NO: 35427

SEQ ID NO: 179492 - DNA, 601 bp, Human
taaatccttctccacttttaaagaatcatgactgagggcatatccttgctccttgaggctctgcctgatttgttgtgacagagcaacagtctgcagcctagagctgaatgactgaagcaaagaggccagtaatgtgctatcctgtttgcctttaggcacactgtcaaccatgccagctagcaaagcttccttctttacgtttaaattcatgatagaatcagacagcctcttccgctttgctgcattccagtcctcagaagactgcaacagtctggcttttttgaggtgcagcatgccagayccctgatatgtatgtgtattgagaactggaccattactttgacaggtgggaaatgcactgccagaaatgttaaagttctgatcctcttcattatgcccagcagactttttgtcaacggcagtacctgatccccctgctgcctgatgcattagtaatccttctaggtaagttaaaacaatagaatcctggtgcacatcagagccaagctcttctccatgagtcatgttcaatagaagtgttcacaagggcttggtttctattcactttaaagaatggttttctgtggtgagtgcgatgtaa

SEQ ID NO: 179493 - DNA, 601 bp, Human
gttgatttattgcatctatatcaatggctgaaggtattttttttaatgttagttgttttaacttaaaaattttaagaacttttccctgctacaatatctagaaggtagtcgtctgtatttttaaccaagagttttaaagttatatttgcaacattttatactctttttcatctgtgcttgagttttgtatatggtgcgaggtagggatacagttttattttcatcatatacagattgaatctctcatatccaaaatgcttgggaccagaagtgttttggattttggacttttttttttttyccttcagattttggaatatttgtattttgcttacctgggttgggtaaatatccgaaatttgaaaatctgaaatctgaaataagccagtgagcatttcctttcaacatcttgttggttctcagaaaatatggagttttcaaattgtggagcatttcttatttctggcttggagttttgggatgtgcaacctgtaaatgattttaaaaagttcttttgttatccttgctttattgaaaagttaatgctctcttctactgaattgataggccatctttgtcatatatgcaaaagtttaatgca

SEQ ID NO: 179494 - DNA, 601 bp, Human
gtttaatgcaaaatttttttccctttccttgactttcatcattcattttgtgaatatcatcctgtgttcattgttgttgctttaaaataatctctcatactggaaaagaaagttctttgcctttgttcctttttttcagaagtaacacttgacttttccttagaaattttagaatgatcataccaagctctctcaaatcctctgtctttttgattaatttgattgaatctgtagatccatttgggattattaagatctttatgatacaggatgagcaggatatactatttttattaggtcrtgtttaatatctcttgtatggtttataatttaacacaaaactattgtacatcttttgtttcaggtagttgataatttctgataactgttatatggcagtgcttttaaaaatttgttattggtgtatgcaaatgcagtggtcttttgtatgttaattttatacctagccaccttgctaaatgtttctaataccttttccagagacaattttgtactttctgtgtaaaagatcatatcattaagggaggagaccacgcctcatattgtcttatgcccaatttctgccctcaaagaaagaaaa

SEQ ID NO: 179495 - DNA, 601 bp, Human
cgcatgtggcttccacagctggactccagcattcagatgaggggaacgtggtggaacccagaaactcggagacggcagcaaccgtggagccccaagggggtgtcatagcttctgcctggggagtcccgaggtctgagccaccagggaatgccacagccctctcttgttcctgccgctcacagctccctgaatgggggtgtgttagagcttgtttattcctgctgcgcatggctttgtgaatgggggtgtattatggttctagttcgaggggtcctgatgtttgggcccccagaggggtcgyggctcatcactcccatattccagcaattgggagtgtgtaacagctcttttcatgcccactgcccacagctccaggagccagccaggtgcgtgttacagccgttctttgttcccaccgtttggcgagttctgggtttttgtccagtgaccaagaataatgaggtacgtggacaccagagagtgaggaaggcagagaagaatgttattgagcaacagaaaagctcttgacaatgagaggggacgtgaagtggatagccctctgtgtgagggggccccaaaagctggtagccatctttgcagt

SEQ ID NO: 179496 - DNA, 601 bp, Human
atgctctcaagtgtgtttttttttttaatttttttttcttaagctatagctcagtaaatgccgatatttccatgttgaactgaacaggttgtgtgatttaatgtagagcaggatacacttgctgtgaataagaggtaacaattatagcttacctataagttagcgccaaataaatattcatcagaacttgtgagtactttgccttgtgtacatatttgagtgcctgggcaatcaagagagtgacatactatgcagcgtgataactgcttttgtagacattgtgaaatagtattcttatactgaagtaataattgtattctaaatattgctttattgctagtatgtgtttctgcttatctgtgggaattttccaaggtttgtctttgattttctgatttctttgcaagctttacctttgagagattatatattttccgagtcatatatgttcattactatcaagtatgtgtattgaaaataagtgtaatgttacatcttcacataaattctagttttaggttttcaattgcatgtgtacatttctgcttagtcatcactcagtatcatgaccgttcatttatgtattctttgttttaagcag

SEQ ID NO: 179497 - DNA, 601 bp, Human
ttccaagagaccataggacatattatataagtaattagcatgaccaaaaactgtatttgctttaaagaattgtgacaaatataactgctaggaattatatagtattccagtttcagagttctacttagagcacgtttattttgttttattagtataagggagtttatttttggattataagctaattaggcaaacaagtacagaaactagagatgcataaagatttaattggacaagagagctataataggaatctgattattagcatcaacaagttaaatacatattttatttaaactgmagacatagtgatttaaggatatgatttgattcataaaagttttgtttacctacttgttttccagaatataggcactctaatttaaaaacagactgtgttccaaaagattttgcaagttgggtttttggaactgaaaatacatgttcccatagaaaccatgtttcctggtggtgtgttcttatttagaaatgtaactctgtgtgaacttagcttatagtgctgagtaacagtattttttgggagaaatacatttagagtttctactcatgatgtatttattttatctactaattaataggg

SEQ ID NO: 179498 - DNA, 601 bp, Human
cattcatttgggagacaccttttgtcctttgcccttctctttatcctacctagaacttggacaggatgatggaggaggagaccatgcagtgacaaacattctgatgcatgttccactttaaagacttgatgttgggtgtccctactaggtctggactgcccattgtgtcttctaagttagaaaagaaagacactccagagtattgaagctgctgtttagttgggaatctgttacatgtagctgaatatagtttctatctaatacatatgatttctgtaaaagatacttgggctgcaatatmtcttaaacctttcatgtaatttgtttaggactttttagacttctgaaaatacatattttatacataaattgtcaagcatgttttgaaatgcacattttacaatttgatgtcaacaaagctgaatgcagaacattttaaaactttttattttgaaatttcaaatttaaagttgcaagacttagtacacagaacttccataactttttttctccccaaaccatttgatagtaagttgcaggcatcatgcccctttagcacttaaattcttcaggatatatttcctaataaaaaagatactct

SEQ ID NO: 179499 - DNA, 601 bp, Human
atacatatacctctttgttgatattagctggaatatcactgtttacaatggactgtttcttttagaaggaataaattttttttttgctgactagaaaaatttagtttttaaactaatatcacatggaagttatatttggggcatatggagaaatttttgtttatgcatacctggtgtgtcagaggctaaactatattatgtcactggatttgaaaaacaatttgtgagccttcctttaatattgaagaagtaaatatattttcaatagttagtaggacaattatatgcctttttggtgtaytttttacctttcacttttgagagaaaaaggagacatatcaaagaaatcttgtgctctgcataaaaaagaatttagaagtcgtacacctcatgtctttacttgattacattccatactgtaattctgttgaattctggaaaaaagcccaaatcatttgtactataattagcaaacgtactaggtaacattttttattatttggacctctgttcagatcagatcaaatattatagattgtcaaatgagtgcctgttgtccctggcttaaattgagaataaaattgttttggagttttgctgt

SEQ ID NO: 179500 - DNA, 601 bp, Human
taatatcacatggaagttatatttggggcatatggagaaatttttgtttatgcatacctggtgtgtcagaggctaaactatattatgtcactggatttgaaaaacaatttgtgagccttcctttaatattgaagaagtaaatatattttcaatagttagtaggacaattatatgcctttttggtgtactttttacctttcacttttgagagaaaaaggagacatatcaaagaaatcttgtgctctgcataaaaaagaatttagaagtcgtacacctcatgtctttacttgattacattccrtactgtaattctgttgaattctggaaaaaagcccaaatcatttgtactataattagcaaacgtactaggtaacattttttattatttggacctctgttcagatcagatcaaatattatagattgtcaaatgagtgcctgttgtccctggcttaaattgagaataaaattgttttggagttttgctgtcaaaaacacaaatgaaaatgagaccaggacacgatacccggtattgagcattataggtgtgattaatagtcagaggagagattctgccaagtttttgtgtcacggcaaactct

SEQ ID NO: 179501 - DNA, 601 bp, Human
tctgagctatgcctggaaattggaatgcaaagtctagttgccgcttatattccatctcttgacattcttaaagctggaaattggagcctggaatactgtggaacaacttaaatcttttcaatcaagctagagaaaacagccaaaggcaacaggataatggttgccacccccccccccccccgcccccgctgcactctgccttccatgtctcgtgttagtgcattctaatggatgaggcctaagtttcatccaaaaccctaactgccagtgaataaggaagatagtttttctgttttttttwatgtttagtttctataattgaagaaagtaaacttaagagaacgagttaatggaatctgaccgctaattaatcacacacctaaaccctgtttttctgcttctctgtgattttcaaattttttccacttttcattatcctttctctacttagacctaagttctagccattttaataaccaagatagctttcatttttatgaggcattccatacctttttaatcctcactgcttcatcagtgtttatgaatgttcagttctgggttacactcatcttcagctgtggtctgggtggacttggat

SEQ ID NO: 179502 - DNA, 601 bp, Human
gaaattggagcctggaatactgtggaacaacttaaatcttttcaatcaagctagagaaaacagccaaaggcaacaggataatggttgccacccccccccccccccgcccccgctgcactctgccttccatgtctcgtgttagtgcattctaatggatgaggcctaagtttcatccaaaaccctaactgccagtgaataaggaagatagtttttctgtttttttttatgtttagtttctataattgaagaaagtaaacttaagagaacgagttaatggaatctgaccgctaattaatcacayacctaaaccctgtttttctgcttctctgtgattttcaaattttttccacttttcattatcctttctctacttagacctaagttctagccattttaataaccaagatagctttcatttttatgaggcattccatacctttttaatcctcactgcttcatcagtgtttatgaatgttcagttctgggttacactcatcttcagctgtggtctgggtggacttggattttgtaaccagacttgtaaaacctttggcctgctgttgcctgtaaagtgattcaccatttcaattactatgctata

SEQ ID NO: 179503 - DNA, 601 bp, Human
ttaccacttccctacttagcaatataccatggtttctatcactgttgaaatgataatgggagtatttatcattggcatcatctgggttagggaaattgaccaatatatattgggaaattggattaaaagtcatttttattgaaggcggtattagttgtaaccttttttggaaaaagaattaatacttaatagcatcaaggctattttttattagaagagggcttgtttcattcacttgtatatttcatttttgtgaaatgagaatcttgttttaaattaaaaggactgcatatttattaarcaattcagattgtatagaagtatttaaatagaaagtgaaagattcttatacttcttcctcctataactcctttcctcagagttaaccactgttaatagtttggcacattctttcagaatttaaaaaatgtatgtgtaaatgtacatctctggttagtttctgaaacatcagtttttaagagttcactgttaattattgtaatttgataatgtctagatggtagtagtatggacagaatttaatacgtatgtaatcgggttaacttcagaaagcagaaatgtcaatgtttaattgtattga

SEQ ID NO: 179504 - DNA, 601 bp, Human
gtcacatatatgggaattcccattagactgtcagtacatttctcagcagagactgcacaagacaggagagagtgggatgacatattcacagtgctgggaaaaaataaaaataaaatataaaaataaaaactgtcagcagagaatatatccggcagtgctatccttaagaaatgaaaaagaagggccgggcgcagtggctgatgcctgtaatctcagcactttgggaggccaaagcaggcagatcacgaggtcaggagatcgagaccatcttggttaacatggtgaaaccccgtctgtactaaaaaaaaaaaaaaaaaatacaaaaaattagccaggcatggtggtgggtgccggtagtctcagctacttgggaggctgaggcaggagaatggcgtgaacccaggaggcggagcttgcagtgagccgagatcgcgccactgcactccagcctgggcgacagagcgagactccgtctcaaaaaaaataaagaaaagaaaaagaaatagagacgtttccagacaagcaaaggtgatggaattcatcaccactggactggtcctacaaaaacacttagaggaaataataggaaatgaaagaatga

SEQ ID NO: 179505 - DNA, 601 bp, Human
agcagagactgcacaagacaggagagagtgggatgacatattcacagtgctgggaaaaaataaaaataaaatataaaaataaaaactgtcagcagagaatatatccggcagtgctatccttaagaaatgaaaaagaagggccgggcgcagtggctgatgcctgtaatctcagcactttgggaggccaaagcaggcagatcacgaggtcaggagatcgagaccatcttggttaacatggtgaaaccccgtctgtactaaaaaaaaaaaaaaaaaatacaaaaaattagccaggcatggtggygggtgccggtagtctcagctacttgggaggctgaggcaggagaatggcgtgaacccaggaggcggagcttgcagtgagccgagatcgcgccactgcactccagcctgggcgacagagcgagactccgtctcaaaaaaaataaagaaaagaaaaagaaatagagacgtttccagacaagcaaaggtgatggaattcatcaccactggactggtcctacaaaaacacttagaggaaataataggaaatgaaagaatgattaataccatgaaaatatgtgaaaatacaaaactcatcaatata

SEQ ID NO: 179506 - DNA, 601 bp, Human
aagaggagggaatacttccaaactcattttatgaggccagcattaccctgattcaaaaactagacaaggacacaacaaaaagaaacaggccaatatccctgatcaacctagatgcagaaattctcaacaagattctagcacgtccgattcaacggcatattaaaaacatcatccactatgatcgagattcatcccagagatggagggatggttcaacatacacaaatcaataaatgcgatacatcacagtaacaaagagaacggaaaccatataatttcagtagatacagaaaaaagcacrttacaaagtttaacatcccttcatgataaaaactctcaaaatagatatagaaagtatgtacctcaacacggtaaagaccatagttgagaaacccacagctagtagtatactgaatgcagaaaaaaatgaaagcttttccactaagatcaagaacctaacaaagatgcccacttccaccaatcctattcaacatagtactggaagtcttagagcagttaggcaggggaaagaaataaaagacatcaaaattggaaaggagaaagtaaaattgtctctgtttccagatgatatgatcttaaa

SEQ ID NO: 179507 - DNA, 601 bp, Human
ttaacttttttttatatacttcagtgctaaaattttcaccgttttctccctttttgcttctggtgcataatatcatataatttgattttctttgtttttctggatttacctcactttttaatatgctgtggtgcatcctaataagtaatatgctatgttattggctttcccaggacatgaagatgctaaggaatacctggattaacataaatctatagtagtatctttgcttctagccttgattatacgttgtttacttacatgccaaaaagcaatatctaaaatattgataccttagagwttcttagatcatcttaataggctatctcactttacttgcgctatctattaagaaggtttgtgcatatgataatttagacataattttaaaatattaagtatagttttaaggctctgaactgagtgctcatgaacatgttttgctgcctgtgtttggtcaagtagatgctatctcagcactattatggcaaatacatgagggtcattgattagaagcttttcttagaaaggtataagaagaaagaaagtatttgtaaataatattgttagaatagttgctttttatttctctatcctgtat

SEQ ID NO: 179508 - DNA, 601 bp, Human
agagggagagtaaaaggaaatagggcaaaagcatgtttgaagagattactcacaatattccaaacttgagaaagatcaagccatagattcaggaagcaataggaatcaaatagtataaacataaagaatactgcaccaaagtacatcataataaaacaaataactatagacaaagagaaatcctaaaagttgcaaggtggaaaaagatacacgtataaaggagcaaaaacaagactaatagctgactttgatacctttaaacatcaagtcacacataagcagaaataatgtctttaaagtsctagaaataaataactggccatcttgaattttatacctagcagaagtctttaaaaatgaagaaaaactagctgaaataattcttcaccagcacacccacaccaaaggaagttctaagtatccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttggtttcactttctgctgttt

SEQ ID NO: 179509 - DNA, 601 bp, Human
aaataatgtctttaaagtgctagaaataaataactggccatcttgaattttatacctagcagaagtctttaaaaatgaagaaaaactagctgaaataattcttcaccagcacacccacaccaaaggaagttctaagtatccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttgrtttcactttctgctgtttcagttacctgctgttaattgtggctgaaaatattacagtactgagagagagaaggagagggagagagggagaacacattcatataacttttattacagtatgttttctttacaattgacctattttattattcgttattgttgctaatctcatactgtgcccaatttataaatttagccattataggcatgcaaggaaaaaaaacataatatatatggagttcagtaatatctgtggtttccggtattcagaggagattttggaatgtatcctttttggata

SEQ ID NO: 179510 - DNA, 601 bp, Human
atccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttggtttcactttctgctgtttcagttacctgctgttaattgtggctgaaaatattacagtactgagagagagaaggagagggagagagggagaacacattcatataacttttattacagtatgttttctttacaattgayctattttattattcgttattgttgctaatctcatactgtgcccaatttataaatttagccattataggcatgcaaggaaaaaaaacataatatatatggagttcagtaatatctgtggtttccggtattcagaggagattttggaatgtatcctttttggataagagggtgctactctgtaccccattttcccattatttaatgcctctgttcttcctctaccactccactgcaaacatgactttgcagttgccaaatccaaaggttatttctctgtccttaatttattggaagaatgtg

SEQ ID NO: 179511 - DNA, 601 bp, Human
ctctttcctctttaaattcctcaaaagaatagtccatggtttgtctcccctacttaacagtagtcccccttatctttggtttcactttctgctgtttcagttacctgctgttaattgtggctgaaaatattacagtactgagagagagaaggagagggagagagggagaacacattcatataacttttattacagtatgttttctttacaattgacctattttattattcgttattgttgctaatctcatactgtgcccaatttataaatttagccattataggcatgcaaggaaaaaaawcataatatatatggagttcagtaatatctgtggtttccggtattcagaggagattttggaatgtatcctttttggataagagggtgctactctgtaccccattttcccattatttaatgcctctgttcttcctctaccactccactgcaaacatgactttgcagttgccaaatccaaaggttatttctctgtccttaatttattggaagaatgtggcaacctttcatgatattgctaatcttgtcctccttgaaatgtgccagctattttttgatgtacagcagaatcttttgtggaact

SEQ ID NO: 179512 - DNA, 601 bp, Human
tccgtgttgggagagcaaagaccaaaggcatggtgaaaggtgataaatgggctggttctgaatgatagtaaaggtagatatggcttaaaaagttgtgtgtgtaagttgaattaagaaaagtgaattgtggaaagagactagtcttccttctaagagagaagccagtcataattctttataaaacgaagaactgtttgctaagatgatttcttcattttataaagattcattacagagctctttgggtggggagtaatgattattttttaaaaatctcatttgtaagtttggtttttgattttgtgtgtgtgtgtgtgtgtgtgtgtattttaaagtgaaacccaataattgattatcatataatgcttgttttttcaaatatcttatatcctggttaaattataaaagtttcttgcatttcgtgtgaaacatttcacttgttatctttgtaaggagttggtaattatatatttcaacaactggctctaggtttgatgttacaacatctagtattttttttttagtaggctcaaatatcaacaggcttttttcttttcacagcaagatgtgagtgagtttacacacaaattattagattggt

SEQ ID NO: 179513 - DNA, 601 bp, Human
ttgtacttggtattagtaagttgctttagtgattgtgttatataaaggtggccttaatacgttttcacttgaactatgtgtttgcttcagtaaaagtaatttatttcagagtactttcttatcactttttacatagatcttcctaatactttctttcaaaccaatggttcttcattagggatgatttttagtttgtttgccaaagtacccccactgcaaaagtccctcaactttttgagaacttctagttcattgtcccctctcagcccttctctgtacttcactccttcctttttcatcyaaaacctaaaactctctttccccccttcccttctggcaccccctccctgttctctaaccttcattaagctgttcatcttttctgtgtctgtactgagtacctgaagattgctggcaaaaagtcacagaaatgggctaactgtagtggatcatgaatttgagtgatactgagcttccgtgctcccaatcctataacccaacttgttctgtgtaatcaccattctttctctcatttactgcaataaatattttcgttttttccactcatttcagatctaacttatctcttcattctctgaga

SEQ ID NO: 179514 - DNA, 601 bp, Human
tgtaatcccagctactagagacgctgaggcaagagaattgctggaactcaggaggcggagtttgcagtgagccgagatcacaccactgagctccagactgggtgacagagcgagactctgtctcaataaaaaataaaatgtcatcatcatcatcatctagttgttcaaaaaaaaaaaaatagtaatcattatcatcatctagttgttcatgccagaattctgttattcttgatattttccttcttacctatctcttatcctgctcagtcaagtcctgttggtgcccttccttgcatatatrtataaatgtatatgtatgtaattttatctcttttctgtatttttacttttaacaaccttcatccatgctacctttatttctggatagattctgcaatagtcttttaacagatgaccacccacttcacacagggactttaaaggtgtttcagagacataaacctgagcctgttattcttagatttaaccattcagtgactgtattagtccatttacatgctgctgataaagacatacccgagaccgggcaatttgcaaaagaaagaggtttaatggactcacagttttacatggctgggga

SEQ ID NO: 179515 - DNA, 601 bp, Human
aaatttatatcaaactggtattcacagttactccattggagaaatgtcatacaatatcaatgtttgtacatatcaattaggtactaaatctaagtttgcacagggagttccggtgattaaaaaattttctttgggcttaagaattagaaatgtgaattttaatttttaatagctctaacagatttatgagtatctatgatcccattactagtctgtaacagagtttttactggcatgcagcaaaataagaaaaataaggacagtgctctgggtggggtgtgtgcacttgtgtgcgtgtgcttgtgtgtgtgtgtgtgtgtgtgtgtgtgtgtgtgtgtgtcaagttgccatctgtcctttcttggaaggaactctcttttattcttttctattctattttttcttttttttcagaataagttattctgaacttttctctttcctactttgctgctgttaaagtgtacttaaaaaaatggattatggtagattttattacatttttttccttaaatgtgaaaatataattccctattatcattccccaattttatgctgatttattgatttttgaaaaaaatgaactatgtgacatggttgg

SEQ ID NO: 179516 - DNA, 601 bp, Human
tttgttaaccgtcaatttagaattctgaagatgtagacacatttgctatatgtaaaactgcccactataagctttttattcaaataaacaattaggccaatgagtatgtacacaataaatacatttttagtttttcaaaaatcatctttttaatctatcaactttgcatatctttagcttattcagattccgtctttttaaagttttatagtttagtttttttcaaacttttaagcccagccagttctctctcatttaaaaaaaaaaatgctcttatggttttctccaaacaggttgtttktggatttcatggaatgtggtatatagtaaactacataattgcagtttaactcttctttttttcacatttaggttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaag

SEQ ID NO: 179517 - DNA, 601 bp, Human
ttaaccgtcaatttagaattctgaagatgtagacacatttgctatatgtaaaactgcccactataagctttttattcaaataaacaattaggccaatgagtatgtacacaataaatacatttttagtttttcaaaaatcatctttttaatctatcaactttgcatatctttagcttattcagattccgtctttttaaagttttatagtttagtttttttcaaacttttaagcccagccagttctctctcatttaaaaaaaaaaatgctcttatggttttctccaaacaggttgtttgtggrtttcatggaatgtggtatatagtaaactacataattgcagtttaactcttctttttttcacatttaggttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaaggtaa

SEQ ID NO: 179518 - DNA, 601 bp, Human
gaagctatgtgggtccacaacaatgtagtttttagtagatgtcaagaggtatctaagctcaaatcacagtgtagtaactatattatagttcctttcatttttaaaacatttctgtccctttgtgatttcatgctttgcattctgtacatattctttccaaatcactcctcagaacctgccccaagatggagctactgtgttattgttcccttaacatttacttattccattcacatgtgactattcttgttattagtgggaggaaggggctgcatagtgtactataagcagttgtggtacytaagctcccagacacaggtgaatcctccattcattggttaagctccagttttattcttggctcacctatattttgtgataccaaaatattaagttctatatatcctcctcctcttcatcctgtctgtttctcatctctccaaattttcagagttaacatattttatttctgcttagtcaaacgaatacatatttccaactaatattcctatctattaaggactagccttgccccatcctcattttacatttgtcatcttttttctttctctgtgaaaagaccatgtgtgcataactgcat

SEQ ID NO: 179519 - DNA, 601 bp, Human
ttcagccagccatcctttgctgtcagtgtagggaacagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgcatactgttgttgagattttcagccagccatcctttgctgtcagtgtgtggatcagagtgagtaggggagcaracttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtggggatcagagtgagtagggtttttttttctgagtgtgaacagcacaccctacctaaggccacttaagagacactggagt

SEQ ID NO: 179520 - DNA, 601 bp, Human
attctagccaattttgtgtccccctgttgctctctctcttaatcagaaagcacatttatttctttttcatgttgctctactgccttctattaccttcaccgatctctagttttactttcctctctaattcgttcttcacaatatccccagaataattttttaaaaactgctatgttgccattatattatgtactatattatatacctgcatcatctcttgccatttctccactctcatactgtagtccagtcatattattcttttttttgaatgtagtccatgcttactgcatggactctycattcttccacctggaaaaacagctcattcattattcagcttaataggtcactttaggtcacatccaaattgctcacatcacttcactgccattgttcccatataaagtgttataatattgtcaaaatttatatatatgattatttggttagtggtgttctccacagatgactgtgagcttcatggagacagagactggctgctttgtcagagactcactgagataaaccctttaggtcatgtaaggattttgggcttgtctcatctagggaacacccagtggatgttcattgtacattg

SEQ ID NO: 179521 - DNA, 601 bp, Human
tttctcctgtctctcacccattcctccatctgtaatctgattacatgggaatagttgagaatttaagacctaattgtcataatttcatgaaatgtgtttaacaataaaactactagatactgtagattagagtattatttaaaactactagatactgtagattagagtattattagaaggataagtaggatgttgcaaaactgtttgtgaatattttaagaacgtcctgtgcaaaaacgtcattaggctactctattgtagttttcaactacatctttttatagcggtaaattgagcatgtttggtgttatactgtgttatcagtgaatatggcattctgagagaagctatttcaagaatttgttactactaaaccttttagttcctgtagtcatttatcttttattagtgagcataagcagctctaatgcagattttgtggtagttccttttaatatttgaagattccccttgacaactaaaaagagtacgacatatcataattttacaacacgtaattttctgcttagtaagtgaattcagtgccagcaataacctgctaattgcaatgaggccttaaatatataataagacttccttt

SEQ ID NO: 179522 - DNA, 601 bp, Human
ttgttaacaataaaaagaaaaaaaggaataaatctgattgagttgttaaaaatgggtatcagcttccaacagctttttcttattttcagcaggtgtttgttgaacacttaagatataaatatactggagcctcataggctgtatataataagttaaacaaaatagaatatggatattaactggatacacaattgattaccaaaaacaatagaaggataaaattataaggaaaaaaaccctacaaattctgatgagtttagaggaggtcatatcttattttggttgagatatcaagaaaggyttttgggagctattggactttttaaaaaattgtcagctatacagacaataatagaaaatacaactccactattttttatcttaagtacttaaagttctaaatactttcagggaaaaatgtaatgatattggtaatacccagtttgaggatgtaaagggaaaactgcagattttgtattactacttgatgaatgcatttgcttctgatgttcagttttaagtggtttcatttgataccaagtcaatgcaggtatttttaaaagatttaagagtatgtgcttaaacagtttaatagtgcatg

SEQ ID NO: 179523 - DNA, 601 bp, Human
catatcactgtaccagtgtaagaaatcacacgccataaagagaataagcagatttgtgagataaactggtcagagagttttctcaagcaggtgttagatatattgcaattctcagtatataatccaaagtaaatacaatgagtaataggttcagtgaatcagaggtgacggaggcaatctcttgatttctgtaagatagcttcatagggctttgagtaatttcactttgcagatattttaaaatgtaaacagctaaaaataataagctattatgaaaacaaaaaaaatgcttaagtatttatacttaatggctctacattgttctagttaactattttataaacatgctggctcttgaaaattatgggaactggcatgtttttaataaacctatcaatttattgattaagcagttaagtacttgttttaggatgtgccctctctcatttaaaaaagttgaattgtgattaatcatttaacactatcttttttgcaagtgcttatgtgacagagttgtgtgttttgtcgttttttaaaatttattgcagtgacagtttaacagtgcatgtgcattggaacttttaaaaatgagttgttatgg

SEQ ID NO: 179524 - DNA, 601 bp, Human
tacaatgttttgattacaattttttccttttacagatttgaaagatgaaaataccatgtatgttttgtcattttatttacattaactgaaaatcttcaagtttttttttttttcactcttttcaaacccttcttagtggttttaaaaagcagcttttttgaggtccagtttgctacagtgaactatgcatttctttctttttgacattaaaaatctaacatttttcattttctgtattttgccattatccaacttggtctttcaaaaactggttcttttttcactgtttctttcagtatasagtacaaaacaaaagccttgtacatagtagtagacctatcaataagcatttttgagtttgctaagattagggtgactaactctcctgatatgcccgggactgagggatttcctggactacaggatttaaagtgctaaactgggaaagttctaagcaaactggtcccaggacaagttgatcaccctattatgatcccataagaaaggttgaaaatctacttctaaaaaaagaagaaaaatgtattttttatagttttctgttttaatacatttctttatagtttctaggtttctaactggc

SEQ ID NO: 179525 - DNA, 601 bp, Human
ggtgtctaaaataaaactaacaatgacagtctctgccactgccatggccctattgtaaccattcttagcactgtgtatcttgtttttttctttttgtttataacaatgcacatatacagagacttaaaatttttttaatgtagattttactgttcataatattttgtaacttatatcactcagaaatctattgtgggcttaaagtttagacagtatcacattatctttactagctgtctgtatacacacatacacatgtgtacacatgtgtacacacaggtacacacatgtacacgcacaygtgtacacatacatgtacacacacatgcacacatgtacacccacacagtattccatgctatagatatattctcatttcttgtatcttaccctctttatggacatgtgtcctatattttctcccagtctaccatttctatttgaattagtttagagtactttttcttaaacaggttttaaaatagtatgttcgttttcctactttatggattttttttgccatattaaaagatctactcttacccaaagttatataaattttcccactacttacttaaaatacttttcttagtaaattttt

SEQ ID NO: 179526 - DNA, 601 bp, Human
ttctatatttaaattggatatatatatgtatatatatatatatatctatattttttttttttttttggatggcgtctcgctctgtcgcctaggctagaatgcaatggcacagtatcggctcactgcaacctttgcctcccgggttcaagtgattctcctgcctcagctcccaagcagctgggattacaggctcccgccaccatacccagctaattttgtttgtttgtttgagacggagtctcacactgtttcccaggctggagtgcaatggcatgatctcagctcaccacaacctctgccycctgggttcaagcaattgtcctgcctcagcctcccgagtagctgggattacaggcgcccatcaccatgcctggctaatttttcctattttttagtagagacagggtttcactgtgttggccaggctggtcttgaactcctgacttcaggtgatctgcccaccttggcctcccaaagtgctgggattacaggtgtgagccactgtgcctggcctggaaatttttttgactaacagcccaataggttttgatatctgatattcccatattagtatagttttttatttctttggctcaagaat

SEQ ID NO: 179527 - DNA, 601 bp, Human
ttcaagtgattctcctgcctcagctcccaagcagctgggattacaggctcccgccaccatacccagctaattttgtttgtttgtttgagacggagtctcacactgtttcccaggctggagtgcaatggcatgatctcagctcaccacaacctctgcctcctgggttcaagcaattgtcctgcctcagcctcccgagtagctgggattacaggcgcccatcaccatgcctggctaatttttcctattttttagtagagacagggtttcactgtgttggccaggctggtcttgaactcctgayttcaggtgatctgcccaccttggcctcccaaagtgctgggattacaggtgtgagccactgtgcctggcctggaaatttttttgactaacagcccaataggttttgatatctgatattcccatattagtatagttttttatttctttggctcaagaataatttagagccatattttaaattttctaagtatttaggttggaagatatctctatttataattcctatttgtattacagtgtggtcaaagaatatggccaatattatttcagtcctctggaatttgaagtaagttttcttcat

SEQ ID NO: 179528 - DNA, 601 bp, Human
gtaagttttcttcatttcttggcactgtcagtttttaaaaaatagcccataagcattttaaaatacacataaactctcttaaccaactttattttagagataagagcaatcagacttagaagattatgtgccttattctatgtcacaattaattataaatgatgtatctagctttttgaattttaatctcatcagtttcccattagatttaactgcctccagaatataaatgtttatatttttggtatccacatactcacatatatatatatttggtatcttcatatatatatatatatakatatagagagagagagagagagagtttacataaaaaattaagtccataagaagttataaatttagaatatggttttacagtattacttagaaaagtagaaaaaagtctaggtagaaattatttgcatctttagaactgaacaaggtctcaaaagcatgacttaaactaattttgctgatgggtcatctgtaggtagatggggaatgaacaagaaaggatatcacacatatggagaacttaagaaacaaaggcatgtgtgcatttgtgaggagacaagcctaacctagataggagggagat

SEQ ID NO: 179529 - DNA, 601 bp, Human
agcttctattttgaaagtaggtaggggaatgatgaccatttagtggaatcactccgtgcatgtaaacctgcaatattaatttaagagactcagtacaaatttgttttattttggtcatgctattttgtactaaagtatgatatacgaaatatttgaatattctaaaagtctattacaggttgagtatcccaaatccagaattcaaaatctgaaatattgcaaaatccaaaacattttgagtgccaacatgatactcaaaggaaatgttcattggagtatcatggattttggatttttggaytcggaatgctcaaccagcataatgcaaacattccaaaatctgaaaaaaatctaaaattggaaacacttctggtcccaggtatttcagattagggatactcaacctgtagcctgtgacaatcattatcgaaggttcatatcaacaagaacagtaattgaattgttaatgttttagatttattctcaaattcttcctactttgattattatgtttggtctccccccttccccgtttttttttttttttccgaatttggataataggaagatttttaaagagctctaagagaagcttatgtgt

SEQ ID NO: 179530 - DNA, 601 bp, Human
aatatgtttaaatattacaatttgcttgtcagttttcaaatacatacttattcagaaagttaatattctagtatagtaaatacttaccaaattagaaggattaactagaaaatcaataatggtgacagatattacttgtggaatatcttttaaagaaatattggtgtgtgtgcgactgtgatcccagctactcaggaggctgaggcaggagaatcacttgaacccgggaggcggaggttgtggtgagccaagatcgcgccactgcactccagcctgggcgacagagcgagacactgtctcaaaaaaaaaaagaaagaaatactgttttttttttttttttttttttttttactttaaatctttaaatatagcagttattgtagctagctgtttgtaaaatattgccaaaagattctgtcaaaattgtttttaatgaaaatgtaaacatttaaaggcttgaatgaaatactgatggacccttgtgagtcctgagaacagtgaagtgaaatcatggttgcaagaaccataattttatagagtgtaccaggctacatgatcttattttatcttagataagaatatggtaattggactgctaaat

SEQ ID NO: 179531 - DNA, 601 bp, Human
atgagtacccaaacactgccttccaagaagcctctaaaatgcctctagctggaaaggagtattctttcctatgaactccccaagcacccagcgtttccctaccttagcacctaactcattttaccttatattgtatttatttgcttagaagctttctactcctatcggactttaagaatattgtaaaaatgccctgtggcccatcacggttaatagccaagtgctttacacacagtagacaactatatgaaagaaaatggaactatgaattggtgcgcctcactgttcctaagatttgggcttggacctgatgacagctaaggtggtcattcctttccaaaactatggttctacaattgtttttcttggacttacattatgtcatttcagagtcttttgtcctttaatatacattctcagagatctgtaactatggaaatagccttttaaaaaaaagagctgtgtttatacatttcccccaaattacaatgtcacagaaaggccactaaattgaggctaaaatatactttgataatatatttttccccaattagttttatgatcttcggctaatcaatgtctaagggagttacttttttca

SEQ ID NO: 179532 - DNA, 601 bp, Human
taaccccataccatccttatactcttcatataccctatactccagggaaatagaattataccattcaccaaatatattttgtgctttctagcacaaactaaggcattttcatgccttagttcacaccattctttcctcctaaaagatactctcctcttaccctcatttatctgtccaaccttcatacactgatctttaaaacctagagtaaacccctgggtgtacaggtctactgaaggcctcctgtgggtttgagaactgtttcatgctataaggaaaatgatgtgagtaaattcttcaygtttttttctttaaactgggaagatgatccacagttgtccatgagattctcaagagggatgagtacccaaacactgccttccaagaagcctctaaaatgcctctagctggaaaggagtattctttcctatgaactccccaagcacccagcgtttccctaccttagcacctaactcattttaccttatattgtatttatttgcttagaagctttctactcctatcggactttaagaatattgtaaaaatgccctgtggcccatcacggttaatagccaagtgctttacacacagtagacaa

SEQ ID NO: 179533 - DNA, 601 bp, Human
aaaggtggcatttgagaaacatcaggcatctggggccagggtttattttgagaccttctaagatggaaaaagcaaagacatagaggtggtaagggattggctgtatgtggggaatgctaaggagtctagatggaaaaaccagcagaccccagatcatgggaggcccggaatgttaagcctgggagtttgtattttatttgccaagcaataaaatgacaaaattagacttgtgcattttgggaaaataaatatagcattatggaccagcagcagggccaactgggtctcattaattctttgragaaattcttctgtttttgtcataaatactactgcctacctagcaatgaacaatattctaaatgtaaaaaaatgtacacatgaaaattccttcaagggtaataacatttttacacatgcctatgatcaaagtatacagtcttatttaagttaaagaacatgcacaaaaaatacataggtggctccaatttaagaacttgttatcaatatttcttgttagagacccaattttcttttagattagcactgtccaatagacctttttgtgatgttagaaacgctctctgtctgtgctgtccag

SEQ ID NO: 179534 - DNA, 601 bp, Human
caaaaattaattttgtgtactagcttacaaaaacaaaattacttttcaccaccacattccaacagatctttttttttttttcttttttgagacggagtcttgcttggtcgccaggctggagtgcggtagcatgatcttggctctctgcaacctccgactccctggttcaagcgattctcctgtctcagcctcccaagtaactgggattacaggcacacgccaccatgcccagctaatttttgtatttttagtagagagggggtttcaccatgttaaccaggatggtctcgatctcctgacytcatgatccgcccgcctcggcctcccataagtgctcggattacaggcgtgagccaccacacccggccaatagacctttttaaagcattcatgtagtcaaagaaaagacttcagaaagaaaataagtatttctacttcaatttcaattcaaactattttattacgatgaggtttcacataaatgaggtatcctcaaaccaatctctaacattcaaggtttctcagaatcacggacactcactaagtcagaatttctcagggtctaagttgcaaaaggtgtatcgttaagtctacaggctct

SEQ ID NO: 179535 - DNA, 601 bp, Human
atgcattccattaattgactttgcatatattatgtcatttaactacatatgcagaagatactataattctccccaaatgtcagatgaggagacatgcaccagttaattactcaagattacacagctgaaagtgattataaggattcaagattgggcagttcgatttcagatccccaccatttaatcactatgttatgtgatctcctatactgctcttattctaacagcaaacatttagccggcagcttctcaggcacacgtcatggtcctaataaattcacatgtcaacactgtcattcarttctctaaaaatccaggtaagtgtaaatattcttcacttatcccccacaagaatgaatctgtgatttataagacgtaccttcaaatttgaaggtgggaaatgtattcatgtctgcattaccaaacatttgcttgagcttaaaaagctccctctccagctcttgctgatactctgaactagcatcaacaggtcctccagatgtcctgttaagtaaatgagcaaacaaaaattaattttgtgtactagcttacaaaaacaaaattacttttcaccaccacattccaacagatcttttttttt

SEQ ID NO: 179536 - DNA, 601 bp, Human
acccacctctgctttggatcctgggccactatttccaactgcgtaactattcaacttccattcgaatacctaacactcttcactctccaagtacactcacctgttaattaagtgatacttaatgtactgatactactatgtgcaaagccatgtgccaggtgcccctacaatagaacatgacattgcaagttgcaaaagctttggcagaattttccagtcagatggtacagcttttgcaaagacatagagatctgaagggtttgatatgtcttgggagttgagtagttcagtgcatgtaagrcacctaaccagtgcttctcaaactttgtgcatctgaatgattcttacaaggaagtctaggtggggcttgtgagtttgcattttaacaagttttacatgatgtcactgctgaccacgttttgtgtgggcaaagatctaaaggccatactgagagcttggtgggagctgacaggtctgtcaggttatgcaccctaaccccacggtactaagacatttgtggaagtgtcgagaagtaaggttatacgctgagatttattttattgaatggtagctatgtagcagttctcaaggaaggtagaac

SEQ ID NO: 179537 - DNA, 601 bp, Human
tcgaatacctaacactcttcactctccaagtacactcacctgttaattaagtgatacttaatgtactgatactactatgtgcaaagccatgtgccaggtgcccctacaatagaacatgacattgcaagttgcaaaagctttggcagaattttccagtcagatggtacagcttttgcaaagacatagagatctgaagggtttgatatgtcttgggagttgagtagttcagtgcatgtaaggcacctaaccagtgcttctcaaactttgtgcatctgaatgattcttacaaggaagtctaggyggggcttgtgagtttgcattttaacaagttttacatgatgtcactgctgaccacgttttgtgtgggcaaagatctaaaggccatactgagagcttggtgggagctgacaggtctgtcaggttatgcaccctaaccccacggtactaagacatttgtggaagtgtcgagaagtaaggttatacgctgagatttattttattgaatggtagctatgtagcagttctcaaggaaggtagaactaatagagctaacacaggaatcctctgggatgatctggacgtaagcagtccctgttgaaac

SEQ ID NO: 179538 - DNA, 601 bp, Human
cattccacaaaacatggtatttctccttaaggccaattcctgaacttcagaccttttggcttctcagggatgtcactctgttatcccatctattatatctggattccgtcaactttaaccaagcttatttatccctctttatattccttcggtactgttgtcgctttgcctttattttttatttttaaattatttatttttttgagacagtgtctctctctcttgcccacgctggagtgcagtgggctcaggtgattcttctatctcagccctcaagtagctgggactacaggcacctagscttatttttcttctttcttccttttttttttggagacggagttttgctcttgttgcccaggctagagtgcaatggcgcgatctcgactcaccgcaacctctgcctcccgggttcaagtgattctcctgcctcagcctcccgagtagctgggattacaggcatgcaccaccacgcctgggtaattttgtatttttagtagagcgggggtttctccatgttagtcaggctggttgtgaactcccgacctcaggtgatccgcccgcctcggcctccgaaagtgctgggattacaggtgtgagc

SEQ ID NO: 179539 - DNA, 601 bp, Human
ctcttgttgcccaggctagagtgcaatggcgcgatctcgactcaccgcaacctctgcctcccgggttcaagtgattctcctgcctcagcctcccgagtagctgggattacaggcatgcaccaccacgcctgggtaattttgtatttttagtagagcgggggtttctccatgttagtcaggctggttgtgaactcccgacctcaggtgatccgcccgcctcggcctccgaaagtgctgggattacaggtgtgagccactgcgctcagcctttatttttctttattaaccagatttctggaaraaatagcctgcatgtactgactgcattattttctttcatgcccactaattcttccatcctttgcaatctaattttcatccccttctacttctatgaaactgcagttgctgtagattgcagttgacactgtggctacatccggtggtcacatcgtatcttcagcctcttaaacctcagcacaaatagctctattgaacagtttctttctgctcttgagctattcctcatttccttttgtatggtccatttccttcgtgtaccgtaaatgccaacatttctcagtttatgggtgcagttact

SEQ ID NO: 179540 - DNA, 601 bp, Human
tgtcattgttttctcttgccagaatgtacatttcataggtcaggcactgtttacattgtattcccagtatatggcacagggcatgttcattgcataaatggggaaagttatgctagacaggaattcatgtttgtaggcttgggaaggacctagaagagaaagagcatttgaagatcaagaataggtacctcatggaagaggtgagcagggctgggctctgtgtcctgcacaggtcagctttgtgtcagctttgccaggtgttcaggagtggagtttatatcaccactcacatttagttctsctacttgcagccagttctctccccttcccttatttccacctttcatctgtcatagaagtcatcatcagatgagagttgatgctttgtgtcattaaataaaggaaataattgaggctgggaactttggattcagtttatttggtggctagcaagtagttgatgtgaagataattattaaattaaattaattattaaaataagataattattaaaataatgcagaaaacaattaaaaattatccaaccagaatgaccttatgggtttatcttactgtctttcatctaacttctgtttcttaa

SEQ ID NO: 179541 - DNA, 601 bp, Human
caggagtggagtttatatcaccactcacatttagttctcctacttgcagccagttctctccccttcccttatttccacctttcatctgtcatagaagtcatcatcagatgagagttgatgctttgtgtcattaaataaaggaaataattgaggctgggaactttggattcagtttatttggtggctagcaagtagttgatgtgaagataattattaaattaaattaattattaaaataagataattattaaaataatgcagaaaacaattaaaaattatccaaccagaatgaccttatggrtttatcttactgtctttcatctaacttctgtttcttaagaaaacaaacctagtaatctagaataataattgttcaattgggtttggatttaggttggttctttttatttttctttttcttttttaaacagagtcttgctctgtcgcccaggctggagtgcagtggcgcgatctcggttcactgcaacctccgcctcccaggtttaagcaattctcctgcctcagcctcccaagcagctaggattacaggcgctcaccaccatgcccaggcgattttgtgtgtgtgtgtgcgtgtgtgtgt

SEQ ID NO: 179542 - DNA, 601 bp, Human
aaataattgaggctgggaactttggattcagtttatttggtggctagcaagtagttgatgtgaagataattattaaattaaattaattattaaaataagataattattaaaataatgcagaaaacaattaaaaattatccaaccagaatgaccttatgggtttatcttactgtctttcatctaacttctgtttcttaagaaaacaaacctagtaatctagaataataattgttcaattgggtttggatttaggttggttctttttatttttctttttcttttttaaacagagtcttgctcygtcgcccaggctggagtgcagtggcgcgatctcggttcactgcaacctccgcctcccaggtttaagcaattctcctgcctcagcctcccaagcagctaggattacaggcgctcaccaccatgcccaggcgattttgtgtgtgtgtgtgcgtgtgtgtgtgtgtgtgtgtgtgtatttttagtagagttggggtttcaccatgttggccagcctggtcttgaacttctgacctcaggtgatccacccacctcagcctcccaaagtgctgggattacacgtgtgagccactgtgcctggcct

SEQ ID NO: 179543 - DNA, 601 bp, Human
tatgcttttttccccatgtattcaaatgaaaaatattgggatattaaaatgtttttcgtactttgccagaatctggtcagtgtttgacctacagcacatctcatttgcactagccatgtttcaagtgccagcagctactgtattggtcagcactaggagttttagttccagtcatcttccaccatagtcctagaacatttaacctgaaaaagcatgggggcagtgtgccatcaaaacagctttctcaaatggaacatgcctttggaatagttctcatgagattttacttctaaaatcgttrttttttttttgtcacatagtatttgtttcctgttagcgatgagctaaaatagtttcttatttcttacttaatctcttgtagtcatcaaaacatttgttacaggcacacaaaattgtatcagctctccttattccatagttaaagccaatcacatcttgagtataaagcagaaaagtatatgcataataattatatttttaatttgcctaggtggggaaataaatgcatttatggaaaggtccaaaagaagcaggatagaatggccccaggtaatggttgctggggaaatttgaattcact

SEQ ID NO: 179544 - DNA, 601 bp, Human
tctttctttttttttttttttttttttttgagacagagtctggctctgtcgcccaggccggattgcagtggtgagatcacagctcactgcaagctctgcctcctgggttcacaccattctcctgcctcaccctctcgagtagctgggactacaggtgcctgccacctcacccagctaatttttttgtatttttagtaaagacggggtttcaccatgttgtccaggatggtctcaatttcctgacctcgtgattcgcctgccttggcctcccaaagtgctgggattacaggtgtgagccacygcgcccggcatgcttagttcttttttcttttttcccacgctaaaccagagaccctttttttgaaatggagtttcgctcgttacccaggctggagtgcagtggcgcgatctcggctcaccgtaacctccacctcccgggttcaagcgattctcctacctcagcctcccgagtagctgggactacaggcatgcgccaccacgcccagctaattttttgtattttttagtagagacggggtttcttcatgttggtcaggctggtcttgaactcccgatctcaggtgatccgcccaccttggcc

SEQ ID NO: 179545 - DNA, 601 bp, Human
aaatacaaagcttagttggtcgtggtggcagggcgcctataatcccagctattcaggaggctgaggcaggagaatcgcttgaaccagggaggcggaggttgcagtgagctgagtttgtgccattgcactctagcctgggcgacggaacgagactctgtctcaaaaaaaaaaaaagaaaagaaaaaagaaagttaagaaagttccagttgcgctacatccttatcatggccttctttcattttgactattctggtggatgtgttagtgccatctcattataattttcttttcttattctttytgttatggaaaatttcaaatatatgtaaaactagagaaaattatttggcacatcccagtatatctttgctcagctttatcaactctcagctcatgtcggactttttctgctgctctgttgactctgatttgtttcgccattcctcctcacaggtgtctcagacttggaccagtctctaaaattctctacctacaaaatgttcagcctcttgtattttaagttaatattgtagtccccgtttgtcacagaggatatcaggtacaaattcttgcaatttcttgtactctaatgtgtaaactt

SEQ ID NO: 179546 - DNA, 601 bp, Human
ttcagcctcttgtattttaagttaatattgtagtccccgtttgtcacagaggatatcaggtacaaattcttgcaatttcttgtactctaatgtgtaaacttaacgataagtgtgccaatgtttacatctttccttcaatctctttttggttttttagagttaaggtctcactgtattgtccaggctggttgagcaagtgatgctccctccttgtctcccgaagtgttgagattacaggcttgagctacggtacctagggtctaataaaaggtgtcttattcctgatatttgttttttgggttttttttttttttggtggtgggggacagggtctttttctgtcacccaagctggaatgcagtgatgcagtcacaactcactgcagcctcgacctcccaggctcccacctcagtctccgtagtagctgggactgcaggcatgcaccaccacgtacaactaacttaaaaattttttttttagagatggtgccttcctatgttgcccaggttggtctcaaactcctgggcctaagcagtcttcctgcctcaacctcccaaagtgttgctattacaggtgtggtgaacaggtccttattgacagt

SEQ ID NO: 179547 - DNA, 601 bp, Human
tacggtacctagggtctaataaaaggtgtcttattcctgatatttgttttttgggttttttttttttttggtggtgggggacagggtctttttctgtcacccaagctggaatgcagtgatgcagtcacaactcactgcagcctcgacctcccaggctcccacctcagtctccgtagtagctgggactgcaggcatgcaccaccacgtacaactaacttaaaaattttttttttagagatggtgccttcctatgttgcccaggttggtctcaaactcctgggcctaagcagtcttcctgccycaacctcccaaagtgttgctattacaggtgtggtgaacaggtccttattgacagttttctaggtctcattcttttttgagggcttgatcttttagtctctggtgtttggctataagatttttaacgtctcctattctatttgctttttccttttgacttataaatgtactcaatgtttcccatttcaaaaagaacctttccttgaccacatatcatacactgtctattttctcccctcatcgagaacaaatttctcaaactagtagtcatttctgtctttgctcacatctctcaagcact

SEQ ID NO: 179548 - DNA, 601 bp, Human
cttcctgcctcaacctcccaaagtgttgctattacaggtgtggtgaacaggtccttattgacagttttctaggtctcattcttttttgagggcttgatcttttagtctctggtgtttggctataagatttttaacgtctcctattctatttgctttttccttttgacttataaatgtactcaatgtttcccatttcaaaaagaacctttccttgaccacatatcatacactgtctattttctcccctcatcgagaacaaatttctcaaactagtagtcatttctgtctttgctcacatctytcaagcactgtggtcagataatatcctgttgcagctccccaaaaccttcactaaatctgatttggcctaggacaccgatgatgttctaattgccaaatctagtggatacatttcagtgtcattttttttacataataaattgtgagttcttcctagtggaaggcactgctaaatgccttttaaatataaaagatgacaagacatagggttatgtatcatagtagaagtattaggcttatcagatgacagtgaattgcctactagctactatttattgaagagtgaacaccaggatgtgct

SEQ ID NO: 179549 - DNA, 601 bp, Human
caggtgtggtgaacaggtccttattgacagttttctaggtctcattcttttttgagggcttgatcttttagtctctggtgtttggctataagatttttaacgtctcctattctatttgctttttccttttgacttataaatgtactcaatgtttcccatttcaaaaagaacctttccttgaccacatatcatacactgtctattttctcccctcatcgagaacaaatttctcaaactagtagtcatttctgtctttgctcacatctctcaagcactgtggtcagataatatcctgttgcagctccccaaaaccttcactaaatctgatttggcctaggacaccgatgatgttctaattgccaaatctagtggatacatttcagtgtcattttttttacataataaattgtgagttcttcctagtggaaggcactgctaaatgccttttaaatataaaagatgacaagacatagggttatgtatcatagtagaagtattaggcttatcagatgacagtgaattgcctactagctactatttattgaagagtgaacaccaggatgtgctgcagctgttctaagaggtttacatgtgttattta

SEQ ID NO: 179550 - DNA, 601 bp, Human
tgttctaagaggtttacatgtgttatttaatttctccaatgaagtaggcattattatttttaatcttcattttagagaggaaaacatctagtcacggagaggctagaaattgcctgtggccaagcatttagtgagataaatttgaatctgaacccagatctaactttagaactcctactgtttaagaaatgtctgcatttgttgggagctggactcagagaactcctgctaatgcctttgagatgtggatacaggggaggagaagaaatgattgtcagggaaggcttcttgttggttgatwgatcaatgggctagaattagaacatacttagttaggtctgaaatagataatttagttcaacacccctaatttacatttgagccctagggaagcaacttgtccaaaatcatacagagcttttttgtgtaataaatttggcaacagtcagataacctagtctgacatttatttttctgtttttccaaaaaaagaaaaagtttcacccaaacccctgaaccatgtgccacctaaaatgctactagaaatgtagcatagaagaagagtataaattccaaacatttctctaccatggtgattgga

SEQ ID NO: 179551 - DNA, 601 bp, Human
atgactttcaaatattgctaatctcaaagcaacttcctgggaagaagaaaggcaaaggttggagttagggtctggcagagggggaaaggaaatggtgcaaatagcatggtggtcacctttttgtatagagtttagagtatctcagtgacttgctaacctagacatctatagtatttgtaattaaatgcacaaaattacacttgtctttatcaatcttcttcttcattttctcgaacctctaaatctacttataaatcttttaacatactagttcctgatttgtctaacttattttcttccttttttttttttttgagaaggactcttgctctgtcaccaggctggagtgcaatggtgcaatcttggctcactgcagcccctgcctcccaggttccagtgattctcctgcctcagcctcctgggtagctgggattacaggcacatgccaccacgccaagctaatttttgtgtttttagtagagatggggtttcatcctggccaggctggtctcaaactcttgatttcaggtgatccgcctgccttggcctccgaaagtgctgggattataggcatgagccaccgcgcccggcctctaactta

SEQ ID NO: 179552 - DNA, 601 bp, Human
ctcttatacaaaggcacttgtgcctgtgaacattgttttgcctgccacttccctcagagatctcaaaattgttatctgcttacctccaggcatccagacttgcctgattgctgttttattgttacaacaaagtgctttgttgactgcttagatgtcaagacagattatgcagttatgcagttgcctaactcataattcatagctcctctctgtccctgcttgaattctacaatgagtcatgatctttaaaatccctgtgcatgtgccatcactgatcagggtttacatctagtatctttckgggataggttaaaaacacagaaaatatgtttcaaagtgttccttttgttttgtttcctcagcgatagaaaaaagaaaaccttcattcaacaaatatttgttgaatgccaagtgcccaaaattttgctctgctaaaaaaaaaccagtgatgatcaagaacagcatgagctttgccaccaaagtcaaatgtgaaatagtccctggaggcagagggtgagcgcagtttcagtaaagtgaggaaagtgcccgtgatgaaagcattgttagtgctagtccgaggagtaattagaggacatatgtt

SEQ ID NO: 179553 - DNA, 601 bp, Human
gaatttcttactctgattttcctgactgttgttggacatttaggttgttttcagatgtttttgtgtttcagagagcatcagtgagtaatatccttgtacatatgagctgttcagttatgagagttcagctgcagttcctaaaagtggattagcacactgacatttcacacgtcttctactgcgttgacagtaggttgtgctgatttactttctgtgttgccacagtttccaacacttttgccaagattggccttattgaatttttttaaccaccgtcaattttatatttgaaatatgttaygttattctaatttatatttatttaattataaatatggttgtgtgctctcttgttaatcttttttaaaaatagactttattttgtacagcagttttagatttacagcaaaatcgagcagaaagtacagagttcccctgtacccctttcccccatgcaccaacatctccctcgcttgtcaacacgccccccaccagagtgtaccttgttaggattgatgaacccgtattgacataacattaccacctagagtccatagtttacatcggggttcactcttggttttgtacattctacgggttt

SEQ ID NO: 179554 - DNA, 601 bp, Human
tcctaattctcaaaagtagttgctgttaacaatttgacatatatcttttcagattattttgttacacatatatgactattttaaggcagttttttaaaattactttttatgtatcaaacgagaaagaaagataatataaaaactaagttgtattttattttgatcactttgtatagtgtaagtactgagaacatgaatttgggggatttcaacttttacaaatgtaggtgtctaattgaagttatttaacatttttatttgatttctacaaaatgaaaactctaaaaacacacagtaaccyggaagtttttattgttattgatagcaattttttattctcacttatatattcttagctccatatttgaactatttcttggtttgttttggaatgagatttttatttttaagggtacttagattactcatattatttgatgcatgatgtgttaataaccaaactaaatttctgaaattgatcaaatttataattcactcattaattcttttctattatgtgcaaagaactacagcaggagatagaggtagccgcaatttgcaatttatttcagccctaatagagctaatgatttaatagtaa

SEQ ID NO: 179555 - DNA, 601 bp, Human
aaaacaactcaaactctagaggcttaaaacaaaaatcatgtattcatgatcctgtgggttgctagttagactaggctaggatggaaaattatgggctcaacagtggggctgcagagagctggtctagactagggctgagtgttcgagggttggccagacacctccgttgccccctctgtggtttgttcacacagtggccggtgaccgaggaggcaagagtgggtgcagcaagggtttttgaggcctaacctcggaactacacaggtcattcctggcacatcctgttggtcaaagctgggcrggcctcaggtttaagggagcaggtgcagataatttgaatcccaatttaaatttatttcaggagtgcatttacatgtgattgaaagcttacgatggtgcctaaacgtaaatggtgttgaatgtaaccaggattttctttagttctcagtctattggctttgactttattaaaattttattagaactgatagtctgtgtatattaagcttattttaggactaatggaaagaatcatgcagtgactaactcctcttcattttggtttgttctgtcaaaatttatttgaaaaacaacatcaaga

SEQ ID NO: 179556 - DNA, 601 bp, Human
ggccagacacctccgttgccccctctgtggtttgttcacacagtggccggtgaccgaggaggcaagagtgggtgcagcaagggtttttgaggcctaacctcggaactacacaggtcattcctggcacatcctgttggtcaaagctgggcaggcctcaggtttaagggagcaggtgcagataatttgaatcccaatttaaatttatttcaggagtgcatttacatgtgattgaaagcttacgatggtgcctaaacgtaaatggtgttgaatgtaaccaggattttctttagttctcagtctrttggctttgactttattaaaattttattagaactgatagtctgtgtatattaagcttattttaggactaatggaaagaatcatgcagtgactaactcctcttcattttggtttgttctgtcaaaatttatttgaaaaacaacatcaagatagtcatgtggagaattaggactttggattgatttactcctaattttgctctaatgtgtttttttttttttttttttttttttggtgggagcaggggaaaagggagaggaagagagaggcaggccccgtgaaccataccatatcttagtgc

SEQ ID NO: 179557 - DNA, 601 bp, Human
cttacgatggtgcctaaacgtaaatggtgttgaatgtaaccaggattttctttagttctcagtctattggctttgactttattaaaattttattagaactgatagtctgtgtatattaagcttattttaggactaatggaaagaatcatgcagtgactaactcctcttcattttggtttgttctgtcaaaatttatttgaaaaacaacatcaagatagtcatgtggagaattaggactttggattgatttactcctaattttgctctaatgtgtttttttttttttttttttttttttggkgggagcaggggaaaagggagaggaagagagaggcaggccccgtgaaccataccatatcttagtgcttagggcctcctccaggtcatcatccagctctgaaggttgtcagagtcaggtgacataggtccaaatagagttgctcttcaacagaaagtagtgaaacttaatggttatgcacactttagatgtttgaatttatacttaagaaaatgttgggtaatcacaagtaaaccatagatgtgacaaactagtgctatgcatacttttatagtatgaataggaaaaaaagttttatgtgat

SEQ ID NO: 179558 - DNA, 601 bp, Human; identical to SEQ ID NO: 21679

SEQ ID NO: 179559 - DNA, 601 bp, Human; identical to SEQ ID NO: 21680

SEQ ID NO: 179560 - DNA, 601 bp, Human; identical to SEQ ID NO: 21681

SEQ ID NO: 179561 - DNA, 601 bp, Human; identical to SEQ ID NO: 21682

SEQ ID NO: 179562 - DNA, 601 bp, Human; identical to SEQ ID NO: 21683

SEQ ID NO: 179563 - DNA, 601 bp, Human; identical to SEQ ID NO: 21684

SEQ ID NO: 179564 - DNA, 601 bp, Human; identical to SEQ ID NO: 21685

SEQ ID NO: 179565 - DNA, 601 bp, Human; identical to SEQ ID NO: 21686

SEQ ID NO: 179566 - DNA, 601 bp, Human; identical to SEQ ID NO: 21687

SEQ ID NO: 179567 - DNA, 601 bp, Human; identical to SEQ ID NO: 21688

SEQ ID NO: 179568 - DNA, 601 bp, Human; identical to SEQ ID NO: 21689

SEQ ID NO: 179569 - DNA, 601 bp, Human; identical to SEQ ID NO: 21690

SEQ ID NO: 179570 - DNA, 601 bp, Human; identical to SEQ ID NO: 21691

SEQ ID NO: 179571 - DNA, 601 bp, Human; identical to SEQ ID NO: 21692

SEQ ID NO: 179572 - DNA, 601 bp, Human; identical to SEQ ID NO: 21693

SEQ ID NO: 179573 - DNA, 601 bp, Human; identical to SEQ ID NO: 21694

SEQ ID NO: 179574 - DNA, 601 bp, Human; identical to SEQ ID NO: 21695

SEQ ID NO: 179575 - DNA, 601 bp, Human; identical to SEQ ID NO: 21696

SEQ ID NO: 179576 - DNA, 601 bp, Human; identical to SEQ ID NO: 21697

SEQ ID NO: 179577 - DNA, 601 bp, Human; identical to SEQ ID NO: 21698

SEQ ID NO: 179578 - DNA, 601 bp, Human; identical to SEQ ID NO: 21699

SEQ ID NO: 179579 - DNA, 601 bp, Human; identical to SEQ ID NO: 21700

SEQ ID NO: 179580 - DNA, 601 bp, Human; identical to SEQ ID NO: 21701

SEQ ID NO: 179581 - DNA, 601 bp, Human; identical to SEQ ID NO: 21702

SEQ ID NO: 179582 - DNA, 601 bp, Human; identical to SEQ ID NO: 21703

SEQ ID NO: 179583 - DNA, 601 bp, Human; identical to SEQ ID NO: 21704

SEQ ID NO: 179584 - DNA, 601 bp, Human; identical to SEQ ID NO: 21705

SEQ ID NO: 179585 - DNA, 601 bp, Human; identical to SEQ ID NO: 21706

SEQ ID NO: 179586 - DNA, 601 bp, Human; identical to SEQ ID NO: 21707

SEQ ID NO: 179587 - DNA, 601 bp, Human; identical to SEQ ID NO: 21708

SEQ ID NO: 179588 - DNA, 601 bp, Human; identical to SEQ ID NO: 21709

SEQ ID NO: 179589 - DNA, 601 bp, Human; identical to SEQ ID NO: 21710

SEQ ID NO: 179590 - DNA, 601 bp, Human; identical to SEQ ID NO: 21711

SEQ ID NO: 179591 - DNA, 601 bp, Human; identical to SEQ ID NO: 21712

SEQ ID NO: 179592 - DNA, 601 bp, Human; identical to SEQ ID NO: 21713

SEQ ID NO: 179593 - DNA, 601 bp, Human; identical to SEQ ID NO: 21714

SEQ ID NO: 179594 - DNA, 601 bp, Human; identical to SEQ ID NO: 21715

SEQ ID NO: 179595 - DNA, 601 bp, Human; identical to SEQ ID NO: 121932

SEQ ID NO: 179596 - DNA, 601 bp, Human; identical to SEQ ID NO: 121931

SEQ ID NO: 179597 - DNA, 601 bp, Human; identical to SEQ ID NO: 121930

SEQ ID NO: 179598 - DNA, 601 bp, Human; identical to SEQ ID NO: 121929

SEQ ID NO: 179599 - DNA, 601 bp, Human; identical to SEQ ID NO: 121928

SEQ ID NO: 179600 - DNA, 601 bp, Human; identical to SEQ ID NO: 121927

SEQ ID NO: 179601 - DNA, 601 bp, Human
gagcagtgccagacactggcatagtgacgcttcctgagcagttgaaattgctcagttactatactagctctgacctacaattagtcagcccctttacaaaaattcagaacatactaggttttattttttaatcactgaacatgcccactaaaagaaaaatagaaatgtgctactttgagctgcagatatcaaatactaacttttactacacacatgttttttctagactatgggtaattttaatgtgcattgtattggatagagtcttttctaaaatagtttcaaagtatttatttttttaaaaaaaaacttactactatacataactgaaatatcctttatctgagataagttctaggtttaacatcctgggtttttgggaatgcaatcaactctactcaccctggtcaaaaaaaaaaaatattctgaacaatacaaagtaactaatgagcgtgtgtgttataatttccaatacttattaacttaattggggttttgcttgtgtcttttaccttttgaaagagacaaatctagggatgctagaaatggctgtgctagccaatgttcctcatccctgtataacaaatataaggtagcattt

SEQ ID NO: 179602 - DNA, 601 bp, Human
tgccagacactggcatagtgacgcttcctgagcagttgaaattgctcagttactatactagctctgacctacaattagtcagcccctttacaaaaattcagaacatactaggttttattttttaatcactgaacatgcccactaaaagaaaaatagaaatgtgctactttgagctgcagatatcaaatactaacttttactacacacatgttttttctagactatgggtaattttaatgtgcattgtattggatagagtcttttctaaaatagtttcaaagtatttatttttttaaaaaaraacttactactatacataactgaaatatcctttatctgagataagttctaggtttaacatcctgggtttttgggaatgcaatcaactctactcaccctggtcaaaaaaaaaaaatattctgaacaatacaaagtaactaatgagcgtgtgtgttataatttccaatacttattaacttaattggggttttgcttgtgtcttttaccttttgaaagagacaaatctagggatgctagaaatggctgtgctagccaatgttcctcatccctgtataacaaatataaggtagcattttccttt

SEQ ID NO: 179603 - DNA, 601 bp, Human
ttgagctgcagatatcaaatactaacttttactacacacatgttttttctagactatgggtaattttaatgtgcattgtattggatagagtcttttctaaaatagtttcaaagtatttatttttttaaaaaaaaacttactactatacataactgaaatatcctttatctgagataagttctaggtttaacatcctgggtttttgggaatgcaatcaactctactcaccctggtcaaaaaaaaaaaatattctgaacaatacaaagtaactaatgagcgtgtgtgttataatttccaatayttattaacttaattggggttttgcttgtgtcttttaccttttgaaagagacaaatctagggatgctagaaatggctgtgctagccaatgttcctcatccctgtataacaaatataaggtagcattttcctttcctatatcccccacatctaaaggaactcaggaggagaagggaaaaggatgctttaagacatatttgttcacagatctcagtatttttctaagctccaagcaatcacaatcatctacgtaaaagtagttttcaaggtgaaaacaaacaacatgattcactgaccttaca

SEQ ID NO: 179604 - DNA, 601 bp, Human
taattggggttttgcttgtgtcttttaccttttgaaagagacaaatctagggatgctagaaatggctgtgctagccaatgttcctcatccctgtataacaaatataaggtagcattttcctttcctatatcccccacatctaaaggaactcaggaggagaagggaaaaggatgctttaagacatatttgttcacagatctcagtatttttctaagctccaagcaatcacaatcatctacgtaaaagtagttttcaaggtgaaaacaaacaacatgattcactgaccttacaaatatatgcracaagataatgaggttttcttttttctaaatgggagccaaaatgcataaaataaaatggcatggcatggcctggtgttgtttatgtgcagtacaaatgtgttactccttctggcctggagtgtcctgtggctgacatgagcactgttgccccgtatgcacctaaggaccaatgcacgcttttaaatgagcagtttagcacactgtggaaaccagctttacctcagaggaaacctgtttctctacagtgactttcttgtgtcagtcaagtgcaatattgaatacaaaaaattaacaaaaag

SEQ ID NO: 179605 - DNA, 601 bp, Human
gtcactgagagaggcacctgtgtcttcaaaatcatgttggtcctaacatgaacttgaaaactccaatgggtgctgggaaagtctaaagagaaggtatctgatagtgtgatataaaagggagtgcctgactaatattaacatgttgctgagaatgagcagatcttttcccttaacaattttacctgtgtcattcatctttgcatttaatattgattttatgggcctaatgttaacattacatagacctcaacttcagctacttttcttgtaaggtttgtgatctctggttttcattgagatrgtgactttgcgtaagttcagttattactggtagaaataccagaaattgaaactagctattctggtctcaggttttgagctccttccattaaattatgccatattgtatatggacttatgtatgccaagtacacacagtataagtgtgtgttcaaacaataaataacacttactttcagtaatttagttacctggaataactaaaagcaagagttcatttctcttatatttgatttcagcttagtatacactgtatttgtcctaacatgaacttgaaaactccagtgggcgctggaaaaat

SEQ ID NO: 179606 - DNA, 601 bp, Human
aggcacctgtgtcttcaaaatcatgttggtcctaacatgaacttgaaaactccaatgggtgctgggaaagtctaaagagaaggtatctgatagtgtgatataaaagggagtgcctgactaatattaacatgttgctgagaatgagcagatcttttcccttaacaattttacctgtgtcattcatctttgcatttaatattgattttatgggcctaatgttaacattacatagacctcaacttcagctacttttcttgtaaggtttgtgatctctggttttcattgagatagtgactttgcrtaagttcagttattactggtagaaataccagaaattgaaactagctattctggtctcaggttttgagctccttccattaaattatgccatattgtatatggacttatgtatgccaagtacacacagtataagtgtgtgttcaaacaataaataacacttactttcagtaatttagttacctggaataactaaaagcaagagttcatttctcttatatttgatttcagcttagtatacactgtatttgtcctaacatgaacttgaaaactccagtgggcgctggaaaaatctagagagaaa

SEQ ID NO: 179607 - DNA, 601 bp, Human
aacatgttgctgagaatgagcagatcttttcccttaacaattttacctgtgtcattcatctttgcatttaatattgattttatgggcctaatgttaacattacatagacctcaacttcagctacttttcttgtaaggtttgtgatctctggttttcattgagatagtgactttgcgtaagttcagttattactggtagaaataccagaaattgaaactagctattctggtctcaggttttgagctccttccattaaattatgccatattgtatatggacttatgtatgccaagtacacacrgtataagtgtgtgttcaaacaataaataacacttactttcagtaatttagttacctggaataactaaaagcaagagttcatttctcttatatttgatttcagcttagtatacactgtatttgtcctaacatgaacttgaaaactccagtgggcgctggaaaaatctagagagaaagcatctgatagtgttacataaaagggagtgcctgactaacgttaacatgtttctgcaaatgagcagatctttcccctttcactgtgtgtactaagtggaaatcaaatataagaaattacctcttg

SEQ ID NO: 179608 - DNA, 601 bp, Human
tagaaataccagaaattgaaactagctattctggtctcaggttttgagctccttccattaaattatgccatattgtatatggacttatgtatgccaagtacacacagtataagtgtgtgttcaaacaataaataacacttactttcagtaatttagttacctggaataactaaaagcaagagttcatttctcttatatttgatttcagcttagtatacactgtatttgtcctaacatgaacttgaaaactccagtgggcgctggaaaaatctagagagaaagcatctgatagtgttacatraaagggagtgcctgactaacgttaacatgtttctgcaaatgagcagatctttcccctttcactgtgtgtactaagtggaaatcaaatataagaaattacctcttgctcttggttatccagggtaactaaattacttaaaagtgagtgtgatttatatgtgaggcaactagcaaagagaaaaactgatattatcagtggactctccagaatttctcttttgaaagggttcaaataatgcaatcaagttggagaggaagcctcactacctacctatgcctagcaaacacactgtttgttgtt

SEQ ID NO: 179609 - DNA, 601 bp, Human
aaggaatgtattccaactaaatcaactgtattaatttgttatcttgatttactactgagatcaagttgtatcaaattggaaactccctacttattatacagcactgtcactatttttccaagtaatttatttaaaataattaaattaattgtttgaaataataaagtaattagaaaaatagttaatcttggagaggaaaatttttaaaaaggaaagaagtaaaaatatttaatttataatctcagttatgaactactgaaaacattaaactctttagaataactttcccaagttacttggmcaatattttacttttttcttattaaaaacttaggaatcttctaaagtacataatgaaatctaaggtaagattagtcacaaattgaaattaacaagcaatgatattgactaaataataagtaaactactggccacaaattaatctcatagaaacaccttccacagcttgaaaagattttcttttagcttttaaaaatattatttggcacatttgtcaagtagagcagttaaatttgaaagattaggccatgttgtgtcttttgattagttgccagtttactagtatcctggcaaagcaaac

SEQ ID NO: 179610 - DNA, 601 bp, Human
ctttttgtacttaaatataatttaccgttgaatattgatgcaagcattgtaacattctgtcagatgctttaagtgctgatgtctttaaatgaaaagtcacaggaaactattttcacagattacttttcttagcaaaattgtctaaatatgcctttaaaaatcaatacttaattcccagagggggaaaaaaacacttcataatgcagattggggaaaggatggtaaaaatcaagtgttcttactttctttcattgtgaggactcaatcataacttttaaaggttttcttttttcctaaattktaaacttctaaaatgttggattacatactttagtaatccgtaaacagatgttgcattctgatgaactggctgtgtttatactgtatgagatgttactgtactttttctcctaaaaatggattaatgagatagagccattcttcaaatctaaaggcaatatttgccttttgaattctgggtagcgctgttccttttgttcttaggaaaaatctgaaccctaaggctgtttccatgcatgtccactgagttggcaagaacctttataaatgattgtgaatcatctaaatgttcaacaggaga

SEQ ID NO: 179611 - DNA, 601 bp, Human
agccaaaaggttgaacaactgtggcctaggatttaggactagtgtctctgtctctttctctctatgtcgtatatatatgtatatatgtatatgtgtgtatatatatgtatatgtgtgtgtatatgtatatttttgtttgtttgtttgtttttgttttttttgagacggagtcttgctctgtcgcccaggctggagtgcagtggtgcgatcttggctcactgcaacctccacctcccgggttcaagtgattctcctgcctcagcatcctaagtagctgggactacaggcacatgccaccacrcctggctaatttttgtatttttagtagagacggggtttcaccatgttggccagggtggtctcgatctcctgacctcatgatccacctgccttggcctcccaaagtgctgggattacaggtgtgagccaccatgcccaacccatattttatatatttgtataaataatatataatataataagtgtgtatatggctgcatttattacagatttttcaatttatatatatattataagcattgcatatacatattattaagcatatttattgcatatattatacacactacagcccaaaata

SEQ ID NO: 179612 - DNA, 601 bp, Human
tatatatgtatatgtgtgtatatatatgtatatgtgtgtgtatatgtatatttttgtttgtttgtttgtttttgttttttttgagacggagtcttgctctgtcgcccaggctggagtgcagtggtgcgatcttggctcactgcaacctccacctcccgggttcaagtgattctcctgcctcagcatcctaagtagctgggactacaggcacatgccaccacgcctggctaatttttgtatttttagtagagacggggtttcaccatgttggccagggtggtctcgatctcctgacctcatsatccacctgccttggcctcccaaagtgctgggattacaggtgtgagccaccatgcccaacccatattttatatatttgtataaataatatataatataataagtgtgtatatggctgcatttattacagatttttcaatttatatatatattataagcattgcatatacatattattaagcatatttattgcatatattatacacactacagcccaaaatactgaatataaaacatatactacatagtatacataaattcacatataactatatacaaatacatatatagttgtgtatta

SEQ ID NO: 179613 - DNA, 601 bp, Human
atttacaaacgagtggtatatagcttaacaatttagaataattagagtctacggccattacaatttgtattatcctaatttaactggaaatatttaagtgagtgttatactttggttaggctaagtacatgtgcatacaagggaagaagactaaagagtggtatctgtcactcactttttgagaacgtcataaaaaatcaggaaggcagcccaccatttgggactttgagattcatagtctcactcctatatcagatgcaaaaagtgaggtggaatgtattattgatatgctacttaaaargacaaaatcggtgaacaattcctggagagtatgctaagtttgctgtactattcctgaaggctgacctgccttttgtttcatgtgaagtaatccttcaaatcaacttctgggttttgcaaagtaacatttgagcttttcttctcccttcagactatgaagttttaatttatgtattcacaccctctctgtcatttactattcatttattcattcttatatttatagcttgtcttattctaaaaatattttaaaggcttataaaaatacatatattataatctgataaaatacattaatgag

SEQ ID NO: 179614 - DNA, 601 bp, Human
gagtggtatatagcttaacaatttagaataattagagtctacggccattacaatttgtattatcctaatttaactggaaatatttaagtgagtgttatactttggttaggctaagtacatgtgcatacaagggaagaagactaaagagtggtatctgtcactcactttttgagaacgtcataaaaaatcaggaaggcagcccaccatttgggactttgagattcatagtctcactcctatatcagatgcaaaaagtgaggtggaatgtattattgatatgctacttaaaaagacaaaatcrgtgaacaattcctggagagtatgctaagtttgctgtactattcctgaaggctgacctgccttttgtttcatgtgaagtaatccttcaaatcaacttctgggttttgcaaagtaacatttgagcttttcttctcccttcagactatgaagttttaatttatgtattcacaccctctctgtcatttactattcatttattcattcttatatttatagcttgtcttattctaaaaatattttaaaggcttataaaaatacatatattataatctgataaaatacattaatgaggatggaggtg

SEQ ID NO: 179615 - DNA, 601 bp, Human
gtgaaggtgaagcaagattaaggcaggtgcgtttccctgaaaagatgccaaaagtggacgagaaaattgtatctgcggctgaattgagaagggaaacagaacaaacttcagagttgggagggtctggttgcttaaacaaattataggtttttcaggttaaaaaccatgcaagaaatttatcctgtgatcctgataaggggaaacaatgtgatgttatagatagcatacctacgatcaaatcagtggtgtgtttcatacatttgtttcttatgaaatgctcaatacaactctatgacaaggyatcacgtagtaataagaacacttctacaaaacatcttggtatggaactgtcaaatagtttggtttgatctagacttcaatttatagtatctagggaaatggatggcttgcacgtcacctcatcatcattcgtaatgattgctccttgagtctgagcttttcctgaaggagagcagcagaaagttagagggaaggggggttgtgattaaatgtgcatttctacttagagccagatccataaacattagaaggtaagaatgaggtccttctatgaaattaagaaacccaaataaggtacctt

SEQ ID NO: 179616 - DNA, 601 bp, Human
taaacattagaaggtaagaatgaggtccttctatgaaattaagaaacccaaataaggtaccttgttaaatagaagaccacctcacctctaagaggatgagacgcctggaagcagagccaatgttttactcagaaaattcttgcaaatagttttaaataatgacaagagtcactaaaaggtgaaaaaaacaaaaaaggtcgggggagaataaaattttttgagacattaagattaaataccatgtctttcaggtaaatgctaagataggtaggttgggaattgcacattgacctcatatagragcatctgtaaaccaataatgtgttcagtatagtctacccaccatggtgattgggtttcagagcagttgttcttaacctttcttacagtaaccatagaataaagctcatgatgtcatgagctcaatgcttcataactgcatatatatctgttcatcacttcatcacaacccttcttccatctaaccttctttttcttttttttcttttttttttttttgagccagtctcactgtgttgcccaggctggagtgcagtggcatgatctcggctcactgcaacgtccacctcccgggttcaag

SEQ ID NO: 179617 - DNA, 601 bp, Human
aatcatctcctcttagaaaagcctattttatctaacgggactattgattacataaggctgaagggaaataactaaacgttgtttgtcagtctgtgttctgaacatcaaatttgcccacctttctttagactccatattttagagtactaccatgggcttaagatgtaagaacaagcaaacaaaacctgaaacattggcgtgtttggtttaaggttttgatctttgtctgaggttcctgaaaagatgactttaacttttgttcaatttcttgcctttttttctgagagaaaggaaacactcrttgtaactccatggtatatttcatttccaaactcacacttctctattttgagttcaaattaaagacttctgtcacatctgtaaaatgccatgctgagctacaaattgagttaatgatagcttccttctacttcatgtttattattacaatgttttactaggtttctctagttttctctctttcaaacattaatatgaatgtggtacattagatattatgcagaagtacaaattctcctttatagctgcctgagaaaagcttgcaactgacatttcgactgaaaagtaatatgcagaagtg

SEQ ID NO: 179618 - DNA, 601 bp, Human
taactaaacgttgtttgtcagtctgtgttctgaacatcaaatttgcccacctttctttagactccatattttagagtactaccatgggcttaagatgtaagaacaagcaaacaaaacctgaaacattggcgtgtttggtttaaggttttgatctttgtctgaggttcctgaaaagatgactttaacttttgttcaatttcttgcctttttttctgagagaaaggaaacactcgttgtaactccatggtatatttcatttccaaactcacacttctctattttgagttcaaattaaagactyctgtcacatctgtaaaatgccatgctgagctacaaattgagttaatgatagcttccttctacttcatgtttattattacaatgttttactaggtttctctagttttctctctttcaaacattaatatgaatgtggtacattagatattatgcagaagtacaaattctcctttatagctgcctgagaaaagcttgcaactgacatttcgactgaaaagtaatatgcagaagtgaaaaaagaacttctctagggccttttgaaggaggacagtatcaccctacaagtcaatatgagaccatc

SEQ ID NO: 179619 - DNA, 601 bp, Human
gatgtaagaacaagcaaacaaaacctgaaacattggcgtgtttggtttaaggttttgatctttgtctgaggttcctgaaaagatgactttaacttttgttcaatttcttgcctttttttctgagagaaaggaaacactcgttgtaactccatggtatatttcatttccaaactcacacttctctattttgagttcaaattaaagacttctgtcacatctgtaaaatgccatgctgagctacaaattgagttaatgatagcttccttctacttcatgtttattattacaatgttttactagstttctctagttttctctctttcaaacattaatatgaatgtggtacattagatattatgcagaagtacaaattctcctttatagctgcctgagaaaagcttgcaactgacatttcgactgaaaagtaatatgcagaagtgaaaaaagaacttctctagggccttttgaaggaggacagtatcaccctacaagtcaatatgagaccatccaaattagcattatatttcataaatctatctacagcataattcatactcagtcaaaaggaaatacagcaaaattccctgtggaaagactcatt

SEQ ID NO: 179620 - DNA, 601 bp, Human
cgttgtaactccatggtatatttcatttccaaactcacacttctctattttgagttcaaattaaagacttctgtcacatctgtaaaatgccatgctgagctacaaattgagttaatgatagcttccttctacttcatgtttattattacaatgttttactaggtttctctagttttctctctttcaaacattaatatgaatgtggtacattagatattatgcagaagtacaaattctcctttatagctgcctgagaaaagcttgcaactgacatttcgactgaaaagtaatatgcagaagwgaaaaaagaacttctctagggccttttgaaggaggacagtatcaccctacaagtcaatatgagaccatccaaattagcattatatttcataaatctatctacagcataattcatactcagtcaaaaggaaatacagcaaaattccctgtggaaagactcatttttgcataacacatacacatacacataaacacacacaaatggcatagaattgtgtaaatcagtacacaagtcctttcgggtcaaataaaaagaaagaagaagggtgattgctttctagctagtgtagacttgagaaaa

SEQ ID NO: 179621 - DNA, 601 bp, Human
acaaattctcctttatagctgcctgagaaaagcttgcaactgacatttcgactgaaaagtaatatgcagaagtgaaaaaagaacttctctagggccttttgaaggaggacagtatcaccctacaagtcaatatgagaccatccaaattagcattatatttcataaatctatctacagcataattcatactcagtcaaaaggaaatacagcaaaattccctgtggaaagactcatttttgcataacacatacacatacacataaacacacacaaatggcatagaattgtgtaaatcagtacrcaagtcctttcgggtcaaataaaaagaaagaagaagggtgattgctttctagctagtgtagacttgagaaaaccattttatgttctgcagtctggtcttatgcaccactcccatctgagattcttcctgaggaaataaaacaggttctgcaattctgtctgtatcttatctcaaaagtctgctaaaaaaagtaacttatttagaagcatacaaatgcatgacccaataaagaaaatgaagtgtaaaagggccgaggaatacaacagcaaaagctgtaagtttgaactttagtcattttta

SEQ ID NO: 179622 - DNA, 601 bp, Human
gtcctttcgggtcaaataaaaagaaagaagaagggtgattgctttctagctagtgtagacttgagaaaaccattttatgttctgcagtctggtcttatgcaccactcccatctgagattcttcctgaggaaataaaacaggttctgcaattctgtctgtatcttatctcaaaagtctgctaaaaaaagtaacttatttagaagcatacaaatgcatgacccaataaagaaaatgaagtgtaaaagggccgaggaatacaacagcaaaagctgtaagtttgaactttagtcatttttaagcraagtaactgttttcatttatttttaaatgatcatttaagtaagtataccttttgccatacaagaattaagaaaattagttgaaagtaaagaaaaatgaaaagttcatttaggttgcttccaatatagatcataatttttttctaagattgcttctttctgagatttgtagtgtccatccaatgctgttaaataataaatcatttctgtataatgacaaaatatatgtacatttaattattaaaggctatgaagaatagaaaggtatgcagttttaagataattataaaatcagttttctt

SEQ ID NO: 179623 - DNA, 601 bp, Human
ctagctagtgtagacttgagaaaaccattttatgttctgcagtctggtcttatgcaccactcccatctgagattcttcctgaggaaataaaacaggttctgcaattctgtctgtatcttatctcaaaagtctgctaaaaaaagtaacttatttagaagcatacaaatgcatgacccaataaagaaaatgaagtgtaaaagggccgaggaatacaacagcaaaagctgtaagtttgaactttagtcatttttaagcaaagtaactgttttcatttatttttaaatgatcatttaagtaagtrtaccttttgccatacaagaattaagaaaattagttgaaagtaaagaaaaatgaaaagttcatttaggttgcttccaatatagatcataatttttttctaagattgcttctttctgagatttgtagtgtccatccaatgctgttaaataataaatcatttctgtataatgacaaaatatatgtacatttaattattaaaggctatgaagaatagaaaggtatgcagttttaagataattataaaatcagttttcttctacccacagaaattattttttaacagtgtttggcatttattgaa

SEQ ID NO: 179624 - DNA, 601 bp, Human
tcttagtgggccttgcaatgaggactaacatgctgaactggtcttttctactgtgaaatatattggaaaaaccttgcactagtatttcaacagcaccctttccattacacttatatattgatttgaatctgtcaaggaactcctctagaacagttgtatgcaactgcgagtcattttttttttcttccaggggacatttggcaatgtctgaggacatttctgtttgtttctactgtgggagtggtggaagctgctactggcatttagtggttagaggtcaggagtgctactagacatcatrcaatgcacagggtagcctccacaacagggaactaaccagcccagaatgccaacagtgctgaggttgaattttaggttggagattatgaacacaaacctagtgcaggtttagtgtagatgctttggaaatcctgctccagaagaaaataaataaaaccatcaatcatctattctcagatggtatgaacggaagccacataccacgttagtgttttgccatgaatcaggaggactcatggcaaaacacttttgataacacttcccttgcccagtgtgtatggtgcctcttctgaaaacatgt

SEQ ID NO: 179625 - DNA, 601 bp, Human
ccaatagggttttatactcagttcaatggaaagcatttgaagagttttagattgaagaagagaacatttcaatgtaaatgctttgcaccatagtaggcttacagcaaatcactgtgggattaaattgtgtcatttcctatgatcgttctcctaacatctgaataaaaataaaggcacagcataaattgttatgtttaaaatgtcagtgatgcagagattggcattcctttctccctaatgccgtagtaaaatggcagcagaaacagtaaataccaatgtgcaaacctgaccaagaagtgakacatgcttaattattcatttctctcaatttcagtcacagggcttcatacctcatcaaattagagtaaaaagcatattttaacgtttgtctgttttgcggtgcctgtcttttgtgaaaaataaatggcaaatcaccaaaaagaatttcttcctatcttatgttaaaatccagtcttcatttggaaagtatttaggtgtgcaagcgcaagcaagccaagtgatatactgaaaacgaaatgtcttaagtcttgatgagtttgaacataatgagaaaaacatcagaagcatgttgatttcgaga

SEQ ID NO: 179626 - DNA, 601 bp, Human
aatggcaaatcaccaaaaagaatttcttcctatcttatgttaaaatccagtcttcatttggaaagtatttaggtgtgcaagcgcaagcaagccaagtgatatactgaaaacgaaatgtcttaagtcttgatgagtttgaacataatgagaaaaacatcagaagcatgttgatttcgagaaaaacacataaacgtcattactttttctggagagaattgagactgtgatgtctaataccagcttagtttgtagaatctgtgtgtgtatgtatctataatgttacataaaagatatattcatrtatgtttcatgtcatcagtaaacaaatctctgtgaatacagaagtgttatcctccttttagtatgcaactgcctgcaattatatctatttattttacaaggctgcaaaccaggaacattgggtttatgtgtattaaacccagtgatatttaagacttgaaatcataatccactttggctttctgaagtggagacagagttcttacaagagatttagtcacaataagatgaattactatcaagagaactgtttgttgctttgtctctacatagttgctgtagctattgcactgtttttatt

SEQ ID NO: 179627 - DNA, 601 bp, Human
ttctgtgtaaatttcagtttcaagcattctgtgtaattttctaagtactgcattcatagtaatgtttcaaagaaaagaaactagataactgtaagaaaattgcaataataaacaggaaatataagaacatattttattaactcaatttgtagttcaccttggccttttacagagtagtttttgactttactaaaattatttttcagtttaggactgttaaggtgtgggcttggaatatatcatgaggttttaatgagtgttttctttctctctgaaaagagtaagacatgctagaatgttsaaaaataattttcaggatccacagataaacaaagaggggatctggattaaaccacaattttgtgctaggtttttgggctgggcacttcatatatatgacacatttaattgtcacagagccactgggggtaacactattgcatttcagaaaggttaagtaacttgcttataagcttctgtggaactgtaccatgatttaaactcaggcagagactcagatcctatggtggtgacatttgtttttatttctgttgttgttaactttacatcacaacatgttcccgcagtaaacagtgtcata

SEQ ID NO: 179628 - DNA, 601 bp, Human
attctgtgtaattttctaagtactgcattcatagtaatgtttcaaagaaaagaaactagataactgtaagaaaattgcaataataaacaggaaatataagaacatattttattaactcaatttgtagttcaccttggccttttacagagtagtttttgactttactaaaattatttttcagtttaggactgttaaggtgtgggcttggaatatatcatgaggttttaatgagtgttttctttctctctgaaaagagtaagacatgctagaatgttgaaaaataattttcaggatccacagrtaaacaaagaggggatctggattaaaccacaattttgtgctaggtttttgggctgggcacttcatatatatgacacatttaattgtcacagagccactgggggtaacactattgcatttcagaaaggttaagtaacttgcttataagcttctgtggaactgtaccatgatttaaactcaggcagagactcagatcctatggtggtgacatttgtttttatttctgttgttgttaactttacatcacaacatgttcccgcagtaaacagtgtcataggacagcagtactcacacaccaaac

SEQ ID NO: 179629 - DNA, 601 bp, Human
taagaaaattgcaataataaacaggaaatataagaacatattttattaactcaatttgtagttcaccttggccttttacagagtagtttttgactttactaaaattatttttcagtttaggactgttaaggtgtgggcttggaatatatcatgaggttttaatgagtgttttctttctctctgaaaagagtaagacatgctagaatgttgaaaaataattttcaggatccacagataaacaaagaggggatctggattaaaccacaattttgtgctaggtttttgggctgggcacttcatrtatatgacacatttaattgtcacagagccactgggggtaacactattgcatttcagaaaggttaagtaacttgcttataagcttctgtggaactgtaccatgatttaaactcaggcagagactcagatcctatggtggtgacatttgtttttatttctgttgttgttaactttacatcacaacatgttcccgcagtaaacagtgtcataggacagcagtactcacacaccaaaccagccatcctgaaatccagagaaattgttcccttcctgtgagagaaagagttagtgtttgaaacta

SEQ ID NO: 179630 - DNA, 601 bp, Human
gaaactagactagcagggcagtatatgtgaaaatatactaaagcgttgtgcctattacatgataggcactcaataaataattgatgaatgattggatgaatgaattaatgatttagttgtatcaaatttaaatttaaccgctagatagttggtgtacgtttagagcaactgtgaatcttaattgcttacaaggtctggttggatatgccagatcaagttctagtgtattcagtcagctctgagcactggacacagataggctgatcctctatggttgcacataaggaaggaaggtgtgtgtttgtgtgtgtgtgtgtgtgtttctggattcatgtatatagcgtggaaaagaattaacagaatagatggattgaaaatgagcacatatacatgaagaattttctatcactaaagtcttcattaattaattgacagtcattttttgatgatacttttgggtgcatcacctatatttctttagaaattatgtaaaaaacatatttcatccttttggattctcttacaataaaaaatataaataattcaaatgaaagtggcttaacaatagggatttatttatttggcaagtaatttaaaggca

SEQ ID NO: 179631 - DNA, 601 bp, Human
actagactagcagggcagtatatgtgaaaatatactaaagcgttgtgcctattacatgataggcactcaataaataattgatgaatgattggatgaatgaattaatgatttagttgtatcaaatttaaatttaaccgctagatagttggtgtacgtttagagcaactgtgaatcttaattgcttacaaggtctggttggatatgccagatcaagttctagtgtattcagtcagctctgagcactggacacagataggctgatcctctatggttgcacataaggaaggaaggtgtgtgtttgtgtgtgtgtgtgtgtgtttctggattcatgtatatagcgtggaaaagaattaacagaatagatggattgaaaatgagcacatatacatgaagaattttctatcactaaagtcttcattaattaattgacagtcattttttgatgatacttttgggtgcatcacctatatttctttagaaattatgtaaaaaacatatttcatccttttggattctcttacaataaaaaatataaataattcaaatgaaagtggcttaacaatagggatttatttatttggcaagtaatttaaaggcagat

SEQ ID NO: 179632 - DNA, 601 bp, Human
acaaatgaccatagaccaggtagctgataaacaacagaaatttatttctctcagttctagaggctgggaagtccaagatcaaggctcaggcagaaactggtgtctgggaagagcccactttctggttcatagatagtcttcttttcattgcatcttcctatgatggaggagggagggagttctctggggccccttttatgaaggcactaatctcactcattatggggctgccactctaatgacctcacctaaaccatattacctcccaaaggccccgcctaccagtaccatcccactgcgkgttagggtttcaacacatgaattttgagggaacacattcagtctatagcaatcagagtatgtaatattaatataacgatatcaactttataggttttactcagatttcctcaattatctcaataacatagtttatagcaattttctcccagtccaggatcgtggctgcatagtgtcaccatgcctctgaatcttcctcaatctgaaacagttccaaggccttcaatgattcatcgcagtaccattttgaagcataaaatcagctgttttgtagaatattattcaatgtagatgtaataaa

SEQ ID NO: 179633 - DNA, 601 bp, Human
ctaatgacctcacctaaaccatattacctcccaaaggccccgcctaccagtaccatcccactgcgtgttagggtttcaacacatgaattttgagggaacacattcagtctatagcaatcagagtatgtaatattaatataacgatatcaactttataggttttactcagatttcctcaattatctcaataacatagtttatagcaattttctcccagtccaggatcgtggctgcatagtgtcaccatgcctctgaatcttcctcaatctgaaacagttccaaggccttcaatgattcatcrcagtaccattttgaagcataaaatcagctgttttgtagaatattattcaatgtagatgtaataaacattttgtccctatattcacaaataaatagtagttgatgacacagattctgaagtcctgttgcccggttttgccactttctctctttttgaatttgggcaagttactcaatctctctatatttagggtttttctaacacataaggtagcagtaataataaaaaagtaactcccatgtaagagtattagaaggattcactgagttagtatatgtcaagcacaatacttaacacaca

SEQ ID NO: 179634 - DNA, 601 bp, Human
ccatattacctcccaaaggccccgcctaccagtaccatcccactgcgtgttagggtttcaacacatgaattttgagggaacacattcagtctatagcaatcagagtatgtaatattaatataacgatatcaactttataggttttactcagatttcctcaattatctcaataacatagtttatagcaattttctcccagtccaggatcgtggctgcatagtgtcaccatgcctctgaatcttcctcaatctgaaacagttccaaggccttcaatgattcatcgcagtaccattttgaagcrtaaaatcagctgttttgtagaatattattcaatgtagatgtaataaacattttgtccctatattcacaaataaatagtagttgatgacacagattctgaagtcctgttgcccggttttgccactttctctctttttgaatttgggcaagttactcaatctctctatatttagggtttttctaacacataaggtagcagtaataataaaaaagtaactcccatgtaagagtattagaaggattcactgagttagtatatgtcaagcacaatacttaacacacagaaaggcttatctgtatt

SEQ ID NO: 179635 - DNA, 601 bp, Human
ttgagagcatattcagacgagggttcagcttgccattgtacagtattatattgtccatgtgtctgtaattaaatgtcttttaaaattattcatccctgagtcttctgagggataaaagttatactcgtcatgtaattatttcaataaagatttttaaatgatagctccatattgctgattcccagacgcccaggctctctccgcttctctgcggattccttggtaaatgcccatgtgatttttcagaaagtgatttcttgagcaccttgccaactgctcaggattttcaggattaaagaaytaaaccacatctgatttgaaagtaatctgtcatttattttttttctaattattactgcttagcttaggtttcaacaatgtaaatgaaagctattttagtttgaatgtgttaaaatgtgctgagtttaagtaacacatagaaagatatcaaactcatgagtatagagttgccttatttgaagccatattttagtaacattctatttaattaaatattctattaattattttatttaatattctatttaattagtagaacataatgtaacataattacatattaatgaccagagatctctca

SEQ ID NO: 179636 - DNA, 601 bp, Human
tccatattgctgattcccagacgcccaggctctctccgcttctctgcggattccttggtaaatgcccatgtgatttttcagaaagtgatttcttgagcaccttgccaactgctcaggattttcaggattaaagaactaaaccacatctgatttgaaagtaatctgtcatttattttttttctaattattactgcttagcttaggtttcaacaatgtaaatgaaagctattttagtttgaatgtgttaaaatgtgctgagtttaagtaacacatagaaagatatcaaactcatgagtatagwgttgccttatttgaagccatattttagtaacattctatttaattaaatattctattaattattttatttaatattctatttaattagtagaacataatgtaacataattacatattaatgaccagagatctctcagaaattttacttatgttttgcttgcattaactactataaaacctcacaaaggagccaataatttgattaaatattttatagggccataaagaaaaatgagatgaagcagccagtaaaatgattttcttgtttttaagtctttaaacatttatctttagggccctt

SEQ ID NO: 179637 - DNA, 601 bp, Human
aggattaaagaactaaaccacatctgatttgaaagtaatctgtcatttattttttttctaattattactgcttagcttaggtttcaacaatgtaaatgaaagctattttagtttgaatgtgttaaaatgtgctgagtttaagtaacacatagaaagatatcaaactcatgagtatagagttgccttatttgaagccatattttagtaacattctatttaattaaatattctattaattattttatttaatattctatttaattagtagaacataatgtaacataattacatattaatgacmagagatctctcagaaattttacttatgttttgcttgcattaactactataaaacctcacaaaggagccaataatttgattaaatattttatagggccataaagaaaaatgagatgaagcagccagtaaaatgattttcttgtttttaagtctttaaacatttatctttagggcccttaaagatccctgttaaatattatatttgccattttctgattgttagatttaaaaatttcgtggcttgatttattagagtacaaatatttttttctaaagttggatagtttgttaaataaaaatt

SEQ ID NO: 179638 - DNA, 601 bp, Human
gtatagagttgccttatttgaagccatattttagtaacattctatttaattaaatattctattaattattttatttaatattctatttaattagtagaacataatgtaacataattacatattaatgaccagagatctctcagaaattttacttatgttttgcttgcattaactactataaaacctcacaaaggagccaataatttgattaaatattttatagggccataaagaaaaatgagatgaagcagccagtaaaatgattttcttgtttttaagtctttaaacatttatctttagrgcccttaaagatccctgttaaatattatatttgccattttctgattgttagatttaaaaatttcgtggcttgatttattagagtacaaatatttttttctaaagttggatagtttgttaaataaaaatttctttgaaaatgggcatacaatgtgtaacaaacacgggaagattttaaaaataaaacataaatttattttaaaaagtgatgtgtttaaaaatattcttacaaagattttcagtactcaaaattgaaagtttacttagtttgttcatatggaaaataattcatctaccaaag

SEQ ID NO: 179639 - DNA, 601 bp, Human
tagaacaatgtctggtgtataataagtgcccaataaatgttaattattattatatttaacaagaccaatgggaccacttgcttgaacttgtttaatttatagatgaagattctacatccctgagagatatttttaaaaatgaatagaagtcagttttcaccaaaacaatagtaaaacttaaataaaattgtagctctgtattaattttaactgtattttgttggtttttaacacagaatggactgacatagtttctaatgataaagtaagaatttaaaagttagcacgattatacactaawttgctcttttttgcacctatgttttttaattcactagcatattatggacagaatgagactcctgtaggcagtagtaccggtaaaaatgaatcttgtccttcagctttctgtttttgtcaggtttagctcttattttcattcatatagaatgccttttgattatttctttttatactaataaattttaaaaactagaaattcgtgataacttcttaattgattaaaatgcgttagctgaacttagattcttctcaatcatttctctttacaatataacttatttatgttcacagctagtaa

SEQ ID NO: 179640 - DNA, 601 bp, Human
attatacactaaattgctcttttttgcacctatgttttttaattcactagcatattatggacagaatgagactcctgtaggcagtagtaccggtaaaaatgaatcttgtccttcagctttctgtttttgtcaggtttagctcttattttcattcatatagaatgccttttgattatttctttttatactaataaattttaaaaactagaaattcgtgataacttcttaattgattaaaatgcgttagctgaacttagattcttctcaatcatttctctttacaatataacttatttatgtgcacagctagtaaaaataattattacaaaatacattgaaggagactgtcagactatgattcgggggacacgtctgtcacctctttgaatatattaagcatctaattattatgtaatgaatccaatacttttgtatgatctagaacattgattattttacaaaaatcttgaaattttcttggttttcttctcagtatggcacacacttgagttttcaaaatttgcaacattaaccaaaaaacaaaaagtaacaggtaaaagcattgcaatttttagggactctgaatttcatttttgatatt

SEQ ID NO: 179641 - DNA, 601 bp, Human
tactaataaattttaaaaactagaaattcgtgataacttcttaattgattaaaatgcgttagctgaacttagattcttctcaatcatttctctttacaatataacttatttatgttcacagctagtaaaaataattattacaaaatacattgaaggagactgtcagactatgattcgggggacacgtctgtcacctctttgaatatattaagcatctaattattatgtaatgaatccaatacttttgtatgatctagaacattgattattttacaaaaatcttgaaattttcttggttttyttctcagtatggcacacacttgagttttcaaaatttgcaacattaaccaaaaaacaaaaagtaacaggtaaaagcattgcaatttttagggactctgaatttcatttttgatatttattcttccactgagggagattgtattgaattcttttttttttctgtaagagtagaaaaacaaaaacaaaaacaaaaaaagcagcaatgaccacattccattgatacaaatttagaggaagtgaattgaaggtgcatgctgtgtgctttgcagaaactttagatttatttgctttggcttttttt

SEQ ID NO: 179642 - DNA, 601 bp, Human
gtgtctcaaataaattaataaataatataaaaattaaaatatatataatataaaaatttttaaaaataagttttgaaaagccctttgcttgggccattttaactgtccattttatagaccttctaggacccagccttcctccttcctggtgaatctgggagaagtcagtgtaacttaatataacttgctctttaatacacaaaggggagtgctctgtgtgggtaacagacgatttcagatttgaattcccaaatactttgtcatgatcaagtaaggaaggagccaaaatttggccccactsagtcagcaaataatcatgtttctaaattgctctgagccattggctttgatccaggtttaaaatgagttggtttaaataatggcactctgaccctctgattctaaattttcagtatgtttcacactgcctaggatcatgagaccgctcggaggctcagagaggacctcgtgtggcctgataattgctgcagcacgtatagcggtgtgaccctttggaactctgaagtcagagcatgtcggttaacccagagtgtggccacatgaacgctgtgggaggcaggaggaattttgagataccctc

SEQ ID NO: 179643 - DNA, 601 bp, Human
ggctgtgagtttgtcataaatagctctcagtattttgagatacattccaccaacacctagtttattgagagtttttagcatgaaaggctgttgaattttgtcaaaggctttttctgcatctattgagataatcatgtggtttttgtctttggatctgtttatgtgatgggttacatttattaatttgtgtatgttgaaccagccttgcatcctagggatgaagctgacttattgtggtggataagctttttgatgtgctgctggattggtttgccagtattttattgaggatttttgcatygatgttcatcagggttattggcctaaaattctccttttttttcttgtgtctctgccaggctttggtatcagaatgatgctggcctcataaaatgagtttgggaggattccctcttttttctattgattggaatagtttcagaaggaatggtaccagctcctctttgaacttctggtagaattcggctgtgaatccgtcttgtcctggactttttttggttggtaggctattaattattggctcaatttcagaatctgttattggccttttcagagattcaacttcttcctggtttagtct

SEQ ID NO: 179644 - DNA, 601 bp, Human
ttgagatacattccaccaacacctagtttattgagagtttttagcatgaaaggctgttgaattttgtcaaaggctttttctgcatctattgagataatcatgtggtttttgtctttggatctgtttatgtgatgggttacatttattaatttgtgtatgttgaaccagccttgcatcctagggatgaagctgacttattgtggtggataagctttttgatgtgctgctggattggtttgccagtattttattgaggatttttgcatcgatgttcatcagggttattggcctaaaattctcyttttttttcttgtgtctctgccaggctttggtatcagaatgatgctggcctcataaaatgagtttgggaggattccctcttttttctattgattggaatagtttcagaaggaatggtaccagctcctctttgaacttctggtagaattcggctgtgaatccgtcttgtcctggactttttttggttggtaggctattaattattggctcaatttcagaatctgttattggccttttcagagattcaacttcttcctggtttagtcttgggagggtgtatgtgtccaggaatttatccatt

SEQ ID NO: 179645 - DNA, 601 bp, Human
tccccttagttatataattgaattctctgccatgcttttcaagattttaagataatatttcaacgtcaggatcattccatgtcaatttcatttgcaggcatgctttactgtcaggatcaatggttctttgtaatttcaacttgaaattcactctgcctcttggtaccacctgccaccgaactagctaagcttggttttgacacagttcccactttctaagtcattaataacactttggaaataccttcatacttgctacaaatcactcagacaaaggcatgaaaaattatcaggtcgagaytgtgtgtatgtgcacacacacatgcacacaggactatatgaagtattgtgtaatctgattgttttaaatccgcttctcattcattgtaaggaaatttgagttttttaggttaagggggtaaaagattttgccttttgcctcaccttttggaacccacagactcagaggctgcaagagctacaaagtgcccttgacaataagctcctttctaaaaatgaggggagtttggatggggtgaggtggggttgctcacgtttacagagccactgtgctgagtccactctgcttccagcctctctc

SEQ ID NO: 179646 - DNA, 601 bp, Human
tcattaataacactttggaaataccttcatacttgctacaaatcactcagacaaaggcatgaaaaattatcaggtcgagattgtgtgtatgtgcacacacacatgcacacaggactatatgaagtattgtgtaatctgattgttttaaatccgcttctcattcattgtaaggaaatttgagttttttaggttaagggggtaaaagattttgccttttgcctcaccttttggaacccacagactcagaggctgcaagagctacaaagtgcccttgacaataagctcctttctaaaaatgagrggagtttggatggggtgaggtggggttgctcacgtttacagagccactgtgctgagtccactctgcttccagcctctctccagctctgtagtgttgattccgaggcagccaccacatcaccaatagtgacccaagtagctaatctttacatagaattggtcagttcattcattcttttatctcttaggcttcctctgtagtagaagtcataagatagtgaatacagtgtatttcctgacttctaaagatcctgcaaaatattagcaaaattcacaaccttaacagctactatgtgacaga

SEQ ID NO: 179647 - DNA, 601 bp, Human
cagctaagtggcaaagctgaaatttcaaaatcttatacgtctgattccaaaatccatactaatgatgatactgtcctgcatgtattaaaggaagaccaatatgaagacctgaatacactgcaacaagtgctatagacaaagtaaaatcaactgctgcgtgaatgttcattacatctgggaggatgtggcaagatttcttggaggagttactgttcaccttggatcttttcgagagacatggatgggctaagggcattccagacacatggtcaagaaaaatatcccttttgattttgtaacyattaaaaaatctttatgtacaaattgctttaatattcttgtagttgttgtttgcctgttttttctttcaaaaaggcattacaaagggggaaagtgcaatgaactgtgagttaaaaggtgtgattctcaaggattttgacgagatctccctatccacatgcctcctagacattccttcatttgatccgcaggttcgttgaactagacatgcccagaaatacactcattctcttcatctgtgaacctacccctgggttttcactcccagtgaatgttaccatcatccactgagttgaccaca

SEQ ID NO: 179648 - DNA, 601 bp, Human
gaaaaagcatcttaattgaatatttgcttgcagtcttttccattcatttgttcattctaaacatattaaatggctacttatagatattatgacagatgttgggaatagaaagccagatgactgccttcaaggaatttaccatctgtcaggagaaggggaaatagccaagttaaacaggtgaatatgttgcagtatccatatactcaaacagaagtggatccagggggcactcatcaatttttggcaaagagaacctaatcaggccatcccgccgattaaaatcttttaattgcatctcatkgctttcaggctaaagtgcacatagttgagcagtgtgtttataaggcctgtgatggttgatactgaatgtcaacttcattggattgaaggacgcaaagtattgtttctgggcatgtctgtgtgggtgtcgccaaaggagattaacatttgagtcagcgaactaggaaaggcagacctatcctcggtctgggtgggcaccatctaatcagctgccagtgcagctagaataaagcaggcaggagaagacagaagaacagacttgctgagtcttctggccttcatccttctcccatgctggatg

SEQ ID NO: 179649 - DNA, 601 bp, Human
actatagtgatttgaaaaagaatgttttattcatagtataataactattgcaccatacttatctctattttgtagatgaagaaaccgagaaaatcaaatgccttttctaaggttacccagataataaataaaaaaccaggattcaaacctaagatgaatctgactccagagcttgtgctaaaagaatgaatgaatgtgtgaatgaaatcacttcatctcttaaagtctcaatttcctagtttgaaaagtaaaacagttagacaagataatctttaaatttccatccaatttcaacaactgkattattttatattataataaaagtaggaactataggcgtgtgtcaccatgcccagctaattgtatcttcagttgaggtggggtttctccatgttagctcatgctggtctcgaactcctgacctcgggtgatccacccgcctaagcctcccaaagtgctgggattacaggcataagccactgtgtccggccaaatttaaattccctcagaatgttttggaggtgcttcaataacaaaacaaaacaaaaaatactttgctggagttcacatacaaatatgatacactaaatagcacaaaaaa

SEQ ID NO: 179650 - DNA, 601 bp, Human
gaggtggggtttctccatgttagctcatgctggtctcgaactcctgacctcgggtgatccacccgcctaagcctcccaaagtgctgggattacaggcataagccactgtgtccggccaaatttaaattccctcagaatgttttggaggtgcttcaataacaaaacaaaacaaaaaatactttgctggagttcacatacaaatatgatacactaaatagcacaaaaaagattacatttcaagcaaaaagaaaaaggaagagcttctgtcatcacgtaactcatcctgatttctctaagggcrtagagacctaagggcttaagggagcctggagaccattgctccagcttgtggatcctgtcccaatagcgtttcttcatcttgggtcggtccactgacatcagcaactgatatggggtgggtacggctgtgccagccttccaggcagccagctgccctggcctgccaatccattcttcacccagcagcagcactcatcactgctgttgttttagtcacatcaatcactttcccaattcagctttgtatcaaatccaagctcccaattataggtttcaaattcctctcccaattattcttccc

SEQ ID NO: 179651 - DNA, 601 bp, Human
aacaaaacaaaaaatactttgctggagttcacatacaaatatgatacactaaatagcacaaaaaagattacatttcaagcaaaaagaaaaaggaagagcttctgtcatcacgtaactcatcctgatttctctaagggcatagagacctaagggcttaagggagcctggagaccattgctccagcttgtggatcctgtcccaatagcgtttcttcatcttgggtcggtccactgacatcagcaactgatatggggtgggtacggctgtgccagccttccaggcagccagctgccctggcctkccaatccattcttcacccagcagcagcactcatcactgctgttgttttagtcacatcaatcactttcccaattcagctttgtatcaaatccaagctcccaattataggtttcaaattcctctcccaattattcttccctccgcgtaaatagaaacatctcctcactgcctgcttttgacactgctctagtgaacatgcttgttccaaggattcacatgccacctccttcctttacctcctagcttctcaaaggtgttgctttctgcttacaaaactactcaaagtcacttcctctggcta

SEQ ID NO: 179652 - DNA, 601 bp, Human
attacatttcaagcaaaaagaaaaaggaagagcttctgtcatcacgtaactcatcctgatttctctaagggcatagagacctaagggcttaagggagcctggagaccattgctccagcttgtggatcctgtcccaatagcgtttcttcatcttgggtcggtccactgacatcagcaactgatatggggtgggtacggctgtgccagccttccaggcagccagctgccctggcctgccaatccattcttcacccagcagcagcactcatcactgctgttgttttagtcacatcaatcacttkcccaattcagctttgtatcaaatccaagctcccaattataggtttcaaattcctctcccaattattcttccctccgcgtaaatagaaacatctcctcactgcctgcttttgacactgctctagtgaacatgcttgttccaaggattcacatgccacctccttcctttacctcctagcttctcaaaggtgttgctttctgcttacaaaactactcaaagtcacttcctctggctagcttttccaaaccaacaactccagactttggtatttctagtctctttagtatctactgagaggtta

SEQ ID NO: 179653 - DNA, 601 bp, Human
ttatagtaagaacagatggtcacagatgagcattgcttcagctattgatgatgttgaagacaaatctttatcacagaaagggaaggaatggaatttttagacataaccattttctagatgtagaatgcattatgcacgccacacaggctatcattgtgattataatggaatgaaatccaaatgtaaaagcatgttgataaagtacttggctgccttcctacacagggtatagactcattcccttctccacgtttgaatcataacataaaaatattttatgtatgatatttgcgtgagattmtcgatgatactgaatgatcggattcctgctagagatatttcactttttatgacagataagtgtttggcattttctttggcttttccacacaagggatgatcaaacagaatgaaagaagaatgagtcttatcaaatatcaaaatgatctaaaaatgactagtttcattctgacagaacttgtatcttaatgtaccaaatagtccactgaggcatgaacattcaattaagttttgaattaaatatcaaaaaaagatgttatatcagagattttgtgtggctcagtttaagatattctagtct

SEQ ID NO: 179654 - DNA, 601 bp, Human
gcaatggtagatagaggtgtgctaacatgattgctcaatatcttgatctacccatgtctgacatcaccaggtgactacttaatggaagcaaaggctgtgatgagtccctcagaagagctcaatgtttcctctaaataactcagattgaagtggaatatgggagtcagatttattgacttgacctggattgttaggttagaacttctgtacccccatattcttccaaagaagtaagtgacacttatttcatgtgaattaaattttaaaatgcctaaaatttttgggatgcaacaaaaatgtrcagtgtaggcaatgactttgtagtctgaaaactcataacactctagctcattcagtgtcatgaaagagttaatgtaaccttcaaagttgtctgatttagaatgaaagtagtttcagctagtcagataatcttcctcgatacttataaaaccaccatacaattagtataagttgacatgcctatggtgaataaagtaaatgagaagaaagactaaaggaattttaatgagctatgccttaatcatccccccaaataaatctaataaggtgtctctctttaactttcactgatgttttttct

SEQ ID NO: 179655 - DNA, 601 bp, Human
ctactttaagtaaagcatgtagcacaatagctgataatctatgttttcagttattactagtaatgcaatgtagctcagaaatccacaaactttatctgttaggttagaaacattggcacccactttcatgttttcttatgttttacgtcatcaaatggcaaactgagagatgaacatggccatcaagtaactctctccctgacttagtaatttcctttctgtttccctgtccataatacaaagagtcgggggtgggagtagagggacgaaagtcctcatatggaaaaaaatacaaccaacytgttcttcctcttgaccatacttagagaaatggtaagtagactctggttaattcaaaaacattttacgataggatagtaaaatgagatttgttttaaaaattactctggaaaaaggatttataatggacaaatgtatatatttagaagattagaccatatcttggcatctggctttgtgaaccatacatgttggaaaacttaaccctctgcctgttctttcaacttccattaaatataatatgtttgctcatagcagcttatcgaacagtgatatgggcaggtaacagaaccatactaca

SEQ ID NO: 179656 - DNA, 601 bp, Human
ggaaagaaaaagtaattagacatcaagaaagtaaagcaagttgcagcccctggttattagtataaaaataaataaggaaaagagagctctgtatagatcgtggtagatagagaatgcttcatggaggaggccaatgttcagttaagacttaaaggataaacaagaatttcatgtgtggagaaatagaaacaaactttccaggctcattcaattactcatgcacttttgcctagcacttatttacctaggccagggaatatgcatgtgagataattctctgttcccaaggaccctcatttcrgttctgtgaatttgataagctttttccctttgtaagttctttgcgcatgatattccaactacattgctttggattcttccccatcatgagctgcttcttccaggcgtcaaaccacacattggagtgtcattgtgagagcacagaattcagagggagacatcatgagcaattcttacccaccagccctcctttcttcccacattcttctcaatcgtggagtatttctaccactagaaccatttcttcaatgacagaaggaaagggaataaaccagaaggaaataggcaatagaaggttcta

SEQ ID NO: 179657 - DNA, 601 bp, Human
tgtgtcaattgtaaaagattgtcttttattttttacaaattaaatattacatagtattttgaataccattgtggagcacactttactgccaaagatagtaaatataaaaagtcttttatatcaagggatgattccaacacatgtaagagtactgagttcccactctagccaaaggagtcatggtgcagtagaagaagaaagggacagggaattgaagaatcttgttcatatgccaatttcacctctattaaccagtcaaccttctactcatgccttaaccactttagacattggtttcctratctataaaatgagggacccagtaagggataagccatatttttatatgtaaacatttccaatagagttccagatacatgtgttagatgaatctgacccttgcatggaataagacacttatctgctgtgtggtctggagcaagcgactcagcctctctgattcttaattctttaaaaactgagtatctccaaactctggagcccattttattttgttttattttattgaaattttatgaaaataaaataccatttttaatccagttaagttaatcttcaataagcatgattacatatatac

SEQ ID NO: 179658 - DNA, 601 bp, Human
ttttgtgtttagcacctcaatatttgattacatcagaggtgaattagtgctatgtttgaaatacagtgaagcgtgagtaatttatttttctgattagggttattatacaaatcgtattctgaaactctgtagtcccaccataatatgaaggcccccaggggcttcagggaactattactgtaacaattgcatatgtaaactcttttcaccacaaaatattaagaggttaaatgctaataggcctttaagatggttggcttgaggttttcttcatctcctgtttgatgttaagcatttgttaaaaaaaaaatcaaagaactggggctgtgtgaagaggttgttattatctttcatctcagggaaataagcagaagacagttgcaaaattgcttggccttattatcctctttctttttaataaactagctccttaaagagctaccgtttttcctaaaatgtctttagatggaagatcgggactgctaattgttctactagttttaactataggggaaaaaaacagcaataacaaagaaatcatgaatcaacgttacaattaccaggttttaagaggataagtaaaaccctggagccaactcta

SEQ ID NO: 179659 - DNA, 601 bp, Human
taatttatttttctgattagggttattatacaaatcgtattctgaaactctgtagtcccaccataatatgaaggcccccaggggcttcagggaactattactgtaacaattgcatatgtaaactcttttcaccacaaaatattaagaggttaaatgctaataggcctttaagatggttggcttgaggttttcttcatctcctgtttgatgttaagcatttgttaaaaaaaaaatcaaagaactggggctgtgtgaagaggttgttattatctttcatctcagggaaataagcagaagacasttgcaaaattgcttggccttattatcctctttctttttaataaactagctccttaaagagctaccgtttttcctaaaatgtctttagatggaagatcgggactgctaattgttctactagttttaactataggggaaaaaaacagcaataacaaagaaatcatgaatcaacgttacaattaccaggttttaagaggataagtaaaaccctggagccaactctaaatacaactaattaaaacaaaaataggaaagaaaatactttctcttaaagtggtcagatatacttaggtacatttaa

SEQ ID NO: 179660 - DNA, 601 bp, Human
gatggttggcttgaggttttcttcatctcctgtttgatgttaagcatttgttaaaaaaaaaatcaaagaactggggctgtgtgaagaggttgttattatctttcatctcagggaaataagcagaagacagttgcaaaattgcttggccttattatcctctttctttttaataaactagctccttaaagagctaccgtttttcctaaaatgtctttagatggaagatcgggactgctaattgttctactagttttaactataggggaaaaaaacagcaataacaaagaaatcatgaatcaaygttacaattaccaggttttaagaggataagtaaaaccctggagccaactctaaatacaactaattaaaacaaaaataggaaagaaaatactttctcttaaagtggtcagatatacttaggtacatttaaatgcatacctagctatctagtagtttcttccatgtatctcgtgaacctgaacaatttggtagccagtgtaatacaagtcccttctggatgcctttcactaactcttcccctttgacagctccctctttactcttttgcttctcctgggtaccacagttggcagctctttct

SEQ ID NO: 179661 - DNA, 601 bp, Human
gacaatgagacacaaatatattcctataatttcctaagaaataatgtatttgatgtaaagaaaaagagaagggaaagagagattattagctgctactgattactcagtgcatgccagatatcacactaagcactttcaataagctgttatgaaatggcccaatgatcctatgaggtaggtattattaacaatatttttatattaaaaaaactagatccagatgtctacccaaaacccaagtacctagtagttaacaacagccaggaaagacacacacacacacacacacacacacacacayatatctatctcctccccttgggattgtgtaataagaacaaacaaacaaccattaggtgtgactctgtgcctagttgacaaaggtgccctttaagaattatatcaccatttcatgaaacagtgggagctcacgtgcttgcattaagtagagtgttcaggacaacctggaccttctagagggctgagagatcagacagatattccagcttttccagcagggactatcaaaatttttcataaagaagacaattatgagctaaaacaaagaacctccaacatgaggaggtttttaggagttaaa

SEQ ID NO: 179662 - DNA, 601 bp, Human
agctgctactgattactcagtgcatgccagatatcacactaagcactttcaataagctgttatgaaatggcccaatgatcctatgaggtaggtattattaacaatatttttatattaaaaaaactagatccagatgtctacccaaaacccaagtacctagtagttaacaacagccaggaaagacacacacacacacacacacacacacacacacatatctatctcctccccttgggattgtgtaataagaacaaacaaacaaccattaggtgtgactctgtgcctagttgacaaaggtgcyctttaagaattatatcaccatttcatgaaacagtgggagctcacgtgcttgcattaagtagagtgttcaggacaacctggaccttctagagggctgagagatcagacagatattccagcttttccagcagggactatcaaaatttttcataaagaagacaattatgagctaaaacaaagaacctccaacatgaggaggtttttaggagttaaagcatgagtttttgagtcagccagactccaaaatcccgatggatatttctgagattcagttttcttttctgcaaagagtacatcataa

SEQ ID NO: 179663 - DNA, 601 bp, Human
gtgttcaggacaacctggaccttctagagggctgagagatcagacagatattccagcttttccagcagggactatcaaaatttttcataaagaagacaattatgagctaaaacaaagaacctccaacatgaggaggtttttaggagttaaagcatgagtttttgagtcagccagactccaaaatcccgatggatatttctgagattcagttttcttttctgcaaagagtacatcataattactaccttgaaaggttgtaagcagattaaactaaaataaacatatgaagggctcagtatgrtatttgggtcatggtgggctctacataaatttctttaaaaagaagagaagggggaaaaaagaggagaggaggaactgctgagaggcattgtttccaggtgcttccctcagtggaagcccctaaggataccaggcgtaaatcattgtggttgctgaagtccgtaggaaatgctgttgcagctgagtgcaaaggtattgggctttaccaacaggggtgacaactagtaaaaaatggaccattgcaagcagtggaaagaaattgaaaacaagaccactttggagcaaaatccagctctccctt

SEQ ID NO: 179664 - DNA, 601 bp, Human
ttatatcctaggatgagactcctgacatttaggaaatgtgtagtgattattgatttcaatgcctcactgaatgaagaaagagagtaatcatttctaccaggtttcctggtagaaatgatgctccagggactcggagtgttttcttgggccaattacagagacactaaacagtaatcttgtcctcagatgtctaaggtagacaggctataattagaaaggagtattgataaagtggtgctgaggtaaaaataaatctagtctttgcaagtctaattattttggagaaaatgagaaaaagaawttgacaaaataaataatgtttgcatacacacgcatacacacacacatattaaaaaaaaaaaaaaccctgaaactattatatatgatctctgatgaaaaaataacaaaattaacaccataagcattcttaataaatagtcattttggaaatcgtttctgaaactttgaaataggcttttaaaatgtaatcatgaatcaacatggctgatatggttcaaaaaatgtggaacccagatgacccacggataatcagtcactaagttctctccatttggagctttattctgtctctcacattcaa

SEQ ID NO: 179665 - DNA, 601 bp, Human
cattcttaataaatagtcattttggaaatcgtttctgaaactttgaaataggcttttaaaatgtaatcatgaatcaacatggctgatatggttcaaaaaatgtggaacccagatgacccacggataatcagtcactaagttctctccatttggagctttattctgtctctcacattcaacctcccactactttctaccatcccagttctgggtcttctctccacatacagaattactgcatttgtcttccaactggttgtccatactctattctctcccacccaaatcatgttatattaayacatgctcctaaaacaggggtcccaacccctgggccataaaccagtacgggtccttggcctgttaggaactgggaagcacagcaggaggtgagcggcggacgaacaaatgaagcttcatctgtatttatagcctctctccattgttcgcattttgttctgattggtcatggggacaaacagttcagctaatcacgtatgagacaaagaatgggaatttggaaggtctgcatctggcctcgccctaggtaacaaggaagtcatccccaagccttatctaagtcattatggggaagggtggt

SEQ ID NO: 179666 - DNA, 601 bp, Human
atggagagatttctttcatcattgctgatattgctgatatccaggggtacagggctcgggtaacatttaacatggccacttccaatggctttcccgtttactcagagtaaacccattatttttcagtggtcgatagcaggggtccccaaacaacgggccatgtggcctattaggaactgggcctcagtgagtggcaggcgagtgagcgaatcttcatctgtatttacagtcagtccccgtcactcgcagtatcgcctgagctccacctcctctcagatcagctgcggcattagattctcayaggagagggaaccctattgtgaattggacatgtgagggatctgggttgtgcgcccctcacgagaatctaattaataatgcctgatggtctgaggtggaacagtttcatcccgaaacaagcctctgccatccgtggaaaaattgtcttccacgaaactagtccctggtgccaaaaaggcgggagaccactgtcctaaaacgcagattttaatatggtcagttggaaactttccaattttttacaggataaaatctaaacttgttctgacattcaaggcccttcaaaacaggacccaacatt

SEQ ID NO: 179667 - DNA, 601 bp, Human
tgccaaaaaggcgggagaccactgtcctaaaacgcagattttaatatggtcagttggaaactttccaattttttacaggataaaatctaaacttgttctgacattcaaggcccttcaaaacaggacccaacatttctcaaaggcaataaactagatcaatattttccagtgtatatcctgagaaacactgtcctgctagatgcttcataataaaaaaggtccttgtgaccaatcatattagaaatgaagaacaatataatcataaaagagctaacatttgttaggaattttctttgtgccrgaaaccaagagcactacacacattataatatttaaccctcacagctctatgtggttgatttacagataagaaaaccaaccaagacttcggaaaggtaagaaatatatccaagtttacacccctgttaagtgtcaaagcagagatctgagccctggtatgccagactgagggctctgaactcttaaacacagaaatgcccaattacttttatgtggggttccaggagattttaacatattaaaatccctgagaagtcctgatgtgcaaaagcttttggaatgctatttaaactaattaaac

SEQ ID NO: 179668 - DNA, 601 bp, Human
acgacttcattataggaaatgtacatcatgagatgccttttaatatctccacaaacctgggtttccaaatagtccatttcaggaaacaaactatgagatttctaaggctctttttacctcaaagattctttaattccttttttcctgtacttccaaattctctcctcaatgactttcaatttatgtaaatagttagttacaagtccctaaacatactttagctctaacctcatttctcatcctcagaagctgtccactttcgtctcaatcttattggtaccttccatctcctctctgaagyctttcctaactggccacaaatatattgggtttgatatggtttggctgcatccccacccaaatctcaaattgtagctcctgtaatcaccatgtgtcatggaagggacccagtggggggtaattgagtgatgggggtgggtcttcccatgctgttctcatgataatgagtaagtctcatgagatctgatggttttataaaggggagtttccctgcacaagcttctcttttgcctgccaccatataagaccgtgcctttcacattccatcatgattgtgaggcctccccagctacgtggaact

SEQ ID NO: 179669 - DNA, 601 bp, Human
ttacctcaaagattctttaattccttttttcctgtacttccaaattctctcctcaatgactttcaatttatgtaaatagttagttacaagtccctaaacatactttagctctaacctcatttctcatcctcagaagctgtccactttcgtctcaatcttattggtaccttccatctcctctctgaagcctttcctaactggccacaaatatattgggtttgatatggtttggctgcatccccacccaaatctcaaattgtagctcctgtaatcaccatgtgtcatggaagggacccagtgrggggtaattgagtgatgggggtgggtcttcccatgctgttctcatgataatgagtaagtctcatgagatctgatggttttataaaggggagtttccctgcacaagcttctcttttgcctgccaccatataagaccgtgcctttcacattccatcatgattgtgaggcctccccagctacgtggaactgtgagtccatcaaacctcttttttcttaaaaattactcagttttaagtatatctttatcagcagtgtgagaacagactaatacagggtttattcttcctcagtgtttctgtgg

SEQ ID NO: 179670 - DNA, 601 bp, Human
gggaatggatatgtacacaacatgatatataaatgtaatctaatatatgaagaaatttaatacactattatgtgtttaaaacagggttgctaggtaaaatacacaatgctcaattgcatttgaatttcagataaacaatgagtaactttttagtataagcatgtcccaaatattatgaggaacatagggcataaactaaacaattattcattatttatctgaaattgaaatggatccggatgttctgtatgtttatttgctcaacctgacagtcctagttttaaaggatctgcaaaagtgmagtttacactatattacataaaaatatataaattatactcagttatggggggaaatatgccttgaaaatagattgtgagaaaatacagtgtaattaagttagtggttactagctgtggagggtttgaatatagattttttaatgtttgtttatgttttcctacaatggatatgagttatttttattagcagaaaaagatgtacatgtattttatatgtccatatagaactctattctgcttttaacatgggcaggggtttactcttaagagtgctatacgctaggatacacactgcttcc

SEQ ID NO: 179671 - DNA, 601 bp, Human
tagtggactcaggagtcggaaaaggtctgtgaaaacaacaaaactggaagaaaagataccaaagcatcttatagcttccagaattttccccaagtgaacgtcaatgttttcccttgaaaggtgatttctgggggatcttgctgcccacacaggtgatgaaaactgtatgccaggctgtcttgtttaagacatatttacttttcatttcactgtattttaaatttgattttatggacttaccatggaaaccatcatttaaaaacaaacaacaaacctctgttttttcaggcctcattttgartagaatattgttggaatcctattagaaagcaggtgtaatgtggacggatctgtggtgcattccttttcccatatcttccttcttgaaaccttttcaaagctgtttcctgacaatgatagcaaaagaagcaatgcattacaggtgaataaaggaaacagaaactaagcttaaaaaatagaacaaagtgaagaaaaaagaaagacaggcgaagatgaggaggaccaggcaggaaagagataggagggctgaagagaggaggaagggacagaaactcctagtgtgtacctaaattacccctag

SEQ ID NO: 179672 - DNA, 601 bp, Human
aattaagacctgatcacaaacacagtcttcacaatatacctccaaggcatcttgtcttggaaaaaaaaaaaaatctgttaaatatacttcactggaatgagggaggatccaaataacagagagtggccagagaatctccaaaataatgattaaagggaggtttcacgatatggcagacctagacaacaacgaattcctattggaacaggaggatgaagggatgtaaacatgaggactccaagggaaaaaaccgaactaataaattatttaatgtgcttggccttattgagaagaagtatgyaattctgtaggtgactgaaggggaagaatgtgtgatagctatctgtaccaaactaaacaaatgagtaaaagtattacctgccttaaaaaacacagggctgcgcaaaaacataaaatagtttattacattcctccaccgtgaaccatatttaaagagttgtaatcatgaaaatactcatggctgatcttttaaaaattgtgataaaacaacattggaagaatgacaggagtacaagaaaaagcaggtccgtggtttctaagtgagctaaattctccttttgcataatagacaatgtcaaaa

SEQ ID NO: 179673 - DNA, 601 bp, Human
cagtcttcacaatatacctccaaggcatcttgtcttggaaaaaaaaaaaaatctgttaaatatacttcactggaatgagggaggatccaaataacagagagtggccagagaatctccaaaataatgattaaagggaggtttcacgatatggcagacctagacaacaacgaattcctattggaacaggaggatgaagggatgtaaacatgaggactccaagggaaaaaaccgaactaataaattatttaatgtgcttggccttattgagaagaagtatgtaattctgtaggtgactgaaggrgaagaatgtgtgatagctatctgtaccaaactaaacaaatgagtaaaagtattacctgccttaaaaaacacagggctgcgcaaaaacataaaatagtttattacattcctccaccgtgaaccatatttaaagagttgtaatcatgaaaatactcatggctgatcttttaaaaattgtgataaaacaacattggaagaatgacaggagtacaagaaaaagcaggtccgtggtttctaagtgagctaaattctccttttgcataatagacaatgtcaaaagaagaagaaaaccaggacaact

SEQ ID NO: 179674 - DNA, 601 bp, Human
ctgtgtttagcatagcacataaatcttcaattccagaccctggatagtggtaacataaatataaatagtctgcctagggggcatttgactgatctgtctttacaaacaaggggttcattaaaagcatatgacttagtttcactgaatgtttgctattgcttcctctcctgtagtgtttttttgtttcctacagtaaaccaaagaacataagttacacctgcacaaagcgatgatttggagtccaagatgtcatgataaatgaggaaggttataggaggatgagccattgcacccacacctyatgatggatgactttggggagctggagcggatctgtagataccctggattttgatcttcaaactaggctgggtcatggagagctaataaatcctgttttactgttgaatgacaaacaataaattagacaatatacactgatagaaagtttttaaatttaatttctttaaaaagtccacaattaaaaataacatatttgattataaaatgtgaggtacaaaatagcctacaacaagaatttggtggaggaaaaaagatgaagaaaatattttcatataaaaataagtggccaggtgtgatg

SEQ ID NO: 179675 - DNA, 601 bp, Human
ttcttttggctgctctggtgctgtatgctgataattttccacctaaatcactaccagaacttctcattctcctctgctggttcatcttcctccacacagtctctggggccagaccaggggcctggggtcctctgcttatctcccgctatagagtctctctgaatgactctcccagccccatgatactaaacacccaccactgggctgactttcaatccacaactagctccaacactacttgtaccccagaaatctagacatatattcaaggaccagcttggaatctctacactgatgtttmcgtatgaatctgaaacaatatttccaagattaagctcttgcttttctctccaaatgtgtttccccccaattccagtcttccatcctttaccaaacattcctcaaaccacccagttgttcaagccaaaactttaggagctagctgctcttgattcttctcgaaaaaaaaatctctcccatttcatctgtcagaaaatcctaccgatcgtgtctccaaaaacatcaccaatcagttaattttttcaccttcaccatcaccatcctctcatctgggttgtttatttggtttcataaccttctt

SEQ ID NO: 179676 - DNA, 601 bp, Human
cttttggctgctctggtgctgtatgctgataattttccacctaaatcactaccagaacttctcattctcctctgctggttcatcttcctccacacagtctctggggccagaccaggggcctggggtcctctgcttatctcccgctatagagtctctctgaatgactctcccagccccatgatactaaacacccaccactgggctgactttcaatccacaactagctccaacactacttgtaccccagaaatctagacatatattcaaggaccagcttggaatctctacactgatgtttacrtatgaatctgaaacaatatttccaagattaagctcttgcttttctctccaaatgtgtttccccccaattccagtcttccatcctttaccaaacattcctcaaaccacccagttgttcaagccaaaactttaggagctagctgctcttgattcttctcgaaaaaaaaatctctcccatttcatctgtcagaaaatcctaccgatcgtgtctccaaaaacatcaccaatcagttaattttttcaccttcaccatcaccatcctctcatctgggttgtttatttggtttcataaccttcttac

SEQ ID NO: 179677 - DNA, 601 bp, Human
ttttgccagtagagaatgaagaaaagtggtttacttaaattgttcagtgaggctacaattccttttatataaaagaatattttcactacttttagaatgacacaaaatagtactttaagagtgagaagatatgttgattttatgcaaatcttaaagctttgggatataagatcagaatgaattacattaccaaaaggtttttatctagacactctacatagtttattgataaatttggtatatttatcagggaagctttataacttaaagaagcactaaaataaaaatatatccctactgyaatttcaaatctaactttgaaatgtagtaatttgacacaagtgccaagatggaaaaaattattcctcaaactgacataagaaaatattctcctatatcataatgaaataacataacactttactttgtgtaaagcattcaccacttgaaaaacattttgataaatgtaaagtttcctaaatgacttgcatatttatgtggctgttccttcatttgcttcagctttcaggccacatttatttactgcctacaatgtgcccactaggaagaaaatatcagtagtgcactcgagtatcttcca

SEQ ID NO: 179678 - DNA, 601 bp, Human
taactatttaagtagggtcagattcctaaataatttgaatgtcaagcatcaaggtagaaggaagaaagaagtgacaaagcagcattaaggaaaatccttcaagaacaaaagagatgtgagctgaggctgacatcagagacaactgtgaacttagtgctgacaatgggaatggaggggtgggaagaaatgtgagaaactgtggaaggagaaatagtcagacttgaaaatttttccatagaggtaagaaatcagggagaaggatcaaagatggcactgatatgtcacatctaagtaagtgaayggaatggtagtgtctttaagagaaaccagtataccaggagtcagtgcagatttggggaaacagataatatgtttgattctaaacaacatgtattgaagacaggacatttcgtccaaggggtgacatcaagatttatgttgcaattagagatcaccagttcagaagagaagtcagtgctaaagacgctcttcttggaaatgtttaagtagctaagagagttgaggccatgaggtagactagtagccctggctctggaataggtgctgtacatgaatctcctcatagctcatgaagttagtt

SEQ ID NO: 179679 - DNA, 601 bp, Human
aggagaaatagtcagacttgaaaatttttccatagaggtaagaaatcagggagaaggatcaaagatggcactgatatgtcacatctaagtaagtgaacggaatggtagtgtctttaagagaaaccagtataccaggagtcagtgcagatttggggaaacagataatatgtttgattctaaacaacatgtattgaagacaggacatttcgtccaaggggtgacatcaagatttatgttgcaattagagatcaccagttcagaagagaagtcagtgctaaagacgctcttcttggaaatgttyaagtagctaagagagttgaggccatgaggtagactagtagccctggctctggaataggtgctgtacatgaatctcctcatagctcatgaagttagttattagattctgttttgcagaagaggaactgtgatcacacagctggtaggagtcagaaccaggactcaagctaaagtcattcagactctggcatttccactgcattatagggctagaaaagggagcaaaggtaaagaacagactgaaagtgagatcctagaagatgccatgttatgggaagaggatgttgttcacatttattga

SEQ ID NO: 179680 - DNA, 601 bp, Human
tatagggctagaaaagggagcaaaggtaaagaacagactgaaagtgagatcctagaagatgccatgttatgggaagaggatgttgttcacatttattgatttatatctcccttttgtctattattgcctttgtaaacaatctgtgttgctcaaagattgctactctcttgtctcaaaaaaatcatttctaggccgggggatgtggctcatgcctgtaattccagcactttgggaggccgaggtgggcggatcacttgaggtcaggagttcgagaccagcctggccaacgtggtgaaaccckgactctaccaaaaatacaaaagttagcttggtgtggtggctcacgcttgtagttccagctactcaagaggctgaggcaggagaattgattggacctgggaggcggaggttgcagtgagccaagatcttaccattgtactccagtctgggcaacagagagagactccatctcaagaaaaaaaaaaaaagaaatcatttctagttgattcattttcacagactgatctgtaaagcaaataagctaagagtttgtacagactgacagtaataaaaggtaggaataatattattggcatcttga

SEQ ID NO: 179681 - DNA, 601 bp, Human
atctcccttttgtctattattgcctttgtaaacaatctgtgttgctcaaagattgctactctcttgtctcaaaaaaatcatttctaggccgggggatgtggctcatgcctgtaattccagcactttgggaggccgaggtgggcggatcacttgaggtcaggagttcgagaccagcctggccaacgtggtgaaaccctgactctaccaaaaatacaaaagttagcttggtgtggtggctcacgcttgtagttccagctactcaagaggctgaggcaggagaattgattggacctgggaggcrgaggttgcagtgagccaagatcttaccattgtactccagtctgggcaacagagagagactccatctcaagaaaaaaaaaaaaagaaatcatttctagttgattcattttcacagactgatctgtaaagcaaataagctaagagtttgtacagactgacagtaataaaaggtaggaataatattattggcatcttgaattcatttgtgttaatatcgtaagtaaaagtttgctctaaaagtctgttcttctaaaatattaaatttcctgctgagatactctctggcttttatacaaacatt

SEQ ID NO: 179682 - DNA, 601 bp, Human
gctgaggcaggagaattgattggacctgggaggcggaggttgcagtgagccaagatcttaccattgtactccagtctgggcaacagagagagactccatctcaagaaaaaaaaaaaaagaaatcatttctagttgattcattttcacagactgatctgtaaagcaaataagctaagagtttgtacagactgacagtaataaaaggtaggaataatattattggcatcttgaattcatttgtgttaatatcgtaagtaaaagtttgctctaaaagtctgttcttctaaaatattaaatttcmtgctgagatactctctggcttttatacaaacattgttacttgttagttaccttgtagtagttatactatttcccctgttatactgaagattcttacttcaaaatgagctgaagatgtgacttatgagtttacataaaatgaaaaaagtagttttggttcttaataaagagaatttatgtgcctggtacattgctaagactaaggaactggcagagtccagatggaggccaagaatacaagatgttatgagcactaaacaaggactccaaaattacttccatcaataacctgtggcatctg

SEQ ID NO: 179683 - DNA, 601 bp, Human
cctgggaggcggaggttgcagtgagccaagatcttaccattgtactccagtctgggcaacagagagagactccatctcaagaaaaaaaaaaaaagaaatcatttctagttgattcattttcacagactgatctgtaaagcaaataagctaagagtttgtacagactgacagtaataaaaggtaggaataatattattggcatcttgaattcatttgtgttaatatcgtaagtaaaagtttgctctaaaagtctgttcttctaaaatattaaatttcctgctgagatactctctggcttttwtacaaacattgttacttgttagttaccttgtagtagttatactatttcccctgttatactgaagattcttacttcaaaatgagctgaagatgtgacttatgagtttacataaaatgaaaaaagtagttttggttcttaataaagagaatttatgtgcctggtacattgctaagactaaggaactggcagagtccagatggaggccaagaatacaagatgttatgagcactaaacaaggactccaaaattacttccatcaataacctgtggcatctgcgaccaccttatccattcctggga

SEQ ID NO: 179684 - DNA, 601 bp, Human
ttcttctaaaatattaaatttcctgctgagatactctctggcttttatacaaacattgttacttgttagttaccttgtagtagttatactatttcccctgttatactgaagattcttacttcaaaatgagctgaagatgtgacttatgagtttacataaaatgaaaaaagtagttttggttcttaataaagagaatttatgtgcctggtacattgctaagactaaggaactggcagagtccagatggaggccaagaatacaagatgttatgagcactaaacaaggactccaaaattacttycatcaataacctgtggcatctgcgaccaccttatccattcctgggattcgttttttgttcattgttgtggtggtggttgtccttgttgctttgaataggagtggccaggggagaggatatctgagattgggtacagggtgtgtatgcagttagaacattagggcgatagcagtattatctttaatcttgaacaccttagaaatggataacacccagagccacacatcgaaaagatagagattttttaaatacccttcaaactgcttaatttgtagtcctaacaaaaaaaaatttacatct

SEQ ID NO: 179685 - DNA, 601 bp, Human
tttgtagtcctaacaaaaaaaaatttacatctgctgaattatgttcatatctgtgagatttaagaaatgctacccaggatctacataaatgttccatttatggcaaagagaagatgattttgtttatgaaaaagagataacaaatatttgagatagtttttaaggatcttctgtcagcaaatgttaatgcagtaaggaagatatcatgatccttctgaaagtcagcgaaaccgaaccaaaaagggatgacataaacttcacgggcatatgctattttaagatttgcacagatttctgcacwctaaaaaacgtgagtttcatgggggctgtttgttctctcactccacacacatatgagagggtgagagagagtatctccagtaacaggggccatccactgttgggttcagtcattctctcttagaggcaccagagggcaccagagggcatgaagatcagagcagcaagccgctctacactctgcatctttatgctagcttccaccataattaacacctgcagaatcctggggtagttttctcaccatgcacttgaaatgtgccagcttttaagaacccttaccggcactcatctcgaattt

SEQ ID NO: 179686 - DNA, 601 bp, Human
aaagagcggagagctaagaattatacctctagcaagccttaaaattataaagaagaggaaaatggttcattaaaggacagagaaatggagaagataaagtatcaaaaaggcagaaagaagaagagccagtaaaataaagtgttgagaagagagtaggaggtcgattaaacaaggtcaagttcacaattttatgccatactgttactcaaatatatatgaaatcttgacatgtgtatttgaataaggatgggatatataatacacatgcatacacatatacacacatacatacatatacatrtgaaaactggatggagaaaaaattttataatgaaggaaacaaacgaacaaaaaaacacaagaaaataattaaaacttgaaaccaaaaactataaagaatatttgccaactactgtcaaatctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtcc

SEQ ID NO: 179687 - DNA, 601 bp, Human
tgtcaaatctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctytctcttccttctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccc

SEQ ID NO: 179688 - DNA, 601 bp, Human
aaatctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctcttccttctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccctctc

SEQ ID NO: 179689 - DNA, 601 bp, Human
atctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctctcccttctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccctctcga

SEQ ID NO: 179690 - DNA, 601 bp, Human
ctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctcttctttctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccctctcgacc

SEQ ID NO: 179691 - DNA, 601 bp, Human
gaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctcttcctcctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccctctcgacctc

SEQ ID NO: 179692 - DNA, 601 bp, Human
aatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctcttccttctttccttctttccttctttatttttttctttctttctctttcttctttctttttttttttttgactgagtttctctcttgttgcccaagctggagtgtaatggtgtgatctcggctcactgcaacctccgcctcccrgcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccctctcgacctcccaaagttctgagattacaggcgtgagccactgcacccggtcaagaagcatttctattctgtgtcttccattttctatttggccagtggggaggaggatccagggcgcaaaggaggctgaggaaaaaaacaggaagta

SEQ ID NO: 179693 - DNA, 601 bp, Human
gcaaatgagaacaagtactccaagaggaaaccaaaaattacgttagacaaataactttattttctcaaataaattgtagacaagatggtttcctgaaggaagaagcagggatgatgtcaatgataaaggcatgcaaatgagaaataagaaaaaaacaaggaagggagttaatataattaacaaagaaatgagagtaatataaacatttgagagaaagaaagccacatttgagtaaccaacgcaggattaacagaaataaaaaccacagaaacatgacagacaggcttgaaatatctcacaraacaaaatagaaaagaatgaggattttcaaatgaccataaatatggtaatagcattggtaaaatggcaataatgtgttttaccataaatgtggtaaaagacataaatatggcaaaagacgtttggcattttttttcttaatcagtattcctgaaaaagagaactcaacaaataaaggagaaaaaataattccaagaatataaagaaaaaaaaagtgtttcctaaaataaaccaatagtgattctagataggcacccattgtttctggaaaaattttaacattgcaatcatcataaacata

SEQ ID NO: 179694 - DNA, 601 bp, Human
gttatttaattttaaagataaggaaaatatctcacatgagcatgcaggaaggaataatataaatatcctttgatttctctttctgcacatctcatatcaaacagtggacagtcttataaattttgaaagcaagaaaaagaatgttatactctcctgaattccccttctggtatagacaagtattctggaacaaaacgaaattttcctggaagaattacatgataagaatatccagaagaaaaaaagatacttgtaaataaagaatagagccaagatcaatcaactatgaaaagtatttatrtaaatgctataaacttaaatgatgtaaaaataatgacgtactataactcgccaaaacagaaaagtagcaaagtaaatgaagtgagaatatatgtgagggtattgaatggttttacggagtgaggagtccaggaatatagtctaaagttgaaatctgcagtaaaaatccataatgtgtctaatattcgtgtttttgttatattttccttaaatcagaagggatttgcagtagttgattagcttgccttgaagaaacatttacttacatttcaacaattcctgtagtttcacttcagcatct

SEQ ID NO: 179695 - DNA, 601 bp, Human
gtttaataatttgcctaaattccttttttttccatcttgtccaccaaatagtgaaaaggtatgtcagattccttcatacaatttaagcaccaccaaataaatttctgtgatctgtgaggttagtaacttgtgacaaagaaagtgatgaatcttgttttcatgttttcttttttcaggcaaaccatgctagatctttgtaactgttattttattacaagagattacaggacattctttaataattttagagtctctgctgtaatcagtatcaaactcagagctttggcttgtaaaatccacrttattttgctgaaaactagatagtgatttgcccttcaccagtcttctattatttgctgtgatttctcttagacctactagttctgctgtttctgaagtcttgcaggcaggcaatatctttgagttcaacccagttaaactaggagccagaactcccggagagcagcagaagagtgagtaggggcaggagtcacttacaacttcttaatccatcatggatttcagttcccacttactaataactgtttcaccttttgagtttttttcagtacaaacaagatggaagctaaatggccaatga

SEQ ID NO: 179696 - DNA, 601 bp, Human
aaaatatccaactttcatgtttataaacttataattcacaggcaacaatggcaaatcagagtggatcttatttttaatctgcctagcagaaaatttatttagtatatgttttactataattatcctaataattgttccactgtacatagggacttttcccagagttgagtaaattggttaggaaataaaaggagctatactgcataaaaataacctaaaattaacatctgcaaataagccaggggacgtgtgtctgtctctgtgtatcataagcatttctagagactgatcatctgacttwgtacttttacatagctatcctttccctacttggccccaagagaatgttatttctcatgattggtttatccattgtattaaaacagaaagaaataatacaattttctcttaaatttcccagtgcctcagttcaatttcctgctggtagatttctgctttctttttatatctaagaaattatactctttactttacaaaggacagtgcactgaccgactgaaatgaatgtgcttgtaatagaacagtgggcagcagcctgccaggcttggtgaagagtgcagcctgctattgctttccaagg

SEQ ID NO: 179697 - DNA, 601 bp, Human
ctcagttcaatttcctgctggtagatttctgctttctttttatatctaagaaattatactctttactttacaaaggacagtgcactgaccgactgaaatgaatgtgcttgtaatagaacagtgggcagcagcctgccaggcttggtgaagagtgcagcctgctattgctttccaaggaacagtttctcccacagctttctttcaccaaagtgtgtctattgccatcaagtcagaaaggaatgaatatttgcgtggttggggaaaacaaacctgctgttgaggaacaggttactttaagccrgaattatctaatcagactgtaccaaaatcaccaagcaattgctagctctggacttagcttttataaagcaacgacaaaatgagttaataagttaaaaaaaatagaggaaataatcattattgcccattgggttattctgaaatatggcttcttcagcaaacaacagggcaaaagtatattatctgtgtttagggcccaagaccagatggatttataggatataaaatatagccttaaagatcccgagaggtttgaagccccagaattcctccctgcactgactgttttaataccctaaaa

SEQ ID NO: 179698 - DNA, 601 bp, Human
tgaagagtgcagcctgctattgctttccaaggaacagtttctcccacagctttctttcaccaaagtgtgtctattgccatcaagtcagaaaggaatgaatatttgcgtggttggggaaaacaaacctgctgttgaggaacaggttactttaagccggaattatctaatcagactgtaccaaaatcaccaagcaattgctagctctggacttagcttttataaagcaacgacaaaatgagttaataagttaaaaaaaatagaggaaataatcattattgcccattgggttattctgaaatayggcttcttcagcaaacaacagggcaaaagtatattatctgtgtttagggcccaagaccagatggatttataggatataaaatatagccttaaagatcccgagaggtttgaagccccagaattcctccctgcactgactgttttaataccctaaaatgtcctcaacaaatgatcagttgtttggagatgtgcattatgggattgtgggattcagaggctctagcaaactcttgaaacaactgtgttttccacaaggttttgatgagtggatttgatgaacagtctcagagcaatataaaag

SEQ ID NO: 179699 - DNA, 601 bp, Human
gggcccaagaccagatggatttataggatataaaatatagccttaaagatcccgagaggtttgaagccccagaattcctccctgcactgactgttttaataccctaaaatgtcctcaacaaatgatcagttgtttggagatgtgcattatgggattgtgggattcagaggctctagcaaactcttgaaacaactgtgttttccacaaggttttgatgagtggatttgatgaacagtctcagagcaatataaaagcatgtgagaaacaaagaaaaaagaccagagacaaagaaacaagaccwgttatgttaggactttaacccagagctagtgctcctggggccacgcctctcaaaaaacttctgccatttcccacttttccgacctgccccaggcagaggatctagccaccagcagaagaactaagtgagcagattaatgccaggggatgctgctgggtgctgcaggctagtagggtaggtaagtccccatgaaatttcagaaagatttgtaggaggcttacaaaagtacacaaaatacaaacactgttgagttgcaagtgaatcaaatcaagaaagaaaaataatattgagttaagtgcg

SEQ ID NO: 179700 - DNA, 601 bp, Human
aataatattgagttaagtgcggtccagaagaagcctaaacagaggacattagcatgtgtggattgctacctggagcattagtgatcagaaagagcatagtagaaacgctatgcccacaggaagactgagtgtgaaaatcagaagagccaaacctgtgctaaagaccagagaaagagaaagtaagacaagggtgagaataataatgatacaaaaaaccctccagtactaataattaatattaattaatattgaataaataaaataatattcaattgtaatattgaataaataaaataatatkcaatattaatattgaataaataaaatcattaatattggatgaatattaattaatattaataatattaatactaatgccagaaatgtgctaagcaattaatatatgttaactcattaaacactttcaagaactatgatgtataatttttattgctatgttatatattagaaagctgagaggtgaagaagtttcggggtagagtatgctgccagagccatgatttgaatccagctctgccagaattcaaggcccatgctctttatcactcttagacagccaagtaggaagtgaaggccaagt

SEQ ID NO: 179701 - DNA, 601 bp, Human
gagaataataatgatacaaaaaaccctccagtactaataattaatattaattaatattgaataaataaaataatattcaattgtaatattgaataaataaaataatattcaatattaatattgaataaataaaatcattaatattggatgaatattaattaatattaataatattaatactaatgccagaaatgtgctaagcaattaatatatgttaactcattaaacactttcaagaactatgatgtataatttttattgctatgttatatattagaaagctgagaggtgaagaagtttsggggtagagtatgctgccagagccatgatttgaatccagctctgccagaattcaaggcccatgctctttatcactcttagacagccaagtaggaagtgaaggccaagtaaacagaagaatgaccaagaagtgaagaacaaagtggggggtgaaggaagcagatccatcagtttctctagtatattttcactgatggttagtagtggtaatgggttatagtgcagaagaataatctcttctattatctcgataaccatcattttacatatataatatatatgtaatacataaatatatata

SEQ ID NO: 179702 - DNA, 601 bp, Human
aagtaaacagaagaatgaccaagaagtgaagaacaaagtggggggtgaaggaagcagatccatcagtttctctagtatattttcactgatggttagtagtggtaatgggttatagtgcagaagaataatctcttctattatctcgataaccatcattttacatatataatatatatgtaatacataaatatatatatttttatatatatataagaatattgccacttctgtttaatagttttcaaaaaataaatttccttccaagttcctattttgggagaaattaatgtatttgcaaccsagggtagtaaaaatgatcaaattattgttctaaaaaaatactaaaactgcaaaaatacttggtcctcaaaatttaggataatactatctgatttccctaatgtatctctctttcaattcattcacttctttcttcaataaacctaccttaagagtttactatgtgataggtttgcaataaaccctttgtaatgcaaaagactaatacatttgtatacaattatataaagcactttacttgaaattaattttatacataaaattgtatttatgtgtatgttatgtatatgttcaaatcagg

SEQ ID NO: 179703 - DNA, 601 bp, Human
ctaccctccatctcttttcctccttctccagccatgtaagatgagctgcttcccctttaccttctaccacaattgtatggttcctgaggcctctctagctatgcttcctttacagcatgcaaaactgtgagtcagttaaacctcttttctttataggttacccagtctcagatggttctttacagcaatgagataactgactaatacagaaaattggtactgggagtggggcattcttataaagatacccaaaaatgtggaggtgactttggaactgggtaatgagcagaggttggaaaaragtggaaggcttaaaagaaaacaggaatatgagggaaagtttggaacttcctagagacttgttgaattattgtgaccaaaatgctgatagtaatatcatcaatgaagtctaggctgaaaaggtcttagatggagatgaggaacttatcaggaagtaaagcaaaggtcacttttcttatgcattagcaaagaagttggaggcattgtgcccctaccctagagatctatggaactttgaaccagagagtgatgatttaggatatctggcagaagaaatttctaagcagtaaaatgttcaaga

SEQ ID NO: 179704 - DNA, 601 bp, Human
gtgacctggctgcttctagcaacctatgcttgtctttgtgagcaaataagtgatctggaactggaacttatattttaaagggaagcagagtataaaagtggaaaatttgtagcccagccatgtggtagaaaagaaaaacccattttctgggaatgaatccaggcgagttgcagaaatttgcataactaaaaagaagtcaaagttaatggccaagacaatgggaaaaaatgccttgaaggaagcatctcctcctgtcacaggcccagagggctgggagagaagaatggttttgcaggctggrcccagggccctactgtcttgtaaaacctcacaacgctgttccctgcatcccagcagctccagctccagccatggctaaaaggaccccagatacacctcaggctactgctccagagtgtacaacccataagatttgatggcttccatgtgctgttaagcctgtggctgtgcagagggcaagagttgagacttgagagcctctgcctagatttcagagggtgtatggaaatgcctggatgtctaggcagaagcctgctacagtgacggagccctcatggagaacttctactagggcaatgta

SEQ ID NO: 179705 - DNA, 601 bp, Human
aaaaatgccttgaaggaagcatctcctcctgtcacaggcccagagggctgggagagaagaatggttttgcaggctgggcccagggccctactgtcttgtaaaacctcacaacgctgttccctgcatcccagcagctccagctccagccatggctaaaaggaccccagatacacctcaggctactgctccagagtgtacaacccataagatttgatggcttccatgtgctgttaagcctgtggctgtgcagagggcaagagttgagacttgagagcctctgcctagatttcagagggtgtayggaaatgcctggatgtctaggcagaagcctgctacagtgacggagccctcatggagaacttctactagggcaatgtagaggaaaaatgtgggattgcagcccatacacagagtccccaccagggcaatacctagtggagctatgagaagagggccactgtcctccagacctcggaatggtagatccactgacagcttgcattatacacctggaaaagccacaggcactcaacaccagtccaggaaagcagctgagggggatgcaccctgcagatccataggggtggagatgcccaaggcc

SEQ ID NO: 179706 - DNA, 601 bp, Human
taaaaggaccccagatacacctcaggctactgctccagagtgtacaacccataagatttgatggcttccatgtgctgttaagcctgtggctgtgcagagggcaagagttgagacttgagagcctctgcctagatttcagagggtgtatggaaatgcctggatgtctaggcagaagcctgctacagtgacggagccctcatggagaacttctactagggcaatgtagaggaaaaatgtgggattgcagcccatacacagagtccccaccagggcaatacctagtggagctatgagaagaggrccactgtcctccagacctcggaatggtagatccactgacagcttgcattatacacctggaaaagccacaggcactcaacaccagtccaggaaagcagctgagggggatgcaccctgcagatccataggggtggagatgcccaaggccatgaaagcccaccccatgcatcagtgtggcctggatgtgagacatggagtcaaagaagattattttggagctttaagatttaaccactcccttgctgggttttggacttgaatgaggcctgtagcccttttgtttcagctgatttctcacatt

SEQ ID NO: 179707 - DNA, 601 bp, Human
cccagatacacctcaggctactgctccagagtgtacaacccataagatttgatggcttccatgtgctgttaagcctgtggctgtgcagagggcaagagttgagacttgagagcctctgcctagatttcagagggtgtatggaaatgcctggatgtctaggcagaagcctgctacagtgacggagccctcatggagaacttctactagggcaatgtagaggaaaaatgtgggattgcagcccatacacagagtccccaccagggcaatacctagtggagctatgagaagagggccactgtcytccagacctcggaatggtagatccactgacagcttgcattatacacctggaaaagccacaggcactcaacaccagtccaggaaagcagctgagggggatgcaccctgcagatccataggggtggagatgcccaaggccatgaaagcccaccccatgcatcagtgtggcctggatgtgagacatggagtcaaagaagattattttggagctttaagatttaaccactcccttgctgggttttggacttgaatgaggcctgtagcccttttgtttcagctgatttctcacatttggaatgtg

SEQ ID NO: 179708 - DNA, 601 bp, Human
actgctccagagtgtacaacccataagatttgatggcttccatgtgctgttaagcctgtggctgtgcagagggcaagagttgagacttgagagcctctgcctagatttcagagggtgtatggaaatgcctggatgtctaggcagaagcctgctacagtgacggagccctcatggagaacttctactagggcaatgtagaggaaaaatgtgggattgcagcccatacacagagtccccaccagggcaatacctagtggagctatgagaagagggccactgtcctccagacctcggaatggtrgatccactgacagcttgcattatacacctggaaaagccacaggcactcaacaccagtccaggaaagcagctgagggggatgcaccctgcagatccataggggtggagatgcccaaggccatgaaagcccaccccatgcatcagtgtggcctggatgtgagacatggagtcaaagaagattattttggagctttaagatttaaccactcccttgctgggttttggacttgaatgaggcctgtagcccttttgtttcagctgatttctcacatttggaatgtgtgtgtatacccaatgcctg

SEQ ID NO: 179709 - DNA, 601 bp, Human
agccacaggcactcaacaccagtccaggaaagcagctgagggggatgcaccctgcagatccataggggtggagatgcccaaggccatgaaagcccaccccatgcatcagtgtggcctggatgtgagacatggagtcaaagaagattattttggagctttaagatttaaccactcccttgctgggttttggacttgaatgaggcctgtagcccttttgtttcagctgatttctcacatttggaatgtgtgtgtatacccaatgcctgtacccaccattgtatcttggaagtaactaacttgyttttcactttacaggctcataggtgaaagggacttaccttgtcccagatgagattttggactgtagatttttgaggtaatgttgaaatgagttaagactttggggaactgttgggatgggatgattgtattttgcagtgtgagaaggacatgagatgttggaggggctgggggcagaatggtatgtttttatttgtgtccctgcccaaatctcatgttgaatttttatccttggtgttggaggaggggtctggtgggtggtgttttgatcatgggggctgatttccaaacccttgatgtt

SEQ ID NO: 179710 - DNA, 601 bp, Human
tcacatttggaatgtgtgtgtatacccaatgcctgtacccaccattgtatcttggaagtaactaacttgtttttcactttacaggctcataggtgaaagggacttaccttgtcccagatgagattttggactgtagatttttgaggtaatgttgaaatgagttaagactttggggaactgttgggatgggatgattgtattttgcagtgtgagaaggacatgagatgttggaggggctgggggcagaatggtatgtttttatttgtgtccctgcccaaatctcatgttgaatttttatccytggtgttggaggaggggtctggtgggtggtgttttgatcatgggggctgatttccaaacccttgatgttcctatcatagtaagttctcatgagatctggttgtttaaaagtgtgtagcacctcccccttcactctcctccttctcttctggccatgtaagatgttcctgcttcccctttgccttccgccatgattgaaagtttcctgaggcttccccagccatgctttctgttgaaccatgagtcaattaagccttttttctttataaattacccagtctcaggtagttctttatagcaa

SEQ ID NO: 179711 - DNA, 601 bp, Human
acatttggaatgtgtgtgtatacccaatgcctgtacccaccattgtatcttggaagtaactaacttgtttttcactttacaggctcataggtgaaagggacttaccttgtcccagatgagattttggactgtagatttttgaggtaatgttgaaatgagttaagactttggggaactgttgggatgggatgattgtattttgcagtgtgagaaggacatgagatgttggaggggctgggggcagaatggtatgtttttatttgtgtccctgcccaaatctcatgttgaatttttatccttrgtgttggaggaggggtctggtgggtggtgttttgatcatgggggctgatttccaaacccttgatgttcctatcatagtaagttctcatgagatctggttgtttaaaagtgtgtagcacctcccccttcactctcctccttctcttctggccatgtaagatgttcctgcttcccctttgccttccgccatgattgaaagtttcctgaggcttccccagccatgctttctgttgaaccatgagtcaattaagccttttttctttataaattacccagtctcaggtagttctttatagcaatg

SEQ ID NO: 179712 - DNA, 601 bp, Human
gtttaaaagtgtgtagcacctcccccttcactctcctccttctcttctggccatgtaagatgttcctgcttcccctttgccttccgccatgattgaaagtttcctgaggcttccccagccatgctttctgttgaaccatgagtcaattaagccttttttctttataaattacccagtctcaggtagttctttatagcaatgtgagaatggacgaatacagggggtagatagaatatttctgccagaaggcatagcgtatgcaaaagttctttagtgggtgggagcagagagcatttggggractgaaggaagccaatgggactgaaagatgggaatggtgggagtcaaagctgcagaagtaaagaagagcccaaccagacagtaccaagtgggctgctcaaacatttctgccttttctcactccttatttatgaaggttgggcacaaacatttgtctctagctctattatgtgtttcagcaaaatctaccgaaactgcttcagtatccaatatttttatcttttgtaataaatggtagtaatagaatgctacagtacacaccttaaatgagcagattttcaccataagcatttttaaaatg

SEQ ID NO: 179713 - DNA, 601 bp, Human
tttatagcaatgtgagaatggacgaatacagggggtagatagaatatttctgccagaaggcatagcgtatgcaaaagttctttagtgggtgggagcagagagcatttgggggactgaaggaagccaatgggactgaaagatgggaatggtgggagtcaaagctgcagaagtaaagaagagcccaaccagacagtaccaagtgggctgctcaaacatttctgccttttctcactccttatttatgaaggttgggcacaaacatttgtctctagctctattatgtgtttcagcaaaatctacygaaactgcttcagtatccaatatttttatcttttgtaataaatggtagtaatagaatgctacagtacacaccttaaatgagcagattttcaccataagcatttttaaaatgtccatatagacaaggtggaatgttgcttttctgcttgtgttttaaaatatcccctcccaactgaatgattatggtgacctttgtttgtgatttagcttcaaattaatatcattaatatatttttgtcattgttgcactatttcatcaccttgaattcttacattttcatctttattggaatctctatgt

SEQ ID NO: 179714 - DNA, 601 bp, Human
atgattatggtgacctttgtttgtgatttagcttcaaattaatatcattaatatatttttgtcattgttgcactatttcatcaccttgaattcttacattttcatctttattggaatctctatgttcatcagacacattggccagtagcataaataatcatgttctgatcagtatttacaaacttgtaatatctgaaatttatgaactgaaattatttctatagcagtaaattttatgaattttattcattaaatgtatgtttaccttgcacttattatgtgaaagattgtaaaacttcckaggacacaatgaaaataaactttaaggagatatactaggttaaatacatgctgtggttataagactctgagcttcatggagcaagcactctatctatcctgctcatcactctacttccagtacctcacaatctatatggcacaaagcagttcctcaatgaacagttatttgaataaacagaacagaaattaaaggaagaagtggaatggatctatcacattttctttaaatccaggattggttctgattttatttctgctcctttgttttgtataagaatatgtgtgtgagtgtgtgtgt

SEQ ID NO: 179715 - DNA, 601 bp, Human
gaagaagtggaatggatctatcacattttctttaaatccaggattggttctgattttatttctgctcctttgttttgtataagaatatgtgtgtgagtgtgtgtgtgtgtgtgtgtgtgtgtgtgtgtgtgtgtgtgtgtgtgtgtgtgtggggaggtgggtgggtgtgtatctaatgcttaatcaagagtttatttcccatgaaaaacacaaacaacacacagacacacagacactctcacacacatacaaacatacacacaatgataattaattcagaacagtgttcttgattcatacwtttccatggttggaaagatcctatgtgtagattttccaagccagtgctttgcaatcattgccagcaaagtaccctattttagaacatatggtgtcagatttcacaaaatgattcatatttcctaggccttgtgtgaaagtaggtgtttctatttgggaattactgcttaaacaatgactattttgacaagaagcaacacattttttttttcttccagcacatctcttgcttaggtggaagctggagaaccaattactagtgtgattatcctaagtgtattcttacatgttttcttctctg

SEQ ID NO: 179716 - DNA, 601 bp, Human
agaaacaggttccttttaaaagtgatgaatatgagcaagcctttttcttattagagtcttagagaggtcactgcagcatgtggtgagatatttactaatgcatgccgtttttacctaggaaacaactttctatgaaatgtaaacacagctgtggagtttaattcaggatcctcatccttcttgtattaagctacattggaaaggcgttcaaatcagccttaaaaaagagaatcagttgacttcatggcagtagacccctgaaattttggaaaccagatttttaagactattacagttagargagctgagttaaaaggtttgctttggagtaaaactggtttggtttgaatatcgctctgttatgtgaccttgaacaagttttcagcattactgaactaattcctcatctgtaaatggggctaatatttgaacacctatcaataggtggtataagaactaaagaaaataggaggctggatgtgatgcctcattcctgaaatcctagcacttttgaaggccaagcaagaggattgcttgaagccagaggtttgagaccattctgggcaacatagtgaggctctgtctctgaaaatttttttaa

SEQ ID NO: 179717 - DNA, 601 bp, Human
atgatttagggtttgtggcagtctgttatgtaagtgacttctagtaaaccatgcctcctggtaatcatgcccttccttgtgtagtgccctcctcttgaatatgggcagcctccctgaccaatagaaggaagcagaatatgcactgtgccaattccaggactaagctttaaaaaagtctggtagcttctgcttttgttgtctagaaagccccgagccaccatgtgagaaagtctattaccttaatagagacaccctgtgtttcattagacacacacccacacacacacacacacacacacasagagagacagagagagagagagagagagagagagatcctaactatattatagaaagacatgagctcaaaaaactcagtggcccagccaattcaagcctctaactgacccatcagctaaataaagccacacaagtaaccactggcaagaccagcagaagaaccatccagcagaacctagcccaaattgagaatagtaagcaaacaaaatagttttttgtttgtttgtttaaagacgctaagttttggggtgtttacttgaacagcaatgggtaacggaatcagggttatttccctttcttt

SEQ ID NO: 179718 - DNA, 601 bp, Human
agacagagagagagagagagagagagagagatcctaactatattatagaaagacatgagctcaaaaaactcagtggcccagccaattcaagcctctaactgacccatcagctaaataaagccacacaagtaaccactggcaagaccagcagaagaaccatccagcagaacctagcccaaattgagaatagtaagcaaacaaaatagttttttgtttgtttgtttaaagacgctaagttttggggtgtttacttgaacagcaatgggtaacggaatcagggttatttccctttctttcattscccctttctaccagacacattttttagattttttctcatatgtcctcctttcactaatcaccatttggtagatccattaaagtctttttacgttgatctaaaatgtaactcttgagtcatttacgacagttatgacatgtgttaatcaaaataggatttggggaaacctgagatgtccaccctacttgctgcaatggctgaacattatatcaaatctggacttatgagtgccatacagcttcataaacattgaagcacctaacatttttcatgcttttgcaacttactatgacttgccgt

SEQ ID NO: 179719 - DNA, 601 bp, Human
aaagacatgagctcaaaaaactcagtggcccagccaattcaagcctctaactgacccatcagctaaataaagccacacaagtaaccactggcaagaccagcagaagaaccatccagcagaacctagcccaaattgagaatagtaagcaaacaaaatagttttttgtttgtttgtttaaagacgctaagttttggggtgtttacttgaacagcaatgggtaacggaatcagggttatttccctttctttcattccccctttctaccagacacattttttagattttttctcatatgtcctcytttcactaatcaccatttggtagatccattaaagtctttttacgttgatctaaaatgtaactcttgagtcatttacgacagttatgacatgtgttaatcaaaataggatttggggaaacctgagatgtccaccctacttgctgcaatggctgaacattatatcaaatctggacttatgagtgccatacagcttcataaacattgaagcacctaacatttttcatgcttttgcaacttactatgacttgccgttgactcatcatggcctgagcatttaaaaatattatgaaatatatttga

SEQ ID NO: 179720 - DNA, 601 bp, Human
agggcctgagttcaaaataccacctgctttaaaatgtgtggtattttcagaattaaaatagcaatgtatatctcttcaacttgattctcactgcatttctttattaagttaggcttttctgataataattaaccagttaagcagccctaaatataattaattttttaattgaagatgagtttgaacaaattgaaaagtttatcaaaatgggtgattttttagcctcatgatctagctgaatcactttatcacaataacatgcttttgcacaaagactacttaatgtgtttttgaaataaamgcatgtggtcccatgagagtatctttgatctcagacatgttggtaccatgtagaagactttgaatttgttgcttaggtttataatacaagcaagtgattcttctattgatactttgaaaatattgtctactctgattggaggaataattaatttaagtccctctatccctgagtaaccctctgttagtgttctctggagaataagaatcaataaatttctctctctctctccatatacatatgtgtatgtgaattcatatgtgtatatatatttatatacgttcatactatacatataca

SEQ ID NO: 179721 - DNA, 601 bp, Human
agtatctttgatctcagacatgttggtaccatgtagaagactttgaatttgttgcttaggtttataatacaagcaagtgattcttctattgatactttgaaaatattgtctactctgattggaggaataattaatttaagtccctctatccctgagtaaccctctgttagtgttctctggagaataagaatcaataaatttctctctctctctccatatacatatgtgtatgtgaattcatatgtgtatatatatttatatacgttcatactatacatatacatatgtattcacacacacrcacacacatgctatgtaaaattggctcatcaatcatgggggctggcaagcccaaaatctgcagggtggcctggcaagttagagacagagggaagacccactgtttccttttaaatctgaaggccatctgctgcagaattccttcttgctcaagggggtcagtcttttttctattcaggccttcaatggattgcaagaggttcatccactttatagagaataatctgctttactcaaagtccatggatttaaatgtcaatcttatctgaaaacaacctcatgggaacatcagtatattgtt

SEQ ID NO: 179722 - DNA, 601 bp, Human
ggtttataatacaagcaagtgattcttctattgatactttgaaaatattgtctactctgattggaggaataattaatttaagtccctctatccctgagtaaccctctgttagtgttctctggagaataagaatcaataaatttctctctctctctccatatacatatgtgtatgtgaattcatatgtgtatatatatttatatacgttcatactatacatatacatatgtattcacacacacacacacacatgctatgtaaaattggctcatcaatcatgggggctggcaagcccaaaatmtgcagggtggcctggcaagttagagacagagggaagacccactgtttccttttaaatctgaaggccatctgctgcagaattccttcttgctcaagggggtcagtcttttttctattcaggccttcaatggattgcaagaggttcatccactttatagagaataatctgctttactcaaagtccatggatttaaatgtcaatcttatctgaaaacaacctcatgggaacatcagtatattgtttgaccacatatctgggcactgaggccaagcccagttgacacataaaagtaaccctcat

SEQ ID NO: 179723 - DNA, 601 bp, Human
tggagaataagaatcaataaatttctctctctctctccatatacatatgtgtatgtgaattcatatgtgtatatatatttatatacgttcatactatacatatacatatgtattcacacacacacacacacatgctatgtaaaattggctcatcaatcatgggggctggcaagcccaaaatctgcagggtggcctggcaagttagagacagagggaagacccactgtttccttttaaatctgaaggccatctgctgcagaattccttcttgctcaagggggtcagtcttttttctattcakgccttcaatggattgcaagaggttcatccactttatagagaataatctgctttactcaaagtccatggatttaaatgtcaatcttatctgaaaacaacctcatgggaacatcagtatattgtttgaccacatatctgggcactgaggccaagcccagttgacacataaaagtaaccctcatacccaccttgagatctgagccaattgagagagagtctcaggtatcaaatagatggagattaacagtagtggtgtttgagtagaggccatggcttggaaacgtgatcaaatggacttcct

SEQ ID NO: 179724 - DNA, 601 bp, Human
catactatacatatacatatgtattcacacacacacacacacatgctatgtaaaattggctcatcaatcatgggggctggcaagcccaaaatctgcagggtggcctggcaagttagagacagagggaagacccactgtttccttttaaatctgaaggccatctgctgcagaattccttcttgctcaagggggtcagtcttttttctattcaggccttcaatggattgcaagaggttcatccactttatagagaataatctgctttactcaaagtccatggatttaaatgtcaatcttatcygaaaacaacctcatgggaacatcagtatattgtttgaccacatatctgggcactgaggccaagcccagttgacacataaaagtaaccctcatacccaccttgagatctgagccaattgagagagagtctcaggtatcaaatagatggagattaacagtagtggtgtttgagtagaggccatggcttggaaacgtgatcaaatggacttcctgctactcaaccttccccatagtaatgaccaatatacagatcgtcacccaggaattttgttatgaggaagagagaaaagtgtgtgcagag

SEQ ID NO: 179725 - DNA, 601 bp, Human
atgggggctggcaagcccaaaatctgcagggtggcctggcaagttagagacagagggaagacccactgtttccttttaaatctgaaggccatctgctgcagaattccttcttgctcaagggggtcagtcttttttctattcaggccttcaatggattgcaagaggttcatccactttatagagaataatctgctttactcaaagtccatggatttaaatgtcaatcttatctgaaaacaacctcatgggaacatcagtatattgtttgaccacatatctgggcactgaggccaagcccagytgacacataaaagtaaccctcatacccaccttgagatctgagccaattgagagagagtctcaggtatcaaatagatggagattaacagtagtggtgtttgagtagaggccatggcttggaaacgtgatcaaatggacttcctgctactcaaccttccccatagtaatgaccaatatacagatcgtcacccaggaattttgttatgaggaagagagaaaagtgtgtgcagagggcaggaagaaagcccaagctctgtgcattacacttttctcagtctcattatcccatgtcactaccttc

SEQ ID NO: 179726 - DNA, 601 bp, Human
ggtgtttgagtagaggccatggcttggaaacgtgatcaaatggacttcctgctactcaaccttccccatagtaatgaccaatatacagatcgtcacccaggaattttgttatgaggaagagagaaaagtgtgtgcagagggcaggaagaaagcccaagctctgtgcattacacttttctcagtctcattatcccatgtcactaccttcctttggagaagagtgcctgtggaggcacagaggaggctccaagttacttgttacattattctaaaagaagcagaaattccttttaaacaagamcaggcaggtttgtgtggggagagagaggatcactccctaaaatagcattcaaatacgatttttcagaacaattctggtttctaaacaatcatcgtgatccagaatctgactgcctgtgcattacagacttaaaaattatgtaaaggatagtatttggcagtaatttagaaaacatatttctcaaagttttctatttagaccagtactccttttctctaagaataatgtgagattttgatcatttgtacagctttcatatttttcttttatgtaatctcttaaaatgattcacagaaactt

SEQ ID NO: 179727 - DNA, 601 bp, Human
caaccttccccatagtaatgaccaatatacagatcgtcacccaggaattttgttatgaggaagagagaaaagtgtgtgcagagggcaggaagaaagcccaagctctgtgcattacacttttctcagtctcattatcccatgtcactaccttcctttggagaagagtgcctgtggaggcacagaggaggctccaagttacttgttacattattctaaaagaagcagaaattccttttaaacaagaccaggcaggtttgtgtggggagagagaggatcactccctaaaatagcattcaaataygatttttcagaacaattctggtttctaaacaatcatcgtgatccagaatctgactgcctgtgcattacagacttaaaaattatgtaaaggatagtatttggcagtaatttagaaaacatatttctcaaagttttctatttagaccagtactccttttctctaagaataatgtgagattttgatcatttgtacagctttcatatttttcttttatgtaatctcttaaaatgattcacagaaacttaaaaatcctactagcaaaatagcccatcatgatcaaatgtagctgcattacccttt

SEQ ID NO: 179728 - DNA, 601 bp, Human
ttatttcatttttctttcatagtacacctgcaaattagctggagctaaccctatcttattggcaaggaaactagcagtgatgttgaagcagcttatccaggatcacacatgaagtggcagattcaggttttacaatgtcaagttccatgcccttttctgaggtcccagccccttctcatcctgccattttgcgatattttagaacaagtgcaacttagtgatgtacttgatacctggtcattgcatcaggaaagattagattaggctgagtgtgattgaaaacccaaatagtagcaagctrgtaaaaatagaggcttatttctcttgcatataaaagaagtctagatcgaggatgtcttggtgccctatgttgaagagcttagttttctttgatctctctgctgtattgtgtgtggttttattctataggtgacgtggtccaaggtaactgctggaactccagaaagtccatccatatattaacccacaagaaagaggagattatcttcttttatagataattcctagaagatgtgcatgtaacatttacttatttctcattggccagaacttgtcacatggaaacagcttgttgcaaggg

SEQ ID NO: 179729 - DNA, 601 bp, Human
agattcaggttttacaatgtcaagttccatgcccttttctgaggtcccagccccttctcatcctgccattttgcgatattttagaacaagtgcaacttagtgatgtacttgatacctggtcattgcatcaggaaagattagattaggctgagtgtgattgaaaacccaaatagtagcaagctagtaaaaatagaggcttatttctcttgcatataaaagaagtctagatcgaggatgtcttggtgccctatgttgaagagcttagttttctttgatctctctgctgtattgtgtgtggttytattctataggtgacgtggtccaaggtaactgctggaactccagaaagtccatccatatattaacccacaagaaagaggagattatcttcttttatagataattcctagaagatgtgcatgtaacatttacttatttctcattggccagaacttgtcacatggaaacagcttgttgcaaggggttgtggatgaggggccgtctattctgagcagtcataagtccatctaaaaaattatgggttttgttttcaaaaaagaaaataagcatgggtacattggaacaaagtagaattgtctgc

SEQ ID NO: 179730 - DNA, 601 bp, Human
tgtttttcatcctgtttagtgcaatactgtaaacctttaataacagcatgggacccatacagagtgccactggtgatgctggaagtgctccaaagaagcagaaaaatgtcacaacactacaagaaaaagttgaattgcttgatatgtgccatagactgaggcctgcaactgcagttgcagacaattcatcttataaacagacaatgtaaacttacagcacaggtacatatagtccaatattgtaaatgtatttttctcatggttttcttcacattttttggcttactttattgaaagaatmcagtatctaatacatagaatatacaaaatctgtgttaatcaatcatttatattatgggcaaggcctttggtcaacagtaggctgttaggagttaagttttggggaaatgaacagttatacatggatttttttttttttttactgtgtgttgggagggttggtgctcctaacagttttgtgggtctcaactttataggatattgctcaggagtttcaagtgagtagatatgttggtatttacaaacactgtgggcttaggaattatggttattattctcccagtatccaaatcctggcaca

SEQ ID NO: 179731 - DNA, 601 bp, Human
ggtatttacaaacactgtgggcttaggaattatggttattattctcccagtatccaaatcctggcacattgcttactagttgggtaaacttgggtaaggtttttgacctccctgtgcctcagtttgccgtctgtaaaattaggatacaaatcctgattgcctagtaataaatcaattaacgtatgtatgtcacttaaatcagtgcctagtgcataataaattttaataatcatacctattattattctccccttttcaaaaatgaggatggctttaatttaattagcactagagggagaaytatagtcccatagagtctaaaattttcctacaagcaaataggataaagtagtgtaacagcaatgctcatcactctcttgcagtgattttcctgcagccctaattagccacacatctcacgcccatgatttctggtcatgtactcttttttcctccccattctgctacctatttttgccagcgtatctttacaattttcatcagaaagagaattctaaatataatttcccaggaaacttctcaggtttccattcattcttcattatcattgaaaagaatagtacatcaaatgctgctgata

SEQ ID NO: 179732 - DNA, 601 bp, Human
caacctatacattgttccagggttgaatgcaatttgattggaaataacctcaacagtgaacttgaaatatcacgctatcaaataaaaatagaaagaagaaaatctaaagtctctttctctctcacacacacacacacagacacacacgcacacaacatagaaaccatgctggtagccctagaatttgtcctttctgatttttaatttggctctgtttttgaagtaaacaagtgtctatcataaatactgtgaaatttatggtaggattttactcccttgtatcacaagccatgagtgcttytaagcagccagcctttatgcataaactgcagtgtgtgagagcttcaagcttatttgaaatggaagtggtgtttggtgagatgggaagaagggatgtattttaaactaataaataatcatcatccatgcctacttggaaaatagctttcttgtcgaatagtatttcaatatatagtatcttgaaataagactgccattaataatgtaagcatagcttgccatataaatcctgcaaatatgtacatacatgaggcctaaattactctctggggccacctttttctgcttaaattacctttag

SEQ ID NO: 179733 - DNA, 601 bp, Human
tgtattgtcactacctgccattgatcaaaaagtcacatggccaagcccagcactattgaaacagtaaagtatgttctacctcttgcaaggcagtgaatggttaggaacaataatgcattatacatactaacaatttactattattaagtaatgatcatgaaatcacaaaattttaatttgttttcgcttttgatggtaatggggatttaaaagacgctgtactttaatcaatttcaatatctataatttttcactctataattattttttcttttatgagtagttttatgtactcatgaayttttattcatgcaacatcttataatacagttattactcttttgatgcacaaattgtaccaaatctgaccagatagagttgctttaagttggctcctgtgcccttccaatgtgtccccattcttctttgagcatttctttactctggcacaagctgtgtccagattatcatttttttattgatacgtaataagtgtgaatatttggtggggtacatctgatattttgatgcatgcatgcaatacgtaatgatcaaatcagcatatttagaatatctatcacatcaaactttattgtttctt

SEQ ID NO: 179734 - DNA, 601 bp, Human
tgacatgctgatttcctttcctttggataaatacctggtagtgagattgatggattgtgtggtatttttatttttaatttgttgagaaatcgctatactgttttctataatggttatgctaatttgcattcccaccaacagtgtataaaaattcccctttctcctcatcctcatcagtatttgctattttttgtctttttgatgatagccattctaattgcagtaagatgatatctcattgtggttttgattagtattttcctaataattaattatgttgattatatttttcatatacctrttggccgtttgtctgtcttcttttgagaaatatctattcgtatcctttgcccacattttaatgggattattttgggcttttttggtgttgagtcatcttccttgtgtattctggatacagtcctttgtcagatgaatagttggcaggtattttttcccatcaatagattgtctcttcactctgttgattatttcctttactgtgcagtttttttgtttaatatggtctcatttgtctacttttgtttttgttgtcattgcttttgcaatcttagccataatatttttgcctagaccagtg

SEQ ID NO: 179735 - DNA, 601 bp, Human
atttttgcatatggtgtaattttcactctctattgaccggtgatagttgttgagtatttttaattgtgctcatagctataatcatcatcataattcagaattacttatgatagagtgataaagacattctttttataaatgcattctttttatatgagctcttttaataatagtattttagagtggagaaaggaaaaatttatatattatctttctttagtcagtgggaaatcttattctagaagaaaaatgatgctgcaggcagaatagcgaataatgttattagactaattcaccccaytcccagtatcctgccacctccctagtcatagtttccttgaataatcaaaacagccgtcatcaactgagtacttacaaggtgacagacactgtgctaagcactttacagggggcttaccccttatttgagcaatactttatgagatatccactacaaatatctctaatacacacatgagaaagttgaaacttggagaagttaggtgacttccctaaagtcatgcagttaggaaaggactggataagactccagagcttccatgagtctcagacactgcactacctccagtggaaatacaaa

SEQ ID NO: 179736 - DNA, 601 bp, Human
agacactgcactacctccagtggaaatacaaaataatcttatgtactctttttacaatagtatgtaaaagtggagaagcaaaaaagtgcattgactttattattacatagtacttaagttaagagtagataagccagaagagtggacagccaaaatgcattggccacttattgggaacaaggcattatttccatgcattaactcatttaatactcaaaacaagcttataaaatggatgtgatgattatcaccattttacaggtccagagaggtaaagtgaccaggtcaagattgcacaggygggtaagtgatggaagctagctttgaaacaagactttctggtgtcagaatttcagaatttacactcttaggctctacacatccttgcctttataaaaaaatttgaaaacttaacctcaaaatgcccacactcactctacaccctaatgcatacctgtacatcctccaggtttaccactatttcaaacctgtctcacatccaaaggatttaaagatgaatttctgtgcaacttattttctctctttgcctcccaagttattcccatcctgtcaccataacaaccccaaacctgtaatacat

SEQ ID NO: 179737 - DNA, 601 bp, Human
gcaaaaaagtgcattgactttattattacatagtacttaagttaagagtagataagccagaagagtggacagccaaaatgcattggccacttattgggaacaaggcattatttccatgcattaactcatttaatactcaaaacaagcttataaaatggatgtgatgattatcaccattttacaggtccagagaggtaaagtgaccaggtcaagattgcacaggtgggtaagtgatggaagctagctttgaaacaagactttctggtgtcagaatttcagaatttacactcttaggctctayacatccttgcctttataaaaaaatttgaaaacttaacctcaaaatgcccacactcactctacaccctaatgcatacctgtacatcctccaggtttaccactatttcaaacctgtctcacatccaaaggatttaaagatgaatttctgtgcaacttattttctctctttgcctcccaagttattcccatcctgtcaccataacaaccccaaacctgtaatacatagtcggaatcgttatcgagagaggcagaaggaagaagcatttgatgtatctcttcaggggtcctctctgacaacttt

SEQ ID NO: 179738 - DNA, 601 bp, Human
cacccagcatcgcaaatcagacgaagaggaacatctaagttacataagaaatgtattgagtaaacaggaagaaatgtggaatgcatctgcctatctctcctttgtcatgaagagaccaaaaactgctgcaagcaaaaggggaaatagaaagtttcttgggagctgggcacggtgactcacggctgtaatcccagcactttgggaggccgaggcaggtggatcatctgaggtcaggagtttgagaccagcctggccaacatggtgaaatgccatctcagcaaaaaaaaaaataataataatwattattattattattttatatatatatattagccaggtgtggtggcacgcacctgtaatcccagctactcaggaggctgaggcaggagaatcacttgaacctgggaggcagaggttgcagtgagccaagatcatgccactgcactccagcctaggcaataagagtgaaattccatctcaaaaaaaaaaaaaaaaaagaatgtttcttggggtctaacccgtggcctcagtgtttagtacgtagtggatggacaagacacttcacttctgtggatctcagtttcttcagctggaactgaga

SEQ ID NO: 179739 - DNA, 601 bp, Human
gaagagaccaaaaactgctgcaagcaaaaggggaaatagaaagtttcttgggagctgggcacggtgactcacggctgtaatcccagcactttgggaggccgaggcaggtggatcatctgaggtcaggagtttgagaccagcctggccaacatggtgaaatgccatctcagcaaaaaaaaaaataataataattattattattattattttatatatatatattagccaggtgtggtggcacgcacctgtaatcccagctactcaggaggctgaggcaggagaatcacttgaacctgggagkcagaggttgcagtgagccaagatcatgccactgcactccagcctaggcaataagagtgaaattccatctcaaaaaaaaaaaaaaaaaagaatgtttcttggggtctaacccgtggcctcagtgtttagtacgtagtggatggacaagacacttcacttctgtggatctcagtttcttcagctggaactgagatgattatgaatctggtttgcattacagtattatgtaaggagatcaaatcaaacactcagaggaaaaacctggcatacaaatcatatgcatttgtgctccaggaaggaa

SEQ ID NO: 179740 - DNA, 601 bp, Human
gagtttgagaccagcctggccaacatggtgaaatgccatctcagcaaaaaaaaaaataataataattattattattattattttatatatatatattagccaggtgtggtggcacgcacctgtaatcccagctactcaggaggctgaggcaggagaatcacttgaacctgggaggcagaggttgcagtgagccaagatcatgccactgcactccagcctaggcaataagagtgaaattccatctcaaaaaaaaaaaaaaaaaagaatgtttcttggggtctaacccgtggcctcagtgttwagtacgtagtggatggacaagacacttcacttctgtggatctcagtttcttcagctggaactgagatgattatgaatctggtttgcattacagtattatgtaaggagatcaaatcaaacactcagaggaaaaacctggcatacaaatcatatgcatttgtgctccaggaaggaattgctaccttggtgtaagatatattaatatgtaaactatattgaatgtcccattctttagacacagtggcttcagacacattttatattttttaatgctacacactcatgtttatcttaatgtctg

SEQ ID NO: 179741 - DNA, 601 bp, Human
gcactgtatttgtatgcccacaatataatgaaaatgtgatccctaaaaggaaacagacatggcataaatatcaatatgctcattaacgagttattacggacagagtgcacacatgagtgaaaatataatttaaactttggttttctgaccttgtctaatgccttgaaagcaagggataattcaaccaattgcacattactctcctcttgtccagcttcccctccatgaaactaaggcttgatttagtttccaaagaatctaatttcaccaagaatgcgatggaatgcctctaatgacgccytccacttacactttcactcggagccagcagcagcgagcaccaccagattattatgaagctgaatgaaatagaggcattcatcagagctaaataaaaataaacagttgaaattgcctgtcagtctcagggggaacatgaagggttgtttaaagatatcttcccttttaataagaaattttattactttgggggtgtgttatgttctcattctcagagtaatccagctgccacatcacctttgttgttatctgaacctgtagctctggtgctgtgagctgttgttatgcacaagcatgaaaa

SEQ ID NO: 179742 - DNA, 601 bp, Human
gtcagtctcagggggaacatgaagggttgtttaaagatatcttcccttttaataagaaattttattactttgggggtgtgttatgttctcattctcagagtaatccagctgccacatcacctttgttgttatctgaacctgtagctctggtgctgtgagctgttgttatgcacaagcatgaaaatagatgcttgatgaacatttcaaggtggtggggctgaaaccaggcatcacggcagaattttgaatcagctattgctacttctctgtcttcattgctttctctctaggctctcctatwacaccaatgctgtgttaaattcctgagattaccagctccctgggtttctctttcttggatttaataagtgaaaaaaagaaaatataaatttaaaagggtaaggtgattgtgtttccatagattgacacgcttggcaaaacaagatcagctgagtttaaagaaggaaaatgggaactatacaggcatacctcatcttattgagcttcactttactgtactttgcagatattgcatttcttacaaattgaaggttttgggcacgcctgcattgagcaagcctatcggcaccatttttccaac

SEQ ID NO: 179743 - DNA, 601 bp, Human
gatgaacatttcaaggtggtggggctgaaaccaggcatcacggcagaattttgaatcagctattgctacttctctgtcttcattgctttctctctaggctctcctattacaccaatgctgtgttaaattcctgagattaccagctccctgggtttctctttcttggatttaataagtgaaaaaaagaaaatataaatttaaaagggtaaggtgattgtgtttccatagattgacacgcttggcaaaacaagatcagctgagtttaaagaaggaaaatgggaactatacaggcatacctcaycttattgagcttcactttactgtactttgcagatattgcatttcttacaaattgaaggttttgggcacgcctgcattgagcaagcctatcggcaccatttttccaacacaatgtgctcactttgtatctctgtatcacatttcggtaattcttgaaatatttcagtttgttacggtgatctgtgaatctgtgattactgattttttttttttttttaagacagagtctcactctgtcacccaggttggagtgcagtggcaagatctctgctcactgcaaactccacctcttgagttccag

SEQ ID NO: 179744 - DNA, 601 bp, Human
ttctctgtcttcattgctttctctctaggctctcctattacaccaatgctgtgttaaattcctgagattaccagctccctgggtttctctttcttggatttaataagtgaaaaaaagaaaatataaatttaaaagggtaaggtgattgtgtttccatagattgacacgcttggcaaaacaagatcagctgagtttaaagaaggaaaatgggaactatacaggcatacctcatcttattgagcttcactttactgtactttgcagatattgcatttcttacaaattgaaggttttgggcacrcctgcattgagcaagcctatcggcaccatttttccaacacaatgtgctcactttgtatctctgtatcacatttcggtaattcttgaaatatttcagtttgttacggtgatctgtgaatctgtgattactgattttttttttttttttaagacagagtctcactctgtcacccaggttggagtgcagtggcaagatctctgctcactgcaaactccacctcttgagttccagcgattctcctgcctcagcctcctgagtagctgggattccaggtgcccgctgccatgcccagctaatttt

SEQ ID NO: 179745 - DNA, 601 bp, Human
ataaaattacaatgcttttcattataattgcttcttcccacttttcatgatgcttctgtaaagtgcattgaaagggaaatacttaaaggaaaaacaacacatatttgataaactaggataattaagaaaagtttgacttgagggaaaaaattgtcaaggatggagagaaaagccaattattaaatagaaacacaactgagaatgcaatccttagccaatcatctgagattcaaaaagtgtatcagcctccttgagcctggaaaagccttgattttctttgtgtgtttcaagtatatttctytgccatatttttgttccctcacaaacatggggggctaaggaaaattataaactacattttgaactgcagggggcattggaagggctggccaactctctgaaagctgagaatcagaaagacagattttcaaaaggaattatgcataagtggtatgtattacaagcacacaattccctttagtgcttctggaaagagccaaagcatgaaggaggaacactggcattgaatgctgctagaacttcaaaaagaaattggccttgctttatgtaattcttattcatctgtaatataaaaacaacc

SEQ ID NO: 179746 - DNA, 601 bp, Human
atggtaatctgggctcttctgccttccctttttcatccatcattctcagtaggaaatcttcaaatccagtggagaataggccaatcctgagtgttcagtgatctgttattttcctcattcaaggaatttaacatgtcctctttgtaaagttaccctgcacttcaccaagcccctcaatgagaagacctcaggtataccagtgcatatcaccatggaaactgagcctccagatggaggaaagctgacttccacagacaaggctatcaggaatccacaactcaaccttgacacccgctgcttgtactgatgctctgaactcatcttggaaaattaataaaaattacaaactcatgagagaaaaatagtggctgggtctggttctatgaagcatctgaagagctgaggtaataaacaactaattgctttgttgtatataaatatgtatcaacaaatttgttcttgaattttctgctttgttgctatgtttttttataattatagattttaaaaattattctttaaagaatgtcaccatagagcagatcctctatcttagaataagaacctttctgagatcaactatgcaggccacttgactggc

SEQ ID NO: 179747 - DNA, 601 bp, Human
ctacctagtgattgatcaatatggatgatactcccttagtattgatatttaaataatatggaattacctacatttagagttgataaggcaagagagggtcaaatgacattacgttttaaaatcattttcagtgggaaaataatgccaaaatgattatcataaacctgctaatctaagtatttccgtaatcgcagaggaatgattctgaatctgtcaacttattgtagggttttgtattgagagaaaaaaaaaagctttgtaacttaattggataattggtttgttattggctgactgattygctggtttttgaatgacctggatggatcacccaattacaccaagaaagtcaatctaaattaaaatatcaatgtcaatgaaaagttcaattaatatgatagcagattatagattcattttgtgtaaaattttgatgcaacagaattataattttataagcataaatactattcataatatagtgggataccttataaaataaatgcatacagtaaatgtaagactgtttattggtgtcacagcacaattttattatttactctagattattataaaattttatagtcgacttgtgttttca

SEQ ID NO: 179748 - DNA, 601 bp, Human
atatgatagcagattatagattcattttgtgtaaaattttgatgcaacagaattataattttataagcataaatactattcataatatagtgggataccttataaaataaatgcatacagtaaatgtaagactgtttattggtgtcacagcacaattttattatttactctagattattataaaattttatagtcgacttgtgttttcatgtcatgttttttattactctgtgatttatagcatgtttggtttcttatatggcaacacaactcctagttattaatagtgtccctgtggagmaatgctgatttatgatgcagagatttcaccaaatttccaggtatatattttagcaacaatcagtgactacctatatcagtgatcacaggtttcccttgccaactctggtctcttgactgtggttacctcaaacactgatgagaaggaaagctggctcagtaggagcaccataatggctgactagcaatgtctgctataggtgtcaggtggggagaattggcaccctgtgcattagtactctcctatatacactaaccaacacacaataagcaaatatgtgtgttggtgattgctttattg

SEQ ID NO: 179749 - DNA, 601 bp, Human
ctgtgcattagtactctcctatatacactaaccaacacacaataagcaaatatgtgtgttggtgattgctttattgactggaattaatttagctttataaagtacctaattctcaccccactcactctagtggagttgtttatccactagaagaaaacaatttcttcttagtcttcaaaatttaaaaggcaggtaaattacactgcatttgatttgaaaattagcttaacccctaaaggagatttattggctaataacactggaagttcatggtgaatcagatttcagggccagtttgatyagtggcccaatgatgtcataaaggacctagtggcttcggttactcttccctgccttctgcactatcagcttcctgctgaacctgttacccatagtgataaagtggctgcagcagttccaggctttataaccacatatcacatgatttgtgaatgagtgagcaaagcctgctctagcattctaacaactaggctgagatttgccctttttggctctcttaggtctaataactgtggctgcagggggtggaggggtggtttgtgcccattcatactcagagtgggcttagcttcccatgaag

SEQ ID NO: 179750 - DNA, 601 bp, Human
ttacagaccccaactagaaataattccaagaaatgagtcaatgggatcatcctcgatcatgtgtacagacttacaggtaggaatggggtctattgcttggataaagcaatggaggaaggatgctgagcttaggaaaataatagccatcttagctgggaaaaaaaaacatattttttttcctcacttaccaattttgtgagtcagtaagccaattgtggatttgcacagagctgaaccatgtattcacagagttaggaagttagctagcccatcctccacaactcttcagagtgcacatggrgccatttacttagtgaaagccctgctataaagaagagccaccagggtttctctcaccagcttatacccaaaattgtctttgaagttcagagccccagcccagaaaattctctcaacacaacacatggcattctcctgcattctattgacacttttctgaatcctgttccaggataagaggcaggaaatgtaaagaatgtaatggtgacatgttcatttgcttatgtggtgcatataattgctgattactttggcacttagatgtatgcgttaacatttagcttgtgaaagatgaataaat

SEQ ID NO: 179751 - DNA, 601 bp, Human
tgcaacgtattgtgagtcatatagcatactagtggaagatccgggatcaaattctaagttgtaattttggaaacaagtcagtatatactttatgtgagctagattggtcaagacacatttcttggcagacagagggttcaaaatggatcgcagatgatggatagtcaaggagagattctttcgggtttctgtttttatgattggtatagacatggaggcttgaaattgcatttcagtcagtgtgaatagcctgaaccaaactacagagatcatcttagaagctgtatgggatgcagagagygtgatgcacagtgaatcaatttggaggacagaatggaggatgatgagatccagacaaaaagattttcatttggtgcaacagtttgctgggcaggaaagtaacaagagcaatattttttttgaaaataagttattctactgtgtgttggaggtgggaagaggcagagagagagacagagaaagagagagagactgaaagagggagagggtgaaagtcaatttgattgtcaagagtcaaaagtaacaaacctgaggcttaccgaaggcattttgtaataaagccttaagttaaggtagtcag

SEQ ID NO: 179752 - DNA, 601 bp, Human
gcaccaccacacccaactagtttttgtatttttagtagagatggggtttcaccatgttggccaggctggtctcgaacttttggcctcaagtgatctgctcacctcggcctcccaaagtgctgggattacaggtgtgagctacctcacccatcccaaattctgttttaatgttggtttagatgtagctttgttaactatgtataataatggaaaccaagaaaaaaacagatacgctgcacttcttataatagagatcagatcaattgctgagtgcctaaagttacaaaatagcttacataayattttatatgatacgcaatagaatatataatgtataatatattatacagatataatttctgtaattaaaattatataatctcaatggtgaaaattaacaattaaaatataacaataaacttgacctgtatcagttatcattaaattgattggggcagtttaggtctttctccaaattttactttggtctccattcattaaatggacattaactagggacttcaaagacccaagaaccacactcagccttggggatagaatgaagactaagagatgatgactgctgtcagcattaatttct

SEQ ID NO: 179753 - DNA, 601 bp, Human
agtttctaacacataatatatgcaactgcctaggtactattcagaaagcaggtcccatgtactggttaactcacagatccacaaggaacgaggtacattttgcttccatttacttttaaccatgatgatgatgtttcatagcttgacaattatagaactataatagctgactgtaaacccaaagtaacttcctcaagtagtattttaaggttgtgaaaatatttgctgggcttttaaaagtgagataatgtttctctaacacagtgacatgtacagatctggattttagtgagatgtgctwctgagtcagttatttaaaatcgatatttaaaaatatacgtttttctccattaatttaataattgatgatttctatgcactaaattgttagggaattacaggctgtttttaaagaaattgctttcatatgtggtcatttcatttgatcattatgaaatgtctggaatattaggggaaaaacaagttataattatcttatcaaacaaaatcctatttttggtaaaattaaatgactaatcggggtcactttttgaagtaaaatcaggtttttgttgttggactatgaaaacacagtcctttt

SEQ ID NO: 179754 - DNA, 601 bp, Human
aggacttttgcactaactgttccaaccacttctcagcatcagtgtcacctactcagaccacccaatttaaagttggccccctctccttcccaagcatctttctattaccctgtttacttttttcccaccaccatcagtgcctcttttaaactgatttgttatttagaatccatcaccccacctggaatgtaaattccgtgaagcaatgagccttcattcactgtggtatcctagaatctggaataggatttagaaaaggggcaccaaccaaacattcattgtaaataggtgaataaggtgmatctactaggcagggcatggtgcctcatccctgtaatcccagcactctgggaggccaaggtgggtggatcacttgagcccaggagttcaggacaagcctgactgacatagtgagacctcatctctacaaaaaatacaaaaatacaggcatggtggtgcacgcctgtagccccactcactttggaggctgaggtgggagagtcacctgagcctggaagttcgaggctgcagtgagctgtgattgcactgctgcatttcagactgggtgacagcaagaccctgtctcaaaaaaaaaaaagaa

SEQ ID NO: 179755 - DNA, 601 bp, Human
gggtgacagcaagaccctgtctcaaaaaaaaaaaagaaagaaagaaagaaactacgaaactgggcattcattatgattaacatcttaacctgtatcatttattgggccttcttactggtaatatgtatctcaaatataataaaaggggacttggccaggcgaggtggctcacacttgtaatcccagcactttgggaggccgaggtgggcagatcatgaggtgaagatattgagaccatcctggccaacatggtgaaaccccgtctctaccaaaaatacaaaaattgctgggagtggtggcrcatgcctgtagtcccagctattttgaaggctgaggcaggagaatcgcttgaacctgggaggtggagttcgaagtgagccgagatcatgccactgccctccagtctggtgatacagcgagactccaccacaaataaataaataaatagataaataaataaatattaaaggagacttacgtgaacatgtcactcagtttaactttccctctagcaaccttcatttattcatgagcttcacaaagatttgatttgtgagcattgaatacagcttatgggcatgatcaattcttactaaaactt

SEQ ID NO: 179756 - DNA, 601 bp, Human
ctttataggcattttacaaatacccttttaaagttcacaacacggaaataaacactggtttccccattacctttcttgtttctctacaggtttctactgcttttctccatgcagcaatcaacccaaagcctttattcataaactccattatccatatctctcctacattcaaaacctgtagcaaataaaaaacaaatctggacttaagaaaatagagactttatttgaaaggacttttgcaataacagggttactgcgataagggaaggggtactattgcaatagggaaaatgcttactcygtgaggtatgaaagcaattcaaaggtcaggcagaaaagagcttttcttttacagaaaggagtaagccaacctggaaggagccaggtatgggggagtggggagagcagatggcttgatcggacagttaaacaggagacatctttctttgtagatgattttcaggagggattattatgactccaatacttgcttaacctaagaagtgagtcaatttcagggtcctgtggtgaagagtgaaacttaattgaagtttggttaagtcaaattaacaagcattttgttctgattggtcagtgggga

SEQ ID NO: 179757 - DNA, 601 bp, Human
taatcgtgtatgagacaaagaatgggaatttggaaggtctgcatctggccttgccctaggtaaacaaggaagtcattcccaaaccttatctaagtcatatggggaagggtggttcttgcagtaagccatttctaataagacaaagagtacagggatttctttcatcattgctgatattaaggagcacaggtctcaggtaaggtttaacatagccacttccaatggctttccagttcatttgaagtaaacccattattttcagtggtctgtaacagaggtccccaaccaatgggccatgtgrcctgttaggaactgggccacacaccagcaggggagccgtgagtgagtgagtgaaacttcatctgtattacagccactccccattctcacattaccacctgagctctgcctcctgttagatcagcagcgggattagattctcataagagtgtgaaccctattatgaattgtgcatgtgagggatctaggctacaggctcctgtaagaatctactgcctgatgatctgtcactgtctcccatcacccccagatgagactgtctagttgcaggaaaacaagctcaaggctttcactgatttct

SEQ ID NO: 179758 - DNA, 601 bp, Human
ctcaggtaaggtttaacatagccacttccaatggctttccagttcatttgaagtaaacccattattttcagtggtctgtaacagaggtccccaaccaatgggccatgtggcctgttaggaactgggccacacaccagcaggggagccgtgagtgagtgagtgaaacttcatctgtattacagccactccccattctcacattaccacctgagctctgcctcctgttagatcagcagcgggattagattctcataagagtgtgaaccctattatgaattgtgcatgtgagggatctaggctrcaggctcctgtaagaatctactgcctgatgatctgtcactgtctcccatcacccccagatgagactgtctagttgcaggaaaacaagctcaaggctttcactgatttctgcattatggtaagctgcgtaattatttcatgatatattacaacgtaataataatagaaataaagtgcacaataaatgtaatgcacttgaatcatcctgaaaccattccccactctccttggtccatgcaaaaattatcttccacaaaactagtccctggtgccaaaagggctggggaccattggtctataa

SEQ ID NO: 179759 - DNA, 601 bp, Human
tgttaggaactgggccacacaccagcaggggagccgtgagtgagtgagtgaaacttcatctgtattacagccactccccattctcacattaccacctgagctctgcctcctgttagatcagcagcgggattagattctcataagagtgtgaaccctattatgaattgtgcatgtgagggatctaggctacaggctcctgtaagaatctactgcctgatgatctgtcactgtctcccatcacccccagatgagactgtctagttgcaggaaaacaagctcaaggctttcactgatttctgcrttatggtaagctgcgtaattatttcatgatatattacaacgtaataataatagaaataaagtgcacaataaatgtaatgcacttgaatcatcctgaaaccattccccactctccttggtccatgcaaaaattatcttccacaaaactagtccctggtgccaaaagggctggggaccattggtctataagacaccatgtgatctgacttccacccactctctgagtcatttccatcccatctcaactgtgctcactggcctccttaggttccattctaggattctatgttcctgctcaaag

SEQ ID NO: 179760 - DNA, 601 bp, Human
actctgtgggacttatcacaatctgacatgttgtatagatttggaattgttttgtcatctttcaccgttcattgaaatgtgagctctagaaagatatagactgtctctttgatttactgctatacttttatctttatcacctataactgtttgttagattatcgaagaagcaaacaaatgattacataaatgaacaaatgaatgaatagaagtaattatattgtctcaaattgagaaacttcgtacaaagattcttcgaccgtgcctaagaagttatttctcttgggagatcaggataaaygaggaacaaaatgagggacactaaaataggaagccataaaaccctgttgtcaatttccagcactagaaattaccaaagaaatgcataacttattaaaatttaaatgaagtcactagcaagattgataaatgttcctggcgttctaccaaaaaatgtctgttgcatcacactggaatggacctaacctatgaagaatcgtggtgcgtctataggctaaagatgaaaatgtcaaggatatctctaaatactgttcgttggaaaatccaaaaggaggaaatagtaattaattatattaggata

SEQ ID NO: 179761 - DNA, 601 bp, Human
atgttgtatagatttggaattgttttgtcatctttcaccgttcattgaaatgtgagctctagaaagatatagactgtctctttgatttactgctatacttttatctttatcacctataactgtttgttagattatcgaagaagcaaacaaatgattacataaatgaacaaatgaatgaatagaagtaattatattgtctcaaattgagaaacttcgtacaaagattcttcgaccgtgcctaagaagttatttctcttgggagatcaggataaacgaggaacaaaatgagggacactaaaayaggaagccataaaaccctgttgtcaatttccagcactagaaattaccaaagaaatgcataacttattaaaatttaaatgaagtcactagcaagattgataaatgttcctggcgttctaccaaaaaatgtctgttgcatcacactggaatggacctaacctatgaagaatcgtggtgcgtctataggctaaagatgaaaatgtcaaggatatctctaaatactgttcgttggaaaatccaaaaggaggaaatagtaattaattatattaggataaatatatgatttgtcttcgaaatctaa

SEQ ID NO: 179762 - DNA, 601 bp, Human
ctcccaggttcaagggattctcctgcctcaacctcccgagtagctgggattacaggctcacaccaccatgatcaggtaattttttgtattttttgtagagatggggtttcaccactttggccaggctagctcaaaaatcctgacctcaggtgaaccacccgcctcagcctcccaaaattctgggattacggcatgagccaccacactcagcctgaagtagcgtttttaaaagtcaaaataaatcctcaaagttcaacttaagcatggcattaggctgatatcttcttgtagcagtgagtakttataaaacgatttttataaaatggtgatgcttctgattttttgtgaggaaagctttttaaaaatataatcacacattttaaaatgcaccagaaaaactaggtattggagggaaccatttctgaattgtttgtgaattgactaatcaccctgggtttgttttgttttgctgcaacttcaataataattattaaaacctaagtcaaattatgatttttcctgagtaggatttattttatgacttgatgtttctgtttgcctacatggagcttttcagctgcaaaataccccttgagataac

SEQ ID NO: 179763 - DNA, 601 bp, Human
tttatttttatttctgtaaacacatcttttattaaaaacaaagagattttctgtgtatgtcatacatactttaaatagaagtgtctcagagcttataaatctccaaatttaaccaaagaagaaaaagaagttgttatataatgtgatatttttttaaaaaaaaacctagacaaagattaaatactaccccaaacaacacccactgtatgtatatgggggatggagggttgtcattctgatcccttgttggtagaaatgaaaattagcacaacctttataaagagtgatttgtcaatattaktatctgtcagaaaaccaaacgcatttaccctttgacccagtaatcacacttctaggaaatattcttcacatgtactcaaggtacaaaataagcttgtacaaggttattgattctagtattttttaacagcaaaagtttaggaaaacttaaacatccatcaacgtgagactattcaaatatggaacaactgaaaaagcttcttttatattgacatagtgtgatttactgttaagcttcacaaaaggtaagatacgtaacaatccctataatatactatttttaaaaaacaacagtcctgta

SEQ ID NO: 179764 - DNA, 601 bp, Human
aggaaatattcttcacatgtactcaaggtacaaaataagcttgtacaaggttattgattctagtattttttaacagcaaaagtttaggaaaacttaaacatccatcaacgtgagactattcaaatatggaacaactgaaaaagcttcttttatattgacatagtgtgatttactgttaagcttcacaaaaggtaagatacgtaacaatccctataatatactatttttaaaaaacaacagtcctgtagtcccagctactcaggaggctgaggcaggagaatggcgtgaacccgggaggcasagcttgcagtgagccaaggtcacgccactgagcactccagcctgggcgacagagcgagactccgtctaaaaaaaacaaagagcaaaaaaacaacagtcggggctcagtttgttcatagggctgattgatatggtaatagtaaaagaaacgtttttctgtgtatcctttggactctttagaattttgagtcatgtgattgttttatgttttcaaagtcaataaagttaaaattataagaaagatagcctaagtaataaatgtgtggaaatgaatagagaattttttaatggacctaagtat

SEQ ID NO: 179765 - DNA, 601 bp, Human
tagaaaaatatttgcaaaagacaaaaacaggaaatttacaggaagaaggtcaataaatactgtatattttaaatatttaactttaataaaatcaaagaataaaaataaaaaatctaatatcagattattggagatggataaattaagcattgttcaagaatgggaagaaatggatactttaatgtgttgtgttgggggctatataatggtacagtctttttgtagggaaatgacactgcacatcaagaattaaaatgtgcatgaattttgctggaacaatttcacacctacgattttacaycaagatgaaaaatgatcaagtgaatacaaatgttcatgagtagggatgttcattgcagcattgtttacatagtgaaaaaccaaaaccaagcctccgtgtgtaatactgaagggttgataaaatgaagcaaagtaaaaggaaattccctgaagttattaaaagggagatgaattagatatattcattaactgagaaagacatccatgtcatcgttaggaaaaactagtttcaaatctgagtagtatccatggggaaatctttgcccgttttatgtgaaataagtaattcaaatctacaaga

SEQ ID NO: 179766 - DNA, 601 bp, Human
ggaatgagtagaggatggaaccagggcacaataggcagcttttagaaacagtaggttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccagtgcagtccgcagtccggcctgggcgacagagcgagactccgtctcaaaaaaaaaaaaaaaaaaaaaaaagaaacagtaggttaggtgcacatgtaagaacagggatagtgctgagaaaaaaaaaaatcagaaagatatctgtaaaacaacaaaatttatgtaagtttaaaagtgcatacaacaactatagacatttaaagatatacattaaatccattgaatgttcaccagcttggggtggggaagagagtaatgagagtgggaaatacaatggcatacacataggtacgtatttataaa

SEQ ID NO: 179767 - DNA, 601 bp, Human
gaatgagtagaggatggaaccagggcacaataggcagcttttagaaacagtaggttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccacagcagtccgcagtccggcctgggcgacagagcgagactccgtctcaaaaaaaaaaaaaaaaaaaaaaaagaaacagtaggttaggtgcacatgtaagaacagggatagtgctgagaaaaaaaaaaatcagaaagatatctgtaaaacaacaaaatttatgtaagtttaaaagtgcatacaacaactatagacatttaaagatatacattaaatccattgaatgttcaccagcttggggtggggaagagagtaatgagagtgggaaatacaatggcatacacataggtacgtatttataaag

SEQ ID NO: 179768 - DNA, 601 bp, Human
aatgagtagaggatggaaccagggcacaataggcagcttttagaaacagtaggttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactccagtccgcagtccggcctgggcgacagagcgagactccgtctcaaaaaaaaaaaaaaaaaaaaaaaagaaacagtaggttaggtgcacatgtaagaacagggatagtgctgagaaaaaaaaaaatcagaaagatatctgtaaaacaacaaaatttatgtaagtttaaaagtgcatacaacaactatagacatttaaagatatacattaaatccattgaatgttcaccagcttggggtggggaagagagtaatgagagtgggaaatacaatggcatacacataggtacgtatttataaaga

SEQ ID NO: 179769 - DNA, 601 bp, Human
aaaaaaaaaaagaaacagtaggttaggtgcacatgtaagaacagggatagtgctgagaaaaaaaaaaatcagaaagatatctgtaaaacaacaaaatttatgtaagtttaaaagtgcatacaacaactatagacatttaaagatatacattaaatccattgaatgttcaccagcttggggtggggaagagagtaatgagagtgggaaatacaatggcatacacataggtacgtatttataaagagggatattgcatgggctaatgatgatagtaggccatgaaagttatataattaactcyttgttcctggaaaataaaaaatggaaggaaggaattaaggtgggatggaagaaaggaagaaatgcagtgtgggagggaaggaggttttaggaaaggagaaagaaaggaaaaaaggaaggagcatgttgcaaagaagtataaagttgcaaagaagcacagataggtatgattccatttatataaaattttgtgtatatatctgtgaaaagggtttgtgtatacgtgtgtgcatgtgtgtacataaaagagatgtcttaaagaatactcattaaaatgagcattttaatgctcacctatgtc

SEQ ID NO: 179770 - DNA, 601 bp, Human
acacaccataaaagggcaaaacaaagctattgttctattatattgtcttaattataatagaaataaacttgaatgtcactgaaaatcataagctcccttacacacataagcctccaaacacatgcacacacacacgtgcacacacacacacacacacacacactcactcactgacctccaaaatattttattcatggcaaagaagaaatggtttttctgtctgacttatcacaggcatttcatgcagagtcaaagaaatgtgacatatttttctgaggataaagtacaaaaatggttgtcrctttggggattaaaagcaaatatgtcacctttgtaaaagtaattctcaatgaattagaaaaacagaacatttctgtttcttttcagatactcatccttaagctgagcttgccctgtgctcagctgggtagcctatctgtgagatcaccatgtactcagaccaaataggaagacttattttcttgggggcattatctcacaattcgaaatagaagatttcaaggaagaggaccttaaaatattttcccaaatcattttgaattagtataattccctttttttcgaaaagccctctggttaa

SEQ ID NO: 179771 - DNA, 601 bp, Human
cactgaaaatcataagctcccttacacacataagcctccaaacacatgcacacacacacgtgcacacacacacacacacacacacactcactcactgacctccaaaatattttattcatggcaaagaagaaatggtttttctgtctgacttatcacaggcatttcatgcagagtcaaagaaatgtgacatatttttctgaggataaagtacaaaaatggttgtcgctttggggattaaaagcaaatatgtcacctttgtaaaagtaattctcaatgaattagaaaaacagaacatttctgyttcttttcagatactcatccttaagctgagcttgccctgtgctcagctgggtagcctatctgtgagatcaccatgtactcagaccaaataggaagacttattttcttgggggcattatctcacaattcgaaatagaagatttcaaggaagaggaccttaaaatattttcccaaatcattttgaattagtataattccctttttttcgaaaagccctctggttaagagtaagagtgttagaggaataactcaggaaggaccagaagccaatgatctcttagaagtggtcaagccagcaagt

SEQ ID NO: 179772 - DNA, 601 bp, Human
tgagatcttcttccttaggctaatttaggaccagtcttgtacttccctttcttgatacttgatccctttattttcttctggtattgtctgacatcctcggtagacagagtttatgagggtaaaaactgtatctgaacagttcaagcacagtcccagaacaataattcagatgtagtagtcactcaattaaaatgtattgaaaaaaatacatgttgaatggatatctacctaagatccctggcaaaagattactggctaacatgacctcaaccacccctgcaaagaggttttcattgaaaartccacatttgcttgtttaggtcatcactaaatcactaacaaccccttctaaactttagactctttcacttttatcaacagggagttaaaatattaaaaatatcatcctccttgtcaccgttaataaataccatccacttgttccacactggaaactacatgtagttcctatctctccatttttcttctctcattttaattggggtgctacagagatgtgtagacttaaatttcaactccataaataaaaattgagcaatatgccttcatggagactattttctacaaatcttttcattgt

SEQ ID NO: 179773 - DNA, 601 bp, Human
ttcctttctggtttggaagaagggaagttcaagttgtgagggctggcagggaaataccaccagcaaggtgagcctccctggactgtaccaggagtgcagaagcctgtccaggctggttgctgctcttacctcctcagctgagcaactgagctccttggtagctggagagaggaagcagagaaaggtgcttctctgtactctagtactacaagtctataagtccaacaataccaggattccaaactccttgattcttcaatggtttaaggccatctattgacaaagcaactattggtggactttttttttttttttttttttttgagacagaggctcactctgtcgcccaggctggagtgcagtggcgcaatctctgctcactgcaacctcagcctcctgagtagctgggattacaggtgcatgccggctaatttttgtattttcagtagagacggggtttcgccaggttggtcaggctggtctcaaactcctgacctcgtgatctgccagccttggcctcccagagtgctgggattacaggcgtgagctaccatgcctggctgagttttggtggatgtttttagcagtaaaagcaaagaat

SEQ ID NO: 179774 - DNA, 601 bp, Human
tgcaaagtgaaaatgtggatccccttgtttcaaaaattattaagaagttcaagacagcaacagcagggcatgaaaccaagctcagcgtcctccgatgtgcaagccccatgcaactgcacaggtctcacatccataaagccagccagatcagaaacctcaacttagaaaaagagggagataaagaaacagcacttgatgcagtggctcacgcctgtaatcccaacactttgtgaggccgaggcaggtggatcacaaggtcaggagattgagaccagcctggccaatatggtaaaaccctgtmtccactaaaaatacaaaaattagccagtcatggtagcaggtgcctgtagtcccagctatccagaaggttgaggcaggagaatagcttgaacctgggaggtggaggttgcagtgagccgagatcgtgccactgcactccagcctgagtgacagagtgagactccgtctcagaaaaaaaaaaaaaaaaaaaaagagcaaaataaagaaacagcacttgattctctacactgatcttcaacagatgtctggtttcctttacctctgttccaactgtgatatactctcataataaatctgcatc

SEQ ID NO: 179775 - DNA, 601 bp, Human
agaaaaagagggagataaagaaacagcacttgatgcagtggctcacgcctgtaatcccaacactttgtgaggccgaggcaggtggatcacaaggtcaggagattgagaccagcctggccaatatggtaaaaccctgtctccactaaaaatacaaaaattagccagtcatggtagcaggtgcctgtagtcccagctatccagaaggttgaggcaggagaatagcttgaacctgggaggtggaggttgcagtgagccgagatcgtgccactgcactccagcctgagtgacagagtgagactcygtctcagaaaaaaaaaaaaaaaaaaaaagagcaaaataaagaaacagcacttgattctctacactgatcttcaacagatgtctggtttcctttacctctgttccaactgtgatatactctcataataaatctgcatcttgaatttaaagttctactttcctaacagtctgaatttgcttaagttgctgaataatatgttgaagttgtattcatatggttagtgaaagaaaagtaggttgctggtttgtaagccaaggggacaaaagtgctttctgttgatgaaccgagaaaccaatggat

SEQ ID NO: 179776 - DNA, 601 bp, Human
agggagataaagaaacagcacttgatgcagtggctcacgcctgtaatcccaacactttgtgaggccgaggcaggtggatcacaaggtcaggagattgagaccagcctggccaatatggtaaaaccctgtctccactaaaaatacaaaaattagccagtcatggtagcaggtgcctgtagtcccagctatccagaaggttgaggcaggagaatagcttgaacctgggaggtggaggttgcagtgagccgagatcgtgccactgcactccagcctgagtgacagagtgagactccgtctcagaaaaaaaaaaaaaaaaaaaaagagcaaaataaagaaacagcacttgattctctacactgatcttcaacagatgtctggtttcctttacctctgttccaactgtgatatactctcataataaatctgcatcttgaatttaaagttctactttcctaacagtctgaatttgcttaagttgctgaataatatgttgaagttgtattcatatggttagtgaaagaaaagtaggttgctggtttgtaagccaaggggacaaaagtgctttctgttgatgaaccgagaaaccaatggatataaggat

SEQ ID NO: 179777 - DNA, 601 bp, Human
gtcccagctatccagaaggttgaggcaggagaatagcttgaacctgggaggtggaggttgcagtgagccgagatcgtgccactgcactccagcctgagtgacagagtgagactccgtctcagaaaaaaaaaaaaaaaaaaaaagagcaaaataaagaaacagcacttgattctctacactgatcttcaacagatgtctggtttcctttacctctgttccaactgtgatatactctcataataaatctgcatcttgaatttaaagttctactttcctaacagtctgaatttgcttaagttgytgaataatatgttgaagttgtattcatatggttagtgaaagaaaagtaggttgctggtttgtaagccaaggggacaaaagtgctttctgttgatgaaccgagaaaccaatggatataaggatattataattctctgcaaggatattataattctctgcagaataagaaattgaagggtacagtagggaaggaagatgaatgccttgccagtagagcttatattcaggatataaatccaccgagtagcagaaaatattagttccttatctttgtatgctaaatccagcatagagatatggt

SEQ ID NO: 179778 - DNA, 601 bp, Human
ttcacgactctgccttggagaaagacaggtagacatatgtcaagaagaattgcccacatggctccagtagacaagcagaaaacttggaaataccaaaggtggatgccgattacctaacataggtgaagaagggaagccaaccctgtcactgaacatttgtcagtgcttattttgaaatactattttcagaatatactgccatgggccaaaatgagttgaagcctagagaaaatacagccctctgtgtcctgtgcatttatcttctcccagtcctctcgcttgcagaatgttcagaagaagracttacactgatacaaagcagacgagagccctgttccttactgctttgtttttatataactaatacaaaaagatattatcataaaagtttataaagcatctgttctccagaatttctgttgaggaatttaaattcttgcacccatctataagttacatggactccttatcagcctcctctccctcaacatcaccaccatcatcatcattaacagcatttgttcattgcccctgtattactaaatggagcaatacaggttaaaaaattttccaatcattagaaattttaattgaggacatt

SEQ ID NO: 179779 - DNA, 601 bp, Human
aaaggtgcttactgggtgatgtcaacttctgattctcaacaagggaatgtcacttactcatcagtgatatccagcccacactggcttgggtttgtgcagccaatcagatcaacattttcccatcagcgtgacatcaagcgtatgaacacctttcccatgagccaggtaccaaccattactagtatttgttatagaaggaaaaactgaagtccaagaataacatttcactggccagcatgccctctgcttctaccaagacttcagctagtcctaaatgcaagagcatggagatcacatactctactgatcttgaaacaaaaatcaattatcatcaaatgaaaataaaagtaaacgtaattagtaccttgttttcccccacaaagcttatattttatttctcttactccattagacatcggggccttcttatttattaacagtagtgaatccctgctctaccaaatatatgtataaagttctctgggagaaaacggaatgagtagctgtttttagggcagccatagtatgagttttggaactacataattcagataaaataaaatgttgacatggtttttcatttaaacactgcaactatcag

SEQ ID NO: 179780 - DNA, 601 bp, Human
taaatgcaagagcatggagatcacatactctactgatcttgaaacaaaaatcaattatcatcaaatgaaaataaaagtaaacgtaattagtaccttgttttcccccacaaagcttatattttatttctcttactccattagacatcggggccttcttatttattaacagtagtgaatccctgctctaccaaatatatgtataaagttctctgggagaaaacggaatgagtagctgtttttagggcagccatagtatgagttttggaactacataattcagataaaataaaatgttgacatkgtttttcatttaaacactgcaactatcagagtcactatgggtactggatttattaaaacctcaaatgtttaaaaactgttggcatgattgtatgcatattttgatagagttacatgtagaagcatgttaataaaatatcagaaccaattataatagaaaccacatttaattaaaatttcctaatacaaccatattcactacattatttttacctttggtgtcattaattccctcctgactcatcccacttactaatttagaagacttaataataagaacatcactgttttctgtttcata

SEQ ID NO: 179781 - DNA, 601 bp, Human
aatggatgtgagtctctctgctttccagcctgcctggtcaccttcctgcctggagacagtggtggctacatgtgcatgttttatatatctgaatattagcagtcatttgtcccaatcccacaagtgctgacaagggtcattgttggagtcatcggcacccctgcaccctctcactttgttacgctgatgttagaaatgtcacatatggaaggaagcagagcatcagacccagacgtgggcactactggagaagcagattggggcatttactaacatatagggccttcaggcatttaactcratgaagctgagcacgatgggtgacacaatgtgtttccaattccggatgaagtattcatatatacttggaccataaatttaaaacgcgagttgtctagccattccagaaaagtcacaaagcagtgtttgtatcagttgaaagaagaactatgcagttactgatagagaagatctccccgcatccagaagatcagggaaggactatagaatagcactcgtgggaatttatctggacgttgaaagatatgtagggtgaactactataaaaaacaacatcatactcacatctttgtcactcatc

SEQ ID NO: 179782 - DNA, 601 bp, Human
tgcctggtcaccttcctgcctggagacagtggtggctacatgtgcatgttttatatatctgaatattagcagtcatttgtcccaatcccacaagtgctgacaagggtcattgttggagtcatcggcacccctgcaccctctcactttgttacgctgatgttagaaatgtcacatatggaaggaagcagagcatcagacccagacgtgggcactactggagaagcagattggggcatttactaacatatagggccttcaggcatttaactcgatgaagctgagcacgatgggtgacacaatstgtttccaattccggatgaagtattcatatatacttggaccataaatttaaaacgcgagttgtctagccattccagaaaagtcacaaagcagtgtttgtatcagttgaaagaagaactatgcagttactgatagagaagatctccccgcatccagaagatcagggaaggactatagaatagcactcgtgggaatttatctggacgttgaaagatatgtagggtgaactactataaaaaacaacatcatactcacatctttgtcactcatctatttattccaaaaactcaaaaattcagtg

SEQ ID NO: 179783 - DNA, 601 bp, Human
gtttgtatcagttgaaagaagaactatgcagttactgatagagaagatctccccgcatccagaagatcagggaaggactatagaatagcactcgtgggaatttatctggacgttgaaagatatgtagggtgaactactataaaaaacaacatcatactcacatctttgtcactcatctatttattccaaaaactcaaaaattcagtgaacactgtattagcttcctaagactgccataacaaagtaccataacctgggtggcttagaaaaccagaaatttattatcctgcagttttgaagrctagaaggctgaaatcaagatgttagcagggttggttgctcctgagggccgtgagggagaatctgtccccggtctccctcctagcttctagaagcctcaggtattccttggcttgtgtatcagggatccccagtcccacaggggcatagaccggtaccggtccatggcctgttaggaaccgctcacaacaggagatgagtggccagcgggtaagtgagcattaccacctgagctccgcctcttgtcagatcagcggggacattagattctcttaggagcgcaaaccctattgtgaactgc

SEQ ID NO: 179784 - DNA, 601 bp, Human
attaccacctgagctccgcctcttgtcagatcagcggggacattagattctcttaggagcgcaaaccctattgtgaactgcgcatgggagggatgtaggttgcacactccttatgagaatctaatacctgatgatctaaggtggaaccgtttcatcccaaaaccagctcccaccacccctcacctccagtccttggaaaaattatcttccaggaaaccggtttctcatgccaaaaaggttggggactgcagttgtagatgaattctccctgtgtcttcacatcatcttctctctgtacgcrtctgtctctgtgtcaaaatgtcccctttttataaagactcctgttgtatggcattagggcccatcctagtgacctcgttttaatttgattccctctataaataccttgtctcctaataaagtcatgttctcaggttctgattacaaggtgtctttttttgcttgtcacaattctacctataacaaacacctactagtagccaggcactatatgagccactcacaaatggcacagtttctgccctcatggtgcttagtaatctagcaaatataataatcattaagaaaaaaaatttaaaga

SEQ ID NO: 179785 - DNA, 601 bp, Human
agacaactcttcagcatggtctgtctggctgcctctctcttcctccccgggctcctccgatctgcagcatggggttcaggtggcatcccccctgcacatatgcccatgcaacccagaggcggaggacattaacacccatggtgccattcttaaccgatgggagtgaaaacggatacatcatgcttcctctttttgtgccctgggtggacagttctgagacaccattcagaaggctctcagaaggtccctgcagaatcaagcaccaggtatttatagtggtggacagctcagtaatgcatcrttgtatcgtctttctctccttttctattttactctcctgtcctgtatttctccccagaattcccatctcaaaagactcgcacaaaagccttggcctcaggttccacttttaagggactaagatcattggcatcagattttattatcccagatcagagatgaaaacaactgactcatcagtgtctttttcaaagccaagaagctgtaggcatacccagaattagcacccaagtctcttagcactcaagtctcttggcttcctgaagaacatcttccccataaaggaggtcatccagcctaa

SEQ ID NO: 179786 - DNA, 601 bp, Human
aagagcaacttcacttattcttctcccttatacaaacaagttttcagagaagtccctctgatgaagtatatcgtactatgctcacgaacagctgtctctatgtgtgagaaagaatatttagaaacaggtagctatttactctagcaatgctactgtgtgctagtgagtcatggatgcaacaatgctggttttgattttgtctgtggaataaaatccaaaacttggtgttatcaaaagctttgcaggcctctcaaccaggtcttatgtattttctggcttgaagagatgggagtcagacctytatctcaggattcctcaacctcaacagaaggatcagattattcttcattgtggggggctgccctgtgcattgcagaatgtttagcaacaccctggcctctacccactggaagccagtagcacctactcaatcgtaacaatcaaaaatgtcttcagataatgccaaaatgtagctaggggtggagacaataaaatcgtctgtgattcagaactactgttttatattaagaacatcatgcttggaaggattttgttttaaggcctgtggctgagtgtaggatatgccaagaacatactgagt

SEQ ID NO: 179787 - DNA, 601 bp, Human
cctctgttcttctaagagcatgtggctctgccagaggcaggagctataagaagggagacagaaatgcaaagaggtcatgatcttttaaaggaaatatatctcactattttttctccatttgaaaatcatgttttatttcaacctattcgatttatattttcaagtcaataataatgtataaaacatctaaaagggcttggaatgcattttataaatagtctgggaattgaagactgaaagccctaagttttctgaattcactattttaatatctctaagttccagtatctagcttgttaargataaggtgaagtttattcacgtttataatatatttaatttttgcatccaaactatcaaaaggaagttcacaatgcttttaattctgatgcttttgtgaggagcaggtacctttctgatttctgctactgtgtaggtatctagaaatcagttatcttatgatcttatgatgtgtttatttgtttatgaagatatagccatcagcattgattgtgtggcttcactactgaccttgcctaggggaatttggacatcaaactttggatttaaaaattatttctgtggaggttaattagctttt

SEQ ID NO: 179788 - DNA, 601 bp, Human
agggaactgggcagggcgtggtgtctcacgcctgtaatcccagcactttaggaggccgaggcgggcggatcacgagatcaggagacttgagaccatcctggctaacatggtgaaaccccgtctctactaaaaatacaaaaaattagccgggcatggtggcgggtgcctgtagtcccagctactcgggaggctgaggcaggagaatggcgtgaacctgggaggtggagcttacagtgagccaagattgtgtcactgcactctggtctgggggcagagtgagactcaatctcaaaaaaaaaaraaaagaaaaagaaaagaaaagaagggaactgaagctgttttccaattaagaagatttctgaaggtctcacagaggggagcttctgaagccagaaacttaatcgggacttacctacctcctgtgcagtgctggtgctgagtgactcgcttagctgaaacccctaaattagagctccatgctttgttttgttctgtgtcctggttgtttctctgagctccttgtgcatccagagacagcagatcaaaggcatcccttttgctgcatcctccatagctctgagacaggcctgaagaacctgaa

SEQ ID NO: 179789 - DNA, 601 bp, Human
gatctcctgactttgtgatccgcccgcctcggcctcccaaagtgctgggattacaggcgtgagccaccgcgcccggcccgtttattttaaatatcacatcctcgtaataaaaatttccctcaatgttctttgaggcatccacttaaataactcaaaaatgttttttgcattctttaagaggtttttataagccagacaaccttaataaccatggcctcaatcacagacagtaaaaatatgctttgcatttctcttctaaccctaatacctaagccagctcctggtaaaatgttatccgaayctttttactcaattcatgacaggtttttgggatatattctactttccaggcactgagttaaattctggagaccagaagaccaagacgttgtccctacactgacattttatctaatagtcctgttttcagattccttgccctaagctcttcctattttttgatttctctcctccagttctcattccatatcagagggctcctgtggatgctccatgctctacgggattgcactcttccacctgcctcccatctctccatgtaaagaggcacccaaaggagcttccactctattgactctct

SEQ ID NO: 179790 - DNA, 601 bp, Human
ggggtggtgtgaggcagctttcttgccaactaatcttatttaaaacctatctatcttatttgatatatcttattaggtatatcaaataagatatatcaaatataatcaaatgttgtatctgtcaggcctctgagcccaagctaagccatcatatcccctgtgacctgcacgtatacatccagatggcctgaagtaactgaagaatcacaaaagaagtgaaaatggctggtccatgccttagctgatgacattaccttgtgaaattccttctcctggctcatcctggctcaaaaggtccccsactgagcaccttgtgacccctgtccctgcctgccagcgaacaaccccctttgactgtaattttccactatccacccaaatcttataaaacggccccacccctatctcccttcgctgactcttttcggactcagtccgcctgcacccaggtgattaaaaagctttattgctcacacaaagcctgtttggtggtctcttcacacggacgagagtgaaaatatcaaacctatcttattagatacatcaatttgatatctaataatatatcaaacctctcttatttgatatatcagtatcacag

SEQ ID NO: 179791 - DNA, 601 bp, Human
aaaaatatgaaaagggtgttaatttgttgatcgttctttgctgcttctcactttcatgtttacagcaaggagaagagcaattgtttctaccagtagctttagtattttgagttctcatgtgtgtaataactatcttggtaggcccagaacacacaatctcatccaattttgaaatttggattttatgccagatggattatttcagtacggattacaaatgcttatactattctgcctagcagagtttgggtcataaaaatcattaaatgtaaaacattgcacaaagttgcccaaattgtcrtgtctctggccaaatttgtggaaataaaaggagccatgcatttgggttatttctacagtttggaaactttgactcttatcttctcttaagctactcaggaaatttccagactctaaaatctgagaggaattgttcagacagacaaaggtggtccagaatggagactttcctgatgccaaggatggcaggacccgtgagtgtccacttcacccctgtgatcctacctctcgtgaggctttactgatgaccttggcttcctctttgatgaaacttttggtggctgagcctcttgaaactgac

SEQ ID NO: 179792 - DNA, 601 bp, Human
agatgaaaaagttttctaagtttccagggatgcctcctctgggagtgagatgccacctggctcccagctcctctcaaccagtaggtccctggaccaggaagaggcagacccccagaagaactcccttggctcatccatcctcaagaattttatttttataacttataacttatgtacacgaatttctatttttttaacttctattttaagttcaggggtacaagtgcaggttgattacataggtaaacttgtgtcatgggggtttgttgtacagattatttcatcacccaggtggtaagcytagtacccattagttattcttcttgatcttctcccttctaccaccctctgtccagtgaaaggtcccagtgtgtgttattcctcaagaattttatgacaccgtttaaatttcccaattctaacactggccaaatttgatattagcctgaaattcatttcatagcttccatattttgaggtaattatattaattttcacttgatttatgttttcctttgaatcactgatacatttagattgctcaaaataaaacaaaatattatttcttttatatatatatttttttctgagatggagtctc

SEQ ID NO: 179793 - DNA, 601 bp, Human
tacataggtaaacttgtgtcatgggggtttgttgtacagattatttcatcacccaggtggtaagcctagtacccattagttattcttcttgatcttctcccttctaccaccctctgtccagtgaaaggtcccagtgtgtgttattcctcaagaattttatgacaccgtttaaatttcccaattctaacactggccaaatttgatattagcctgaaattcatttcatagcttccatattttgaggtaattatattaattttcacttgatttatgttttcctttgaatcactgatacatttagattgctcaaaataaaacaaaatattatttcttttatatatatatttttttctgagatggagtctcactctatcacccacgctagagtgcagtggctccatctcagctcactgcaacatttgcctcccgggttcaagtgattctcctacctcagcctccagagtagctaggactacaggtgcatgctaccacgcccagctaattttgtatttttagtacagacggagtttcactatgttggccaggctagtctcgaactcctaacctcaggtgatccacctgcctaggcctcccaaagtgc

SEQ ID NO: 179794 - DNA, 601 bp, Human
catgaaatctatgttcttgttggggagatggaaaattaacatggtaggttctgaaccatgctatgaagagcaatgagatgtagagtatggggaaagaaaacaggcagtctagagtttttgagtgtgctctgacttggataggcagggaggtctctttgagaaagtaacattaggttggagagcaggcaatttaaggagtgtgcaagttggaggtccctgcatgccaggccaagaaagcaaagtacaaaatgcactgaggcaggttctctgatgtgtgagaagaatcccaagaaggcaaaasagatgagagcaaaatggtggggaattagtaggaaacagaatgcagaggtcattagagctatgtcaaagaggcaatggtgacaagaatgttgagttcaattctgagtaagaaaggaagacaataaagaactttgataaaaggaggctgggctcagtggctcatgcctgtaatccaagaaatttgggaggcccaggggggtggatctcttgagcccaagagttcaagactagtttgggcaacatggtgaaaccctatccctgcaaaaacaaaaaaattagccaggcatggtgtcacgtggct

SEQ ID NO: 179795 - DNA, 601 bp, Human
atgtagagtatggggaaagaaaacaggcagtctagagtttttgagtgtgctctgacttggataggcagggaggtctctttgagaaagtaacattaggttggagagcaggcaatttaaggagtgtgcaagttggaggtccctgcatgccaggccaagaaagcaaagtacaaaatgcactgaggcaggttctctgatgtgtgagaagaatcccaagaaggcaaaagagatgagagcaaaatggtggggaattagtaggaaacagaatgcagaggtcattagagctatgtcaaagaggcaatgrtgacaagaatgttgagttcaattctgagtaagaaaggaagacaataaagaactttgataaaaggaggctgggctcagtggctcatgcctgtaatccaagaaatttgggaggcccaggggggtggatctcttgagcccaagagttcaagactagtttgggcaacatggtgaaaccctatccctgcaaaaacaaaaaaattagccaggcatggtgtcacgtggctatagtcccaactacccaggaggctgaggtgggaggatcactggagtcgaggctgcagtgagctgtgattgtgccact

SEQ ID NO: 179796 - DNA, 601 bp, Human
aattacaacggtcgttcaaagagttcatggaaagtgcttattatgagaaagaattacgcaaggatttcaattgtttgcaccaaaataaactcacattaacttattataacaaatatgaacacaatctagtttgagtcactaagaaggagaagacatctgtttgaaaagagctcctatatgagtaacataaattctgctaaaattgaaggaagaacaaacatcaaatttatgatggagcttaggtggaagaatgatgaaaatcactgatgctttacaagaagtttatgggacaatgccccaragaaataagcagtttacaaatggataactcattttaagatggtatgagatgatgttgaagatgaagcctctagcggtagagcatccacatcaatttgtaaggaaaaaattcatctggttcgtgttctaattgatggtgatcaacaattaacagcagaaacaatagccaacaccacagacatctcaatttgttcagcttacacatttccgatttaaaaattaaaatggagcaaattttccagttgatgggtgccaaaactgttgtgcccagatcagctatagacaagaatagagctctcaa

SEQ ID NO: 179797 - DNA, 601 bp, Human
agctttctgaaggaattcgactaaagtcaatgataaaaatatgaaagtgaaattaagcacgactgagtgtcaaattcccacgttaaatgacctccaagaaaaggaagaaactccaattaagataacaaaataaaacatacgctaagaaaagattacatgctcccacaaagcaaggatgtgagaagcggcacttagggctcctgtagccccttaattcaggctctattatgcccacgaattagaggacatatgctcttctatcaaattgttccacaccactggggaaagtatttatttcatyactgtgagctaagtatctttaaatcattgctgtgcaaatgcagcctccaaagaaaatttaatgtattctttaaaaagaagtcaacagtatcataaaacgtctctcccatatttagttgtagaatccgtttggcttccctctttaagactcccagttcttgcatattttaacacttctataaagctgtaaataggggtattgcaggctattttcactcaatgctttagaattcactaatgaagatgagagtgaggatttccaaatataggaacagccctcagtggatgaagaaatgaatcc

SEQ ID NO: 179798 - DNA, 601 bp, Human
agatagacataaacagtaaattacaaatcttctatgatcaaatttcctaaaattaactgctacgaacattttattcaatatatttctaaacttttttaagacatagaatcttgattttagtttcttaaatctcaattcaatctctttgctttgccttcttatgtggttgtagcgtaggaaagaacacaatggcaaatagcagaatagatttgtgggaaatggataggaaattaataatatttttgttttctgattctccatataatttgtatataatgtatgttacagcacgtattttcakttttcaaatctttcaactaccacctaatcttagtttacaatggctaaaaaagaaaataaaagtattagtttgggagttttttttttttttttacttttatttatttacttttttttgagacagagtctctctcagtcacccaggctggagtgcagtggcacgatctcagctcactgcaagctctgcctcccgggttcacaccattctcctgcctcacccacctgagtagctgggactacaggcgcccaccaccacacctggctaattttttgtatttttagtagagatggggtttcatcg

SEQ ID NO: 179799 - DNA, 601 bp, Human
cttttttaaattttttagtttttatgataataccctccaaccaggctgttgtttagaagaaagtgaccacaaatctgctgtgagtcatctctgccttgatcaatgtccttcttctaattagagcatccattatcagtgaggaccacagggaaggcagcatatctcagggtatgttattatgacagaggtaagcatactcaagctcttccaaggtcagagatttattttaataagacctaattttcaaagggccttatgagaaacccaaattgcttaggaaataagaattttcttcctttcrtcgacaggaaatacattgttaataattttattgtggaaaaattctttctccaaatgccttgtacccatgagtgtcatgcaaccctgagctttgtctattgcattccttggaactgaacaacagtagttcaggaggaaggcatggacatttagaggtaacgagatgcaggagaggctattgaagggtagatggaaggggcaccaaaccaagacttaaacattgtatagtttttctagacttcaataagtagagtttctttctcactgcagtcagagattttacaggctgttaatcctggga

SEQ ID NO: 179800 - DNA, 601 bp, Human
atttctggggtgcgtgtgtgtacgcttaggaagcactcagtaatctctcatggaggtgatcgaagctgagtaagagtgttccagcaggcgaagtagaagaggtgactgctgtaaaccgaagctccatgagccggccagctattccagatgctgcttgggagtttcagccctttctcagttggatgagctccatatgccattgagatgtatacatacacacatatacacacacgcagcatacacacacacacacacatatacacacacatgcaactggttgctctatcacttaacttcaaaygaacaagctaaatctagtgcctggtagagaggggctataccccaaggacatattagctggcacaggcacttagaggtagcaagatttttctgaatcagagataggctgataggctacatctggtactaacttgtaaataagaaaatgtgttcatagatgcaaacagcatagaataaagtaagtcatattttataaagacagtggaacaataaaataaaataataatctgagaaatatgtgcacacagttttaaaaaacacgatggtctaacaatagtgattcatgtgactcagggattgt

SEQ ID NO: 179801 - DNA, 601 bp, Human
tcaatcatttagcgttatcataactctgattgccctcatttagtgttatcatccccatttagtaagttaaaaaaattgaggaacaaagagattgattgatttataaagaatctcaagggaaattagaatcaaagctataaaaaagtatttacagctagaggtaattttacagctgggttttggaatcctttccccagcccttgcaatgacattgcctgaggtgctctctgatttgcatcttagaaagaataaaacttatcgcagtgcattcaggtggcactacccagtcctgcctgggtargcagactactgggtaggtagatatccacctactcttggtgaagccaaagatgttcatactggtcaggttacagggtgacctactgtcctggtttcagcaccaaatgtcctgcatccctggaaagccacccagtcccaggtcagtaaccctcattgctaaccagaactgtcctccacattgaaaatacacattgtatttcttttcttgttgcttttcctggttaatatcttttttgggtgattcacacaaattacacttttttagttttattatagcatttgatattaagatccatcatta

SEQ ID NO: 179802 - DNA, 601 bp, Human
gtggcgggcacctgtagtccaagctactttggaggccgaggcaggagaatggcgtgaacccgggaggcggagcttgcagtgagctgagatctcaccactgcactccagcctgggcaacagagcgagactccgcctcaaaaaaaaaaatgccttgaatatccattgtgggagttcacagagtgcagcacatttaaaaatacgtgcattgagcagtcaagtggactttcagatgttactactttaaaaataaatggtgtgtatttccaaaagttcttatttgaggcattcctaacacagatcyctctgtgatatgatgtttaactgtcctttattttcaatcaaccagaagctttcttggatatctgtattagtcaagcttatctctcttcatctgggacctaactacttcacaaagaaattttctctgagaaataactttcatcgaactcattcattattcatgtcaatgcagactctcagttcattttaaagtgttggatcttagaatgaaactgagagcaatctaggaaggtattagtaacagaactaccttctgtattctggggtaacttatgaacaatagtaaatacagagtttcaat

SEQ ID NO: 179803 - DNA, 601 bp, Human
ttaaaaaccaaatggaaaatattaaggaagaaaaagaagaggccacgcatggtggctcatgcctgtaatcccagcgctttgggaggccgaggcggacagatcatctgaggtcaggagtttgagaccagcctggccaacatggcaaaaccccatctccactaaaaatacaaaaactagccgggtgtggtggcacacgcctgtagtaccagctactcaggaggctgaggcaggagaatcgcttgaacccgggagccagaggttgcagcgagccgagactgcatcactgcaatgcagcctgggygacagagcaaaactccatctcacaaaaaaaaaaaaaaaagaaaagaaaagaaagaaaaaaatatagcaaatgcattttaaatatttacattaaatgtcatggacatgcaccttacctgcaacatatctgtgagatacgattgattaaaagatgctgtttttcatagacatacagaccatcttaatgcttaggtatttttgtaaatgaaaagatgaggtaagatttgatagtataaatctgatatgaattagatacaaagtagtgtcataattagaggttttatttctgatcaagaacctg

SEQ ID NO: 179804 - DNA, 601 bp, Human
aatacaaaaactagccgggtgtggtggcacacgcctgtagtaccagctactcaggaggctgaggcaggagaatcgcttgaacccgggagccagaggttgcagcgagccgagactgcatcactgcaatgcagcctgggtgacagagcaaaactccatctcacaaaaaaaaaaaaaaaagaaaagaaaagaaagaaaaaaatatagcaaatgcattttaaatatttacattaaatgtcatggacatgcaccttacctgcaacatatctgtgagatacgattgattaaaagatgctgtttttcrtagacatacagaccatcttaatgcttaggtatttttgtaaatgaaaagatgaggtaagatttgatagtataaatctgatatgaattagatacaaagtagtgtcataattagaggttttatttctgatcaagaacctgatgtctaacttttcattaaaattagcacaagaacaatatttaagactgcaaattattttagtcagtcccaaagagagtagatctacagatcaaacttttcaaaaagtgtttcttaagacaacaattccactgcatgtcacggttacaaggaaaactgtcctat

SEQ ID NO: 179805 - DNA, 601 bp, Human
ggagaatcgcttgaacccgggagccagaggttgcagcgagccgagactgcatcactgcaatgcagcctgggtgacagagcaaaactccatctcacaaaaaaaaaaaaaaaagaaaagaaaagaaagaaaaaaatatagcaaatgcattttaaatatttacattaaatgtcatggacatgcaccttacctgcaacatatctgtgagatacgattgattaaaagatgctgtttttcatagacatacagaccatcttaatgcttaggtatttttgtaaatgaaaagatgaggtaagatttgatrgtataaatctgatatgaattagatacaaagtagtgtcataattagaggttttatttctgatcaagaacctgatgtctaacttttcattaaaattagcacaagaacaatatttaagactgcaaattattttagtcagtcccaaagagagtagatctacagatcaaacttttcaaaaagtgtttcttaagacaacaattccactgcatgtcacggttacaaggaaaactgtcctatcatcaaatgaatttgggggatactgagttaaacactcaaattgttttctttgctgcaggacttctg

SEQ ID NO: 179806 - DNA, 601 bp, Human
tgatggcttcacttggacttctaataggcaccacaaaagaatcatgtcccaagtcaagtacctcctgcatcgttcctcgtcttggtcaatggcaatttcaagccaaaaacctgatgttatcctcaactcccttcctcttacttatgcatcatcagcaaatcctgccgaagtccttcagattttatctagaattcaaccactttttgtcacatcccaattccactaatttgtacaaagccatcatcatctctcacctggattactgaaatagactcttacggcaagagtgttattgcaacakctccaagggcagatctccctgtgctttgttcttgcccttctcctcccttcagtctattcttaatacaaaagtcagcttgattctcttgaaatatgtcatatcatttcactcctctgctcaaagatggccagtggtttcccatctcacccagaacaaaaccacagccctgtgatggcccttaaggccctctgtgatctgctccaatccacccatcacttctctgagctcgtcttctaccagtccaagcccagctcacccgacttcagcctcactcttcctcaaaaatagcatcaggctgct

SEQ ID NO: 179807 - DNA, 601 bp, Human
tatatataaccatgaattgaagtagaacaacaacaacaactaaatataggtggattttaattctattgcatttctgaaatggttatcgttggaatatatttaccattacaaggtaagttgagtcagaacaatatattcctttgagaggaataagatagaaaaccattattttcctgtgttttttttgtttgttttttccatcattaaatgagatggattctctgccacaatgaaacattgtctgaaattccttttgggaagaagagggtaaatttaatactttcactaatctctcagcacwggcttaatctagagacagatggaatcagtaggcagcagtggaattgcctccctttaaggttcttacccacaacaatggcttgatttccaccatgttacactgagttgattcggatagctccctgttccatggaaacagtgattgaaaagcaggttaggaagtatccttggaacctaaaaaaaaagtcaatcagtgagacctagagccaggcatggtttttttcatattaagattgctgaattccacccctttgacattctgattctctccatataatgtgggattaagggaaagtttgga

SEQ ID NO: 179808 - DNA, 601 bp, Human
aacaattctcctgtaagtctagatggaattatgtggcacaacccaacatccttcatggcaacccttcattgcacccatcatccccccttaaaggccacctgccaggtgtacaggatgttgccagctgtggcttccatctgtgtttaggtagtcacaaaacacaactgcctacgtcctcgctgcacttcactggttcaagagtctacccaaaacagacagaaatgctcctgtggtgacggaactctgctgtctaaaccaagatttcaagtgaattcctcttggcttatcttaaattactgcrctgtaaagtcagaatcttgttagaagagaatattacttgaatatatgtgagttcctttaaaattattttcaatttcaaagcccttgggagaaaaaaaagaagatgttggctgggcacggtggctcacgcctgtaatcccaacactttgggaggccaaggtgggcagattacctgaggtcaggagttcaagaccagcctgaccaacatgccgaaaccctctctgtactaaaaatacaaaaattagctgggtgtggtggtgcttgcctgtaatcccagctactagggaggctgaggcaggag

SEQ ID NO: 179809 - DNA, 601 bp, Human
agtcactaaataaatgtgtttatgtggaaacaaaggctactcatcaccccagattgggggggttctttgcctcagagaggaatccttgcctactaaatacacacaaataaggaaacacaatgaacaccatgtttatgctgatttccaggttactaaatgctggttgtttccatgtagaattaatctagttagatcataggttgtgtccacctgatacagcctcctgcaagaattctagtgttctttgcaaacaaaatataaaacttattttcttaggagcacagataaaaaattaacaacrtagcagggcgcagtggctcatgccggtaatcccagcactttgggtggccgaggcaggtggatcacgaggtcaggagatcgagaccattctgtctaacatggtgaaaccctgtctctactaaaaatacaaaaaaaagtagccgggcatggtggcaggtgcctgtggtcccagctaccacaggctgaggcaggagaatagtgtgaacccgggaagtagagcctgaagtaagccaagattgcaccactgcactccagcctgggtgacagagcgagactccgtctcaaaaacaaaacaaaaaac

SEQ ID NO: 179810 - DNA, 601 bp, Human
tcagttcaaagtagtcagcatgccaaggtgccatattttggggtgtcatgttctgagccccaacagtgttaatggctaataatgacttaaaatgctgtttcttactttaaactaatcatagcacattttaggtttggctctcttaaaagacaacaaaagcattgaatattgcatgccacagagagtgggatttcaaagtgttttcttatgcttggttaggcgattacctacgcagtcagcatagagagcaaataagcaagtgctaattcaaatttcagtggcaaaacattaaaaaaaaacaaaaaaaactcctattctgcttagcttttattttgtgaatgattaagaaaaacctactttatagttttgcctgtctctcttctctactttaacttgtccttaactaaactggcccaaagtttatattcatttggttcaggtgatattttctgaaatattggggaaaatagtcaagacagcacatatttgcatactctgtactatggctgccttttcctgagatctaaatggcttctgcaatacgttgtttgaaagttttatttttatatagttttttaaaaaagattgctttgtttagaaa

SEQ ID NO: 179811 - DNA, 601 bp, Human
tctcttctctactttaacttgtccttaactaaactggcccaaagtttatattcatttggttcaggtgatattttctgaaatattggggaaaatagtcaagacagcacatatttgcatactctgtactatggctgccttttcctgagatctaaatggcttctgcaatacgttgtttgaaagttttatttttatatagttttttaaaaaagattgctttgtttagaaaatgttaaaatgaagaaaagtgtaaggacataaacaaaaatatccagaaaacctatcacagatagtgtcttagtgyatattattttagatattagataggcaggcaggcaggcagacagacaaggagataaacaggtaggtagatagataaatagatacatacataatagatagataatagatcatgataggtagatgatagatattaatagacagatgataggtagatgatagacaataggtagataaatgatgaatgattaatagaggacagatacatgatagaaaatagatcatgataggtagatactaggttggtgcaaaagtaattgcgtttttgcagccgggtgtggtggctcacgcctataatcccagc

SEQ ID NO: 179812 - DNA, 601 bp, Human
aatgagaatagcatccctaacagtggcagtgattgaaaaaaacaatcaaccctgggagaaaacatacatgaaatgaaaatcgcaataataacaataactaaattcttgagtgctgactatgtgcactgtcctaaatagatgattaactcatttaatgtgctcaaccagcctgtgagtaagtgaaatatctgctcttatagctgtatttaagtaatgacttagtttttaaaaactctatctgtcatagttccttccattttcccatagaaaacagaaataatatactcttctagaactaagmatcttgacagaagcctgaagtttggactcaaagaaaatcaacactttggcatgagtagtcaagctaaaatgcaagatgtgctatacacagtcagtgccaaataagtgactcttttcaccttctgtcatcaccactcaccccactgtgtcattatgaccacttgtgatagctaaaactcttctgctatgtgctctcccaccattccactgaaataacccaacgatggaacattctttacactcaatatcaaaaaaaatgataaattacagtttctttttttctctgtactcacttttttct

SEQ ID NO: 179813 - DNA, 601 bp, Human
caccactcaccccactgtgtcattatgaccacttgtgatagctaaaactcttctgctatgtgctctcccaccattccactgaaataacccaacgatggaacattctttacactcaatatcaaaaaaaatgataaattacagtttctttttttctctgtactcacttttttctacccttcatatctcccacctcggttctttgaccagaaccttacttaaatattcagaactatgcccaggaaaccaatatttagatattccaggccaggcatattctttttagctactgttgaaacttaaygagaattcagcaccaacatatactggtggagctgagtgcaatacactttcttgaatacttagactagattcttctataagctcctttgtaaccaaggtacacaatttttcttttgggaagactcccacttgccttctctgttgcacttctgaaaaacgctatgtatgaagatctgcactttaaaagcattgtgtttccccaggtaattcgctcacatacccgttttcattttttagttttgatttttcctccgctctggaggatgcacagatccccttaagaatcgtattagatttgggt

SEQ ID NO: 179814 - DNA, 601 bp, Human
tgatttttcctccgctctggaggatgcacagatccccttaagaatcgtattagatttgggtacattaatatacccacaagtttatgaaatgccattttgcatatttccaagttcaaatagagaagaaattaacatttaaaatttgcaacctgatctttgggtcccagtggtttataacattcatgcttatggcatcaaactcactgatggtttaacaaacaggaaattggattaagactcaagaaaacctaggtacttttcttttgaaccgagactcattaaagatagctaaagctatccrgcaatggattggactgcggtgtaaggtagagaatttctcacactgagaggtgttcagcagtggctgtgtagaggggactcatgcatcaaaaggagtttgacctgaaggtctcttccaattcctgctatttgtgacccattttcagggccgatccaaacaattaacctcaccatgcctccctttcctcactgtaaaatagcactgacacctattcacctcagaggtatattctaaggtttatttcgctatttataaggcatggagcagacttcataaaaaggggcaatctaaatagcaaag

SEQ ID NO: 179815 - DNA, 601 bp, Human
tcttttgccatatatgacattgacatttttaaagagtccaggtcagttttattgttgaatgtccctctattgggtttgtctggttctctcttgcctacgttttatttttaaattctctccatctcagtgggctagaaaaaaattcacgttatcagcattacatgcaccttcaccattcactgcaactggggttctggcagggttgggtcactccatcagggctggcatccacacgagagaggattagcaaagctaggtgttgtgcctaaatcaatgtcctttttctgaagcaattatatgkttagcaaacgacttttaactactcattacaaagaaatgactgatggattgctgcaaaatgcaaatataagggaaagcttcctctaaattttgtctactgtgctttttgaattgtaaattctccatcatttgctaatgaaggcagaaaggcttttcttaagcaaacaattgcttcaggaagagaaataaaaaactcactccctccctgttctttgttcttcccccagtttccatccctaatctttaaatctgctgatcctccccctttctgaagccagtttacctatatactggcaaaagg

SEQ ID NO: 179816 - DNA, 601 bp, Human
aacagcaattttaatccaggattcttcttaactatctttgtaagttacttaactactctgggccctgaattcctcatttaaataataatagtaataatggttacatcataggattatttcaaagattaacacatattacaaataacaaatatacgaacccacgttctatattttgtttcatttttaatgctcctcagtagttcatgacgtggctgtggaagtgagaagacaagcaggtgattataagtacctgagggacttcagttgactgatttgaaaaggagcaagaatccaggaagcstactattctagcaattcaatctttgtgtaaaaagagaaaagattcatgtgttagtccattttcacacagctataaggaactacctgagactgagtaatttataacgaaaagaggtttaattgactcatatttccacatggctggggaggcctcaggaaatttacaatcatggcagaaggtaaacaggaaggaagaaatgtcatacatgttggcagaagagagagagagagcaaggggggaagtgccacacttttttaaaccatcagatctcatgagaattcactcactaccacaagaaca

SEQ ID NO: 179817 - DNA, 601 bp, Human
ctgaggcaggagaatcacttgaacctgggaggtggaggttgcagcgagccaagattatgccactgtactccagcctgggcaacagagtgagactctgtccccaaaaaataataaaataaaataaaataaagttgggaacacaaagttgcatttgaaagcaatcacagacatcaccatatctaattctcacactttgcaagatataaaatgatattgccagagtcatacatccagtgctttctccaccatgagatgctgtcactcctgctaggcagaagagtatccattgcttaattctacrttatagttacattaacaaatctttagatattaaaatttcctctcaataaagcaagtaagcatgtggcagtagtgtcaacaactgaagaactttaaaggtaagtaaatgcaatcagtaatcctttatcataaggcttcatttaagaatgttaatacagttcattaaagggtgtaatgaagtgtgtgggtcagaactgagaaaaacacccagatttatgtgtagccctcaaaaggcaaagaagcatcccttcccaggggcctgttgtaacagaggctgaggacttctgttacatttaagaga

SEQ ID NO: 179818 - DNA, 601 bp, Human
tcactaaatttggacttgaagttcctttgatagaagtagctctttcctagtagcctggggattacatcattcaaaggacaattaaaacaaaaacaaaagcaaaatatccaagaatggcactctcaagaaatgtctagctggtacagcggggagtaggattagttcagctttgtaccaaccactgacacagacatttttctctctatcctctctcttatcatgttttggcctatgtttgcttttcctaatcattttagtgttaagagtggctgtgaggcttggaggaagacactaaagagayggcttatccagttttcgttctagactaataatctgcaaatattttggagataagaacccttttttaaaggtcctatcatgaaattcctaccgtattgcatgtaaaagggcaattgcgctttttggaataactacagaggactcaggtcagcttaatggggcttcattggaacctccagaggctgctgtgcttgaaacgggatattggagacatcagaacttttctgttctggtcaaagtaaggcccaagcactctatgtgatccagcttaacttgctccatttgccctggagaaaaaact

SEQ ID NO: 179819 - DNA, 601 bp, Human
gaagttcctttgatagaagtagctctttcctagtagcctggggattacatcattcaaaggacaattaaaacaaaaacaaaagcaaaatatccaagaatggcactctcaagaaatgtctagctggtacagcggggagtaggattagttcagctttgtaccaaccactgacacagacatttttctctctatcctctctcttatcatgttttggcctatgtttgcttttcctaatcattttagtgttaagagtggctgtgaggcttggaggaagacactaaagagatggcttatccagttttcrttctagactaataatctgcaaatattttggagataagaacccttttttaaaggtcctatcatgaaattcctaccgtattgcatgtaaaagggcaattgcgctttttggaataactacagaggactcaggtcagcttaatggggcttcattggaacctccagaggctgctgtgcttgaaacgggatattggagacatcagaacttttctgttctggtcaaagtaaggcccaagcactctatgtgatccagcttaacttgctccatttgccctggagaaaaaactgtagaaagagacttgtc

SEQ ID NO: 179820 - DNA, 601 bp, Human
tggctaggctgccatgtggtctccagactgcctgatctcagagcctgtgtgctcactttactctgaagggcccccaagcagaatggatgactattctgaagtaggctttcagaaatgtctggaaaaaacacagccatatgctgctggtcttctttagataagatcagtattaatagcttttacttttctggtagctgaaatcactgccaagaacatttctctgccaggtcaatgtggtaccctctttatgtgcgttttccatcattgtcctgcatttccctgcacctttatcatattttcycaccttttaatgattcttcagaaaagaagaaatcaaaggcactttaaagatatttaacatttatctaaaagcaaaaattggggaaaagtctatagttattcttgggcatgctaattactccagcaaagtaattatttctattcatattgaacaagtactatatgatgaaaatctgagaagttatttccccaaaattcatttgaaatttgaatgtcaagacttgattaggctacagaagatagggctttcatatgaactttcttcatgaatttctacagttggaaaatttccataaaccag

SEQ ID NO: 179821 - DNA, 601 bp, Human
agttggaaaatttccataaaccagaaggtcgcatgtgtcctctccccaacttacccacccaccacctcgcagcagggtcctgatgctttgaaaagatgctgctctctccttaacctgccttcaatgtggaaaccattgctcctcctcactctcatttccccaagtccaactactctttcgccgactcttcgctgtttatccttcatatacaccctcattcatactgagtgtgattttactgagggagtggctgaaaggaggtgaatttaaagaatgaagcaaagggcaagaaagctctacytatggaattctcaacttgtacctagcaggatgctgggtgctaagcaaccatctcatttaagtgaccaaataacttttaatatgattggcattattcctcttttgcaattgaaaattgaagccaattttatctaccatatactgagcatacacttaaatagaaaacaccaaggccgcatgacctgacctggcctctttctcctcttgctggcctccagtatccgatgctccatttcagaggcatcctttctggccacgtgacacagccttttctccccacatcatagcctttgcacttgcg

SEQ ID NO: 179822 - DNA, 601 bp, Human
agtgcaatgacaatgctagttaatcaaataattttgtgcattgattctctcctcatatatgttgtgctcagtggctgtaatgatggcaaacagagatgcttaaattggtttcatcccttgtttagataagacagaagcaaccatcagctgtgatctctcactatagaaaacatcaagtcaagcatggcacactatgctaagggatggtaaacatgtgcccactaagtcagatctataagtcaatcatttttttcatcataaatacatagaaaaggccgaagacctcaggggccattttatwctgaacacgtaccgtatgctggcactgtgctaagcagcttaaatgcatcagtcatttaatttttatgagaacattctggatagaagaaactgacagagcccagagagattttgtaacttgcccaaggtcacaaagctagcaagtggcaggtctgggatttaaaacttatctgaggctttgaaaggaaaaaaaatgtaacctcttctgctactgttgtgtacaacaagatgtcaactgattctcgtcttattgcaacctgaaacgtattttagttaagccttgcacttcttgaacgaaggt

SEQ ID NO: 179823 - DNA, 601 bp, Human
caggctggagtgcaatggcatgatctcggctcactgcaacctccacctcccaggttcaagcgattctcctgcctcagcctcccaagcaactgagattacaagcatgcaccacaacgcccagctaatgttgtatttttagtagagatggggtttctctatgttggtcaggctggtctcaaactcccgacctcaggtgatccgcctgccttggcctcccaaagtgctgggattacaggcgtgagccaccaagcctggcttatttatttatttttcacttttgttttcagttcaggggtacatrtgcaggttttttatataggtatgttcctgccagtgagggactgtgattagaatcttagactgaaagttgggagacccatttgcaaattctgctttttccctaacagaaaaaaataactaccatttatctggtatttactgcatgcataatatgctacgtgtttgactggaatgatttctttttatcctctcaaaatagtctttgtcatagatgaggaaaatgaggcttcaggtcacacactcagtgacaggtctggaatttcagatcagagtatgatgttcacatcacccatgttgctca

SEQ ID NO: 179824 - DNA, 601 bp, Human
cacagctgagtccagcatttatacaggaggctccctcacgggtagacaggaaacttaacaaactctggcaggtggattgatgcatcctacttaagataaagctttgactcctgtggttctaactttggtcttaaataaccatatgcttttatttgggatctcaaactccagcagaattttgtgcaaattattaattttcctgccacttgcacctcctattatcaattaagaaattaataaagtcctaagatcccaagattgaaatcaaacctgggttcaaatactataactatgctttatmtctaaaatctataaattaggaataacacttcctctccaattaaatgtcaataacctattactgtagtgaacatcgtgttgtggcactcagcaagcagtcgctgtgaatattattgttgtagcttaaaaatatgagcttggttaatataaatcagtggttctcagcactggctgtacataagtatcacctggggagtttttagtaactatcaatgcctgaaacatatcccagacaaaataaatcagaatatttaggaatgaggctcaggcattggtattttggagaagtttcttggtggtt

SEQ ID NO: 179825 - DNA, 601 bp, Human
caattttccctagatgttgcagagaggttattttttagtttcatgtaattgccccaaaagttccattctctcctgtttaccagattgcctatttcattctgccatgggaaaacttcttttcctgctctgttctcaacagtctgcactccttaaatagcataatctcatctgttgtgcacctgggtgatgcaatctggctcttctagtaggatcatcttccaagctaaactaaaccccaatgatttgcactccttttattaatatctattagtatgagcttcctttctcctgcagaccatayctctaaggagagaagcttataaaggagttaacactgagaagaacttccaaatagtacagttatttaattcatcaactctttgtggaatatcttttgcttttctttagtttaacttggaggtaggagaaaaaggggctggatttatacatcatatagcacagttttcaaatccaaggaaaaaccctagacttgtggttagcttatcacctgtgtacatgcatgtggttaacacgtgtaagtgaatggagggaaacagaggaacttagcaagttgtcaacctcaaatgaaaaaagtcaattt

SEQ ID NO: 179826 - DNA, 601 bp, Human
ctgctctgttctcaacagtctgcactccttaaatagcataatctcatctgttgtgcacctgggtgatgcaatctggctcttctagtaggatcatcttccaagctaaactaaaccccaatgatttgcactccttttattaatatctattagtatgagcttcctttctcctgcagaccatacctctaaggagagaagcttataaaggagttaacactgagaagaacttccaaatagtacagttatttaattcatcaactctttgtggaatatcttttgcttttctttagtttaacttggaggyaggagaaaaaggggctggatttatacatcatatagcacagttttcaaatccaaggaaaaaccctagacttgtggttagcttatcacctgtgtacatgcatgtggttaacacgtgtaagtgaatggagggaaacagaggaacttagcaagttgtcaacctcaaatgaaaaaagtcaatttttcctcttgatacatgtttttgacgttaccaaagctggagtaatgtaccaatcactggagttagggttacagcgatttcatatgccataatcacagaaagatgagaaaatgagatgtattg

SEQ ID NO: 179827 - DNA, 601 bp, Human
tggttagcttatcacctgtgtacatgcatgtggttaacacgtgtaagtgaatggagggaaacagaggaacttagcaagttgtcaacctcaaatgaaaaaagtcaatttttcctcttgatacatgtttttgacgttaccaaagctggagtaatgtaccaatcactggagttagggttacagcgatttcatatgccataatcacagaaagatgagaaaatgagatgtattggttttctattgctgtttaagccaaatttagtggctttaacaatatatttgtttacagttacagaaatcagaratctaaaatcatgttgttagcaggtctgctttccttttggaaacttctggggaaaatccaacttcttgccttttcttactcacagaggccgtcctcattccttgtcttgtggccccgcatcacactccatctttctctctccttctatttacgcattcccatttacaccttctctgccttaagaccctgctgttttcattgtgactacattgggcctacctagataattcagagaaatctccccatctcaaaatctttcatttattcacatctgtaaaatccatctccaggtaaaggaac

SEQ ID NO: 179828 - DNA, 601 bp, Human
tcctagtatgtaccctttgagttggaaaactggaaaaacagtactaatgacgtccacactagtaatcttccaaaatcaatagatattccacaccctgcctattttagatacataatgttaacaaaagggctgggttgtttttaactgtcaatctaagtcaatgatataatgtcaaaagttgtttaacaagattaattccattaagaaatgagacttggccaggtgcagtggctcacgcctgtgatcccagcacttagggagaccaagacaggaggatcacttgaggtcaggagtttgaacmagcgtggccaacatggtaaaaccccatctctactaaaaatataaaaattagccaggcatggcggtacgtgcctgtaatcccagctactcaggaggctgagacaagagaatcgcttgaactcaggaggcagaggttgcagggagccgagattgtaccagtgcgctatagcctggggcgacagaatgagactctttcaaaaataaataaaaataaaaaaaagaaatgggccttattagaagaacatattagtggaagcaattcggaggaatatgctatccatatgaacagtattgatatctg

SEQ ID NO: 179829 - DNA, 601 bp, Human
tttccaagcatttgcagtcaccctagaaattatcccattcttattataattctgttcctgattctttccccttatttctcttttgcagattctgttcatgggcatgatgaccgagtactatcactactttttcacaaccctggtaagtgcatctgggagaaatgtattccacatggtaggaaacgtcttcacacagttatttcagagtcggcctcaccagtgtcaaaggcaggatattgtcatggagacttgccttactttcctaagaatcctctaaatccagcaatgctgagcagcaggttttttttctttctttctttctctttctttctttctttccttctttctttttcttttaactagtatcaatgcatgtgcattcagagagggattaaaatgaaaattccattaaatagaaactattaaagtaaaaactattcataaaaaacatcatctacaatttttatatacattagaaggtgtatccaagtgtgtctggcattcattgatttgatgtggctttgctgcctgtgtccagtagatagctgggttagccaggggttacctgtcagatgtctgaaaaaccttcagaaaggggagt

SEQ ID NO: 179830 - DNA, 601 bp, Human
actgcaaaaataaaacagatgaaaatgaaaactgattactgccctagaatttttagggcagcatgttaatgaaaaacaatgggaaaaatgttcttttattgaaatagtgtggtacggctgccattttgttttaatctatagcagctcccctttatccaatgggtatatgttctgagacctccaatagatgcctgaaatctagtatggtgccaaaccccatatagattatgtttttcctatatatacaaacctaggataaagattaattgataaattaggcacaatactcttgcagactggraccattatgaagtataagggtgacttaacaaagcacttccataccacgatactctacctcataactgagacagctattaactgactgatgagcaggtggcatctgtagtatggagactctggacaaataattcatgtcccaggcaggacagcatgggacagctcaagatttcctcatgctactcagagtggtgtgcaattttaaaattatgaattgcttatttctgaagttttccatttaacatgttccaactgtggttgaccgcaggtaactgaaaccatgaaccacaaaaccacagat

SEQ ID NO: 179831 - DNA, 601 bp, Human
acgtgtcatccatcattgagaagtggtccatggagagactgcaggccccacccaggcccgagactggccttttggatggcatgatgacagtaagtcattttcaaataaaatcatttgcaagaatatttgaatgccttcggggttaagatctcacgtatctttaaaatattagagaaaagtgttacagtgggtgccttgacttgcagtagagaagaaagagtttgctttttaggtaatttgaaaggctgtgactggctactagcaaaaactgctacttttagcttcctggatgtacttgccycagataaaaaacttgacaagagtaatcaccattatcagccaaaccagtgcaaggacaagtgaagagcattttattctaggaatgtggctgtggggaaggtggctggtgggggaagaggaggaacaacctacctgtgagttttgcagaaccgatttgtgttcctcacttctgccacatttcagcaagcaaagccagtgtggaaaaatgtcggatttacaaacagtcggtgtattcagctcttcctgtcctggatgcgtataggttcacctctgcagaactgacagtgtttaacaccagcca

SEQ ID NO: 179832 - DNA, 601 bp, Human
ccacccaggcccgagactggccttttggatggcatgatgacagtaagtcattttcaaataaaatcatttgcaagaatatttgaatgccttcggggttaagatctcacgtatctttaaaatattagagaaaagtgttacagtgggtgccttgacttgcagtagagaagaaagagtttgctttttaggtaatttgaaaggctgtgactggctactagcaaaaactgctacttttagcttcctggatgtacttgccccagataaaaaacttgacaagagtaatcaccattatcagccaaaccaktgcaaggacaagtgaagagcattttattctaggaatgtggctgtggggaaggtggctggtgggggaagaggaggaacaacctacctgtgagttttgcagaaccgatttgtgttcctcacttctgccacatttcagcaagcaaagccagtgtggaaaaatgtcggatttacaaacagtcggtgtattcagctcttcctgtcctggatgcgtataggttcacctctgcagaactgacagtgtttaacaccagccatatgtcgctcttgaagcagatgccagacctgcctcctgacaagtcag

SEQ ID NO: 179833 - DNA, 601 bp, Human
aacatcatttgtctcttgtcaaatgcacctaccttcactatatttctctaatgaagctccctgggtgctgaagaaaatagcaggaaataattttttaaaatgcttcctatatgggagccatctaaggggaaagatattgtggaatgcaggcaggtaatagcattttaaaatggcatagtattttattatccattcctatcatcgggagacgcactctcgcttttaagatgcaatttacccaacatctcacagagaacttgggatttttttcccctttttcttatgaggaacaaatgaaagygaagaactaaatgaatgaattaagtggttctggatgattctatgttcaggctccctaactgtttttcaaacctgaaataacttttaaaatattcaaagtgaactgagagataatgatggaaagcatcttggtacaaatgagccctgggatgatttgaaacatttctttgaataggagcaagtagagaatatccagggaaatattatatttctgaaagggagagggaacaccagagacagagggagaagcacgctaatagatcggtttttctcttcttcctcttgggtttataatttcaat

SEQ ID NO: 179834 - DNA, 601 bp, Human
ccattcctatcatcgggagacgcactctcgcttttaagatgcaatttacccaacatctcacagagaacttgggatttttttcccctttttcttatgaggaacaaatgaaagtgaagaactaaatgaatgaattaagtggttctggatgattctatgttcaggctccctaactgtttttcaaacctgaaataacttttaaaatattcaaagtgaactgagagataatgatggaaagcatcttggtacaaatgagccctgggatgatttgaaacatttctttgaataggagcaagtagagaatatccagggaaatattatatttctgaaagggagagggaacaccagagacagagggagaagcacgctaatagatcggtttttctcttcttcctcttgggtttataatttcaatgagttcaaatatggttcgaaatcctctgcccacttttccaatgaagtttcaatcacaggatgagatctcaaatcatttttacctgtgtttggtatataccactaaaagagttacagtttgaagctatgttaacacagactgtggacttatgccaaacattaaatattcatcacaagtatggcttaattt

SEQ ID NO: 179835 - DNA, 601 bp, Human
aaggttgagtcccagtggatggaagaggtcctggtctgcctgaagatttttactgtcatcccaactaagagaggggtttctagactgtgttcttacagttattattataattaactatataaaggaaagtggggatttaccagagcagaagagggtagctcactaaggtgctgcaaaagtgggtagagtaactattgaatatatcaggtcgtgtcaatactaattttttaaaaagtgataggatgcaggccccagtatgagttgtatccaacagtcatgcagataataactttgaaattaygtgaagcgtaacatttacctttttttatccaaagagtctgctttgcacttgactgttttctttctgtttctcctggatgtggctactttgggaatgtggaaactgtgtcatgggaggtgaagggcattgaagggcacgaaaggacctccgtttgatcaatagctaagccaagagagcaaacttatgaccccaaacccaggcccaaagctaacaaatctttgctgtcaagttgcctctatttaaactctttcttctctacgttaaagataaaaagtcctttggtttcagtttcattgggtc

SEQ ID NO: 179836 - DNA, 601 bp, Human
actttgaaattatgtgaagcgtaacatttacctttttttatccaaagagtctgctttgcacttgactgttttctttctgtttctcctggatgtggctactttgggaatgtggaaactgtgtcatgggaggtgaagggcattgaagggcacgaaaggacctccgtttgatcaatagctaagccaagagagcaaacttatgaccccaaacccaggcccaaagctaacaaatctttgctgtcaagttgcctctatttaaactctttcttctctacgttaaagataaaaagtcctttggtttcartttcattgggtccacatcgcagaccctgcccttcattcattcttgcacatcaagcacttgctgtccccctgccttgaagtctcacttatccaggctacaaaatgccacttcaccagacagagcctccatgaatcaccatctagtacagtagccccctccctggtttttctctctttcttcttacctgtttttgttttcttcatagcccttatgacctgacgtgttatattttgattcgtttgttcagtaccttccctacaagaatagacacttcataaaagtgtcttttatgaaaaagag

SEQ ID NO: 179837 - DNA, 601 bp, Human
agccaagagagcaaacttatgaccccaaacccaggcccaaagctaacaaatctttgctgtcaagttgcctctatttaaactctttcttctctacgttaaagataaaaagtcctttggtttcagtttcattgggtccacatcgcagaccctgcccttcattcattcttgcacatcaagcacttgctgtccccctgccttgaagtctcacttatccaggctacaaaatgccacttcaccagacagagcctccatgaatcaccatctagtacagtagccccctccctggtttttctctctttcytcttacctgtttttgttttcttcatagcccttatgacctgacgtgttatattttgattcgtttgttcagtaccttccctacaagaatagacacttcataaaagtgtcttttatgaaaaagaggctttgtgattttgtgctttgctttctccccagcactagaaaaggcccagtgcgaagtacaccgtcaataaatatgtatttaataaagaaattaatgtgctaaataaataagaattaagcttctactaaaactgaagatgttaaatgaaaaatatttaggcagccttgaaatagtccc

SEQ ID NO: 179838 - DNA, 601 bp, Human
tccccctgccttgaagtctcacttatccaggctacaaaatgccacttcaccagacagagcctccatgaatcaccatctagtacagtagccccctccctggtttttctctctttcttcttacctgtttttgttttcttcatagcccttatgacctgacgtgttatattttgattcgtttgttcagtaccttccctacaagaatagacacttcataaaagtgtcttttatgaaaaagaggctttgtgattttgtgctttgctttctccccagcactagaaaaggcccagtgcgaagtacaccktcaataaatatgtatttaataaagaaattaatgtgctaaataaataagaattaagcttctactaaaactgaagatgttaaatgaaaaatatttaggcagccttgaaatagtcccataaaagtgcagagagttcctataaacaagatatatgtgaatgtgcatgattagtaaaatagagattactttaaaataatagtgtttttttaaaattagtcacagactggccactcttaatatttaaataatgctactactataatagaattgaattctctgaaatcatatgcttcattccactat

SEQ ID NO: 179839 - DNA, 601 bp, Human
acttcataaaagtgtcttttatgaaaaagaggctttgtgattttgtgctttgctttctccccagcactagaaaaggcccagtgcgaagtacaccgtcaataaatatgtatttaataaagaaattaatgtgctaaataaataagaattaagcttctactaaaactgaagatgttaaatgaaaaatatttaggcagccttgaaatagtcccataaaagtgcagagagttcctataaacaagatatatgtgaatgtgcatgattagtaaaatagagattactttaaaataatagtgtttttttraaattagtcacagactggccactcttaatatttaaataatgctactactataatagaattgaattctctgaaatcatatgcttcattccactattcttcaaggtgaatttctctgtagctgtttatagtcatattggtatgtggtgcatacatacatggatgaatataggaattagaaaaaagcataaggaaaatgcatgtgttttgatttcccattcaattgtctatttttctctctaatatttctaactattaagcatttcctagaatttcatacactaaaaatcctcaaaaatatga

SEQ ID NO: 179840 - DNA, 601 bp, Human
ttgaattctctgaaatcatatgcttcattccactattcttcaaggtgaatttctctgtagctgtttatagtcatattggtatgtggtgcatacatacatggatgaatataggaattagaaaaaagcataaggaaaatgcatgtgttttgatttcccattcaattgtctatttttctctctaatatttctaactattaagcatttcctagaatttcatacactaaaaatcctcaaaaatatgattatatcaaaacattcaaacctgaaaatagagaaatcagtcatgcctatatccaaaaartcttgacaccagacttaagaacaatagaattaattaaagaaaaaaatttagtttaaaaattaggttaaaattaagttactaagaaaattgttactgagtcaacggagttgaaaaacagtaaaactcgttattaaaaaatatcttgagaaaaagaaagagtgttttatcaactgaagtggtaattgacagaattaacagaagtttggagtgatttttataaaatctactttgttctcttttataatgtttacatttttctcagcaattgggctgattcgacctttcagcttttggatagac

SEQ ID NO: 179841 - DNA, 601 bp, Human
taaggaaaatgcatgtgttttgatttcccattcaattgtctatttttctctctaatatttctaactattaagcatttcctagaatttcatacactaaaaatcctcaaaaatatgattatatcaaaacattcaaacctgaaaatagagaaatcagtcatgcctatatccaaaaagtcttgacaccagacttaagaacaatagaattaattaaagaaaaaaatttagtttaaaaattaggttaaaattaagttactaagaaaattgttactgagtcaacggagttgaaaaacagtaaaactcrttattaaaaaatatcttgagaaaaagaaagagtgttttatcaactgaagtggtaattgacagaattaacagaagtttggagtgatttttataaaatctactttgttctcttttataatgtttacatttttctcagcaattgggctgattcgacctttcagcttttggatagactgggataatacagaatggttcattctcaaatgggtccttctcagtggaccaaaattgtgtatgagtcaacactgcacaggagtcaggggaacaaccaaacattgatctgacatctgcctttccagtt

SEQ ID NO: 179842 - DNA, 601 bp, Human
tgatgacttgctagcaggactcacagaactcagaaaagctgttatactcacaatgacagatttatagcaacagacgatagagtaaaatcagcgaaggaaaaagtgacagagagtccacacagaaaaagcatgaacttccaagtatcctctcccaatagagttgcatgaacagcacttaatcctcagcaatgatctatgacaactagaaagtattgccaaccagggaagctcacccaagccttggggtccaggttttttattgggatgatgggtcacataggcatggagctcccatacagcwggccttagttacttagtaaccagccttttgggagatcaaattgatacagcatggcccagagacctaggccagcaaaaataggcattcatcataaatcatgtttttagcataaactatctgacattgcccaggacccaaagaatacaatgacactcttattgggatattccaaggagttaaaagttatctctcaagagccagtcaaggggccaatcttctctttggaatgtgcaaggtctgagtaccctaagcctagtgagttaatactttactgcaaattgtaataaccaaagcattgtg

SEQ ID NO: 179843 - DNA, 601 bp, Human
ctcacagaactcagaaaagctgttatactcacaatgacagatttatagcaacagacgatagagtaaaatcagcgaaggaaaaagtgacagagagtccacacagaaaaagcatgaacttccaagtatcctctcccaatagagttgcatgaacagcacttaatcctcagcaatgatctatgacaactagaaagtattgccaaccagggaagctcacccaagccttggggtccaggttttttattgggatgatgggtcacataggcatggagctcccatacagctggccttagttacttagtawccagccttttgggagatcaaattgatacagcatggcccagagacctaggccagcaaaaataggcattcatcataaatcatgtttttagcataaactatctgacattgcccaggacccaaagaatacaatgacactcttattgggatattccaaggagttaaaagttatctctcaagagccagtcaaggggccaatcttctctttggaatgtgcaaggtctgagtaccctaagcctagtgagttaatactttactgcaaattgtaataaccaaagcattgtgtactgaggagaagtatgct

SEQ ID NO: 179844 - DNA, 601 bp, Human
gggatcccatttaacatcttttttctttatctgtaaaagaataaaggttatagtgaaaatttaatgtttgcaagggatttagaacagcatgcgacatatcataagtgctcaataaatgtcagctattgctgttgactgcatttccaaaagtctcaatctgccagtagcttactttcctccaattaaacagaattagtacagcaaagtggtaaagatcatgggtgctagaatcaggcaggtgcaggctcaaaccctggcaatgaaattgattacagagtagccttataccggtcaatttccrtgagccttagttttctcatctacaaagtggatagtgtaagtcctgaactgaaatgatcaaaacatttttaagcattataaattactgccaccaccaatccaacgtcagtatgtcaattacataagcatgaatgaaatgctttttcttaaaactatatcttaaaaccttgcaattctacagttctcacaaaaataaatgtcattttaaggaattgagtagtattaacttcgtcagtgaacatgtttaaacaacttttctgtgtcaggaaccatgttagtcaccaaagctaacttaaatttg

SEQ ID NO: 179845 - DNA, 601 bp, Human
gatcccatttaacatcttttttctttatctgtaaaagaataaaggttatagtgaaaatttaatgtttgcaagggatttagaacagcatgcgacatatcataagtgctcaataaatgtcagctattgctgttgactgcatttccaaaagtctcaatctgccagtagcttactttcctccaattaaacagaattagtacagcaaagtggtaaagatcatgggtgctagaatcaggcaggtgcaggctcaaaccctggcaatgaaattgattacagagtagccttataccggtcaatttccatragccttagttttctcatctacaaagtggatagtgtaagtcctgaactgaaatgatcaaaacatttttaagcattataaattactgccaccaccaatccaacgtcagtatgtcaattacataagcatgaatgaaatgctttttcttaaaactatatcttaaaaccttgcaattctacagttctcacaaaaataaatgtcattttaaggaattgagtagtattaacttcgtcagtgaacatgtttaaacaacttttctgtgtcaggaaccatgttagtcaccaaagctaacttaaatttgag

SEQ ID NO: 179846 - DNA, 601 bp, Human
agtagaggtattccgtgacctcaaagactgataaaattgtgagatatagtaacccctgtcctcactttctacctccaccaagacatgagcaatcaatgcatagtatatgttgaatgaatcaaccaattttggaaaaccatatgataattttcattctatgacctagattctaggtttaactctgaaaatgattagctatgtatataatccctattactctccagaaataataagcagaagtagtgacatctctgggatttctcactatgattgtgtatgtggtgtgtgtgtggctgtgcaggtgtgtgtgtgtgtgtgcatgtgtgtgcccctccacaaatatcctacctcgaagtgagttttctcacataataaatagctttatctcttctgcttattttgaagacttgttgagaatttcaaatgagctaatgtatttgaagttgcaatgaaaccctcaagtgaaatgcaagggtattataagattttatccctaaaggaaaccacagggaagcatattttataaaatgctgtattatgtaaaattgtgcaagtgagaggaatttcatgaggaagggaagaacgagatgcccaaccccct

SEQ ID NO: 179847 - DNA, 601 bp, Human
ctcaaagactgataaaattgtgagatatagtaacccctgtcctcactttctacctccaccaagacatgagcaatcaatgcatagtatatgttgaatgaatcaaccaattttggaaaaccatatgataattttcattctatgacctagattctaggtttaactctgaaaatgattagctatgtatataatccctattactctccagaaataataagcagaagtagtgacatctctgggatttctcactatgattgtgtatgtggtgtgtgtgtggctgtgcatgtgtgtgtgtgtgtgtgcrtgtgtgtgcccctccacaaatatcctacctcgaagtgagttttctcacataataaatagctttatctcttctgcttattttgaagacttgttgagaatttcaaatgagctaatgtatttgaagttgcaatgaaaccctcaagtgaaatgcaagggtattataagattttatccctaaaggaaaccacagggaagcatattttataaaatgctgtattatgtaaaattgtgcaagtgagaggaatttcatgaggaagggaagaacgagatgcccaaccccctaaaaggaatgaccgacttg

SEQ ID NO: 179848 - DNA, 601 bp, Human
cctcacagcccaggggcccttctgagcactgttgggcttgcccatttggtatggtcctccccacagggttctgctggcatgatgcccctaagagagaggaagccatcatcaaccagtctgctcagatttcagtgtcaaaagtttgtccagaaggactagcaggaattttccattgtgatgctgagaagttcagtgacgctaccagataccaacacttactctccttcatgccagccatggccatagctcctgctggctctccacacatgtccataagggcatatgggtgtttcttccatgkcccactgagtcaaggggagagttgatccattactgaagggtaccagagatagttccagcattatcagtccacaatcccagtggcctcctaaagctcaggctgtacaggactgagtggaaggacctctttaattatatagtgactattttgtcatttatcagctaactggaaaagtttattcccattcaaaacctactgagcacataaaagatttttgagagtatggggtatttgcagggatagatatcttcactgatgtcctgggatcctggactgtcctccaccttttcttttctctga

SEQ ID NO: 179849 - DNA, 601 bp, Human
ccagagatagttccagcattatcagtccacaatcccagtggcctcctaaagctcaggctgtacaggactgagtggaaggacctctttaattatatagtgactattttgtcatttatcagctaactggaaaagtttattcccattcaaaacctactgagcacataaaagatttttgagagtatggggtatttgcagggatagatatcttcactgatgtcctgggatcctggactgtcctccaccttttcttttctctgaggcagtttgactccttgtcacaaggccctgttctaagccccgkgactccttatcgatatgtacactgcatgatcatccattccaccacgaacctcagggtgtgtctggacttgatgataagaaataaggctctttggagtagctaggcctgagtatgcgcaatgctctgagatgctattctaatatttctctatgggatacagacatttagttctcaagtgaagagtatttttttcctttctgtactggagaaggatggaaatatagtgtaaagaagagggagggcacaggagaatacccagctaagagtaaggaaagacacctgctttggactcgtgtctct

SEQ ID NO: 179850 - DNA, 601 bp, Human
ctaaagctcaggctgtacaggactgagtggaaggacctctttaattatatagtgactattttgtcatttatcagctaactggaaaagtttattcccattcaaaacctactgagcacataaaagatttttgagagtatggggtatttgcagggatagatatcttcactgatgtcctgggatcctggactgtcctccaccttttcttttctctgaggcagtttgactccttgtcacaaggccctgttctaagccccgtgactccttatcgatatgtacactgcatgatcatccattccaccaygaacctcagggtgtgtctggacttgatgataagaaataaggctctttggagtagctaggcctgagtatgcgcaatgctctgagatgctattctaatatttctctatgggatacagacatttagttctcaagtgaagagtatttttttcctttctgtactggagaaggatggaaatatagtgtaaagaagagggagggcacaggagaatacccagctaagagtaaggaaagacacctgctttggactcgtgtctctgctggtctcttccatgcctgcacaccctctctcagtctgttcaat

SEQ ID NO: 179851 - DNA, 601 bp, Human
cagctaactggaaaagtttattcccattcaaaacctactgagcacataaaagatttttgagagtatggggtatttgcagggatagatatcttcactgatgtcctgggatcctggactgtcctccaccttttcttttctctgaggcagtttgactccttgtcacaaggccctgttctaagccccgtgactccttatcgatatgtacactgcatgatcatccattccaccacgaacctcagggtgtgtctggacttgatgataagaaataaggctctttggagtagctaggcctgagtatgcrcaatgctctgagatgctattctaatatttctctatgggatacagacatttagttctcaagtgaagagtatttttttcctttctgtactggagaaggatggaaatatagtgtaaagaagagggagggcacaggagaatacccagctaagagtaaggaaagacacctgctttggactcgtgtctctgctggtctcttccatgcctgcacaccctctctcagtctgttcaatgcaactaaaggctgactctgatccatgagggtgaggataaagcaggcgggatgtataaggattaagtacct

SEQ ID NO: 179852 - DNA, 601 bp, Human
agtttattcccattcaaaacctactgagcacataaaagatttttgagagtatggggtatttgcagggatagatatcttcactgatgtcctgggatcctggactgtcctccaccttttcttttctctgaggcagtttgactccttgtcacaaggccctgttctaagccccgtgactccttatcgatatgtacactgcatgatcatccattccaccacgaacctcagggtgtgtctggacttgatgataagaaataaggctctttggagtagctaggcctgagtatgcgcaatgctctgagaygctattctaatatttctctatgggatacagacatttagttctcaagtgaagagtatttttttcctttctgtactggagaaggatggaaatatagtgtaaagaagagggagggcacaggagaatacccagctaagagtaaggaaagacacctgctttggactcgtgtctctgctggtctcttccatgcctgcacaccctctctcagtctgttcaatgcaactaaaggctgactctgatccatgagggtgaggataaagcaggcgggatgtataaggattaagtacctaggctacaaatcta

SEQ ID NO: 179853 - DNA, 601 bp, Human
atttttgagagtatggggtatttgcagggatagatatcttcactgatgtcctgggatcctggactgtcctccaccttttcttttctctgaggcagtttgactccttgtcacaaggccctgttctaagccccgtgactccttatcgatatgtacactgcatgatcatccattccaccacgaacctcagggtgtgtctggacttgatgataagaaataaggctctttggagtagctaggcctgagtatgcgcaatgctctgagatgctattctaatatttctctatgggatacagacatttasttctcaagtgaagagtatttttttcctttctgtactggagaaggatggaaatatagtgtaaagaagagggagggcacaggagaatacccagctaagagtaaggaaagacacctgctttggactcgtgtctctgctggtctcttccatgcctgcacaccctctctcagtctgttcaatgcaactaaaggctgactctgatccatgagggtgaggataaagcaggcgggatgtataaggattaagtacctaggctacaaatctaggttgcttgcaagcccaggatgagggtgcaatttaagg

SEQ ID NO: 179854 - DNA, 601 bp, Human
ttcattcttgggtgagtattctatacttgcacaagattaagaggaaattctcgcttaaattttgtaccctgagcacctctcttactttatcctagtcctggcagtgactgcatgggtttaaatcttagttccactaacactgatgagcaatataacctgggcaagtctattggtccattttcatgctgctgataaagacatacctgagactgggtaatttataaagaaaaagaggtttaatggactcacagttccacgtggctgaggaggcctcacaatcatggcggaaagtgaaaggcaygtctacatggtggcaggcaagagaaaacttgtgcagggaaaatcccatttataaaaccatcagatttcatgagacttattcgctatcacgagaacagcatgggaagacttgcctccatgattcaattacctgctactgggtccctcccacaacacatgggaattgtgggagctacaattcgagatgagatttgggtggggacacaccaaaaccatatcagcaagttacttacacttcttgtctctcagttttcttatctataagatgggtatagtatcatctaccccacagcatgactgt

SEQ ID NO: 179855 - DNA, 601 bp, Human
gtgagtattctatacttgcacaagattaagaggaaattctcgcttaaattttgtaccctgagcacctctcttactttatcctagtcctggcagtgactgcatgggtttaaatcttagttccactaacactgatgagcaatataacctgggcaagtctattggtccattttcatgctgctgataaagacatacctgagactgggtaatttataaagaaaaagaggtttaatggactcacagttccacgtggctgaggaggcctcacaatcatggcggaaagtgaaaggcatgtctacatggyggcaggcaagagaaaacttgtgcagggaaaatcccatttataaaaccatcagatttcatgagacttattcgctatcacgagaacagcatgggaagacttgcctccatgattcaattacctgctactgggtccctcccacaacacatgggaattgtgggagctacaattcgagatgagatttgggtggggacacaccaaaaccatatcagcaagttacttacacttcttgtctctcagttttcttatctataagatgggtatagtatcatctaccccacagcatgactgtaaggataaaga

SEQ ID NO: 179856 - DNA, 601 bp, Human
atctataagatgggtatagtatcatctaccccacagcatgactgtaaggataaagaattaggcaaatgcttgtgaagaatagttcagaaacctagtaagcatctgaaatactattctcttgccattggaaggcaccactaagaatagcctcattcagtttactgaagatgataccaggaatttcaaactggcaacaacaacaacaacaacaaagacatcacaaataggcatgaaacaaaataccttttctgacagctacataactctgacacactgtgcctaatagaaaaacatcacaccrcctccttttccctgcagtgatcatggttgtgtcctgaatcgccatcctgattaccttgatctttaacaagaaaacagctggttttcttttatctcctagaagttcaaggagaggcagaagtgacatgaaagcttgggatcaaacactcaagagcccccaagacaccttatcacttgtacttaagtcgcataagaaggtgaaattaccaagccacatttaggcatatttaaagaaataatgagctccaagatgagggaccacactgaaaataagaaggcattttatattcattcactccaa

SEQ ID NO: 179857 - DNA, 601 bp, Human
gccatcctgattaccttgatctttaacaagaaaacagctggttttcttttatctcctagaagttcaaggagaggcagaagtgacatgaaagcttgggatcaaacactcaagagcccccaagacaccttatcacttgtacttaagtcgcataagaaggtgaaattaccaagccacatttaggcatatttaaagaaataatgagctccaagatgagggaccacactgaaaataagaaggcattttatattcattcactccaaagaagcaaatctctcatttttaatctccacagttaggggtkacaggaagggaggggggaatgaatcagaaaccattgtcaacattgtgctcatcctcttttgtctcctgagtcaggatgtcatatgctacctttggcagggtgtaggtacctacagagaagatggaatggggtaaccagaagcaatgcctcagcctgctggaggactggcactgaggaaattctgagacaacctaaaacatgcaaaagagaaagtgcacgtgttttttcagatgagtgcataactgaacaaaattttgcaagtatcaggtttcattaggaaacatgaaataaggaacttgg

SEQ ID NO: 179858 - DNA, 601 bp, Human
aagagcccccaagacaccttatcacttgtacttaagtcgcataagaaggtgaaattaccaagccacatttaggcatatttaaagaaataatgagctccaagatgagggaccacactgaaaataagaaggcattttatattcattcactccaaagaagcaaatctctcatttttaatctccacagttaggggttacaggaagggaggggggaatgaatcagaaaccattgtcaacattgtgctcatcctcttttgtctcctgagtcaggatgtcatatgctacctttggcagggtgtaggtrcctacagagaagatggaatggggtaaccagaagcaatgcctcagcctgctggaggactggcactgaggaaattctgagacaacctaaaacatgcaaaagagaaagtgcacgtgttttttcagatgagtgcataactgaacaaaattttgcaagtatcaggtttcattaggaaacatgaaataaggaacttggtccccaaatttcccccgctgcttcttttttttttttaagttattctcactttgtaaagaagttccaaaactagagtcagaaaaaaaaaaatgaaaagaagcaagtcag

SEQ ID NO: 179859 - DNA, 601 bp, Human
cagaaaccattgtcaacattgtgctcatcctcttttgtctcctgagtcaggatgtcatatgctacctttggcagggtgtaggtacctacagagaagatggaatggggtaaccagaagcaatgcctcagcctgctggaggactggcactgaggaaattctgagacaacctaaaacatgcaaaagagaaagtgcacgtgttttttcagatgagtgcataactgaacaaaattttgcaagtatcaggtttcattaggaaacatgaaataaggaacttggtccccaaatttcccccgctgcttcttttttttttttaagttattctcactttgtaaagaagttccaaaactagagtcagaaaaaaaaaaatgaaaagaagcaagtcagcagattgaatttatggggtgaagaccaaattcatcacaggaggtaaacttcctgagcagaggttgttgcatgtgcggtaatttctgataactccacacactgttgggaatcagtaagcttttcagacacatgtttccagctcactgcctttcagtgtatggggctgactagataaaggggaagagttaaagaacatatgaaacatgatagagtatgt

SEQ ID NO: 179860 - DNA, 601 bp, Human
taactgaacaaaattttgcaagtatcaggtttcattaggaaacatgaaataaggaacttggtccccaaatttcccccgctgcttcttttttttttttaagttattctcactttgtaaagaagttccaaaactagagtcagaaaaaaaaaaatgaaaagaagcaagtcagcagattgaatttatggggtgaagaccaaattcatcacaggaggtaaacttcctgagcagaggttgttgcatgtgcggtaatttctgataactccacacactgttgggaatcagtaagcttttcagacacatstttccagctcactgcctttcagtgtatggggctgactagataaaggggaagagttaaagaacatatgaaacatgatagagtatgttactatgttagctctccgagcatttgctaaacaaatgcatgctaggagattatacattcccactcaacaagcattactggaactccactacataagtaatattaacttggcatcttaagggataacacccttgaaaagtagaagaggtggcttctgccacctagtaatgtaaattctacatggcagaggattgacacgcttcattaaagcttttt

SEQ ID NO: 179861 - DNA, 601 bp, Human
aggtttcattaggaaacatgaaataaggaacttggtccccaaatttcccccgctgcttcttttttttttttaagttattctcactttgtaaagaagttccaaaactagagtcagaaaaaaaaaaatgaaaagaagcaagtcagcagattgaatttatggggtgaagaccaaattcatcacaggaggtaaacttcctgagcagaggttgttgcatgtgcggtaatttctgataactccacacactgttgggaatcagtaagcttttcagacacatgtttccagctcactgcctttcagtgtwtggggctgactagataaaggggaagagttaaagaacatatgaaacatgatagagtatgttactatgttagctctccgagcatttgctaaacaaatgcatgctaggagattatacattcccactcaacaagcattactggaactccactacataagtaatattaacttggcatcttaagggataacacccttgaaaagtagaagaggtggcttctgccacctagtaatgtaaattctacatggcagaggattgacacgcttcattaaagctttttcttatacctcaggataaaacatacac

SEQ ID NO: 179862 - DNA, 601 bp, Human
ggtatgctattgtgtttgtttccacgtctatctccaagctatgcgttttcagtctcaattccctagttcttgcacaatgctggacatagaataagcacccaataaatacatgccaaacaagtgaatgaattgatgaatgaattaatgaatgaattagcaaaggaaccgaagaacacacacaatctataagcatgtgcagtgcttcaggacacactgtgttcataaaaatcatatccagaaacaattcaataagacagagtcaggagctggactagacctgtccaccagggccataggtttygataggagagtgaggcagggatttagggaaagaccaacctatttaactctggtgctgggaacacagattctgagatttcatcacactttgctgtcagtgtgaacttagtcaagtcatttagcttgtttctcagttcctccttctataacatgggtaataaaatgcccacaccataagtttgtagggattacatattttatatgtatagcctagcaaaatatttgtcatgtagtgattgtttaatgaaggatagctaccatcaaatgaaaggttctgttaaaaaatgaaaaacagttttcc

SEQ ID NO: 179863 - DNA, 601 bp, Human
acctatttaactctggtgctgggaacacagattctgagatttcatcacactttgctgtcagtgtgaacttagtcaagtcatttagcttgtttctcagttcctccttctataacatgggtaataaaatgcccacaccataagtttgtagggattacatattttatatgtatagcctagcaaaatatttgtcatgtagtgattgtttaatgaaggatagctaccatcaaatgaaaggttctgttaaaaaatgaaaaacagttttccattttcaagaaaaggaagtctattggagtaagattgyagttagattaacaccttttcttgaaatgaacttacagaaaaaatgtacatgtataattcagtccactgtatcctcctttgaactagttttacctgcttgttttctcatgcataaatatttatgtttctttgacatatttatgtgaggattatgtttttaatattctaacatcacaaagtagccttttgtttctgtattgcactttacgggtaattgttattttgccacctctttgtacaactgatatggtttggctttgtgtccccactcaaatctcatctcgaattcatatcctcacgt

SEQ ID NO: 179864 - DNA, 601 bp, Human
ggagtaagattgcagttagattaacaccttttcttgaaatgaacttacagaaaaaatgtacatgtataattcagtccactgtatcctcctttgaactagttttacctgcttgttttctcatgcataaatatttatgtttctttgacatatttatgtgaggattatgtttttaatattctaacatcacaaagtagccttttgtttctgtattgcactttacgggtaattgttattttgccacctctttgtacaactgatatggtttggctttgtgtccccactcaaatctcatctcgaattsatatcctcacgtgtggagtggggtacccataatctccaagtgttgaaggagggaggtgattggatcatgggggcgtttcccccatgctgttcttgtgatagtgactgagttctcaagagatctgacggttttagaaggggctcttcccctttcgctttctcctctctctcctgctgccatgtaagacatacctacttccccttccgccatgattgtaagtttcctgaggcctccccagccatgcagaactgtgagtgagtcaattaaacctctttcctttatttaaaaaaaaaatgtcta

SEQ ID NO: 179865 - DNA, 601 bp, Human
ccactgtatcctcctttgaactagttttacctgcttgttttctcatgcataaatatttatgtttctttgacatatttatgtgaggattatgtttttaatattctaacatcacaaagtagccttttgtttctgtattgcactttacgggtaattgttattttgccacctctttgtacaactgatatggtttggctttgtgtccccactcaaatctcatctcgaattcatatcctcacgtgtggagtggggtacccataatctccaagtgttgaaggagggaggtgattggatcatgggggcrtttcccccatgctgttcttgtgatagtgactgagttctcaagagatctgacggttttagaaggggctcttcccctttcgctttctcctctctctcctgctgccatgtaagacatacctacttccccttccgccatgattgtaagtttcctgaggcctccccagccatgcagaactgtgagtgagtcaattaaacctctttcctttatttaaaaaaaaaatgtctaccatgtaaggtagtggtcaggaaaaataaggcaacacctaggaaacattaagtatattgccaaacatattataag

SEQ ID NO: 179866 - DNA, 601 bp, Human
acgaagccaggaaatgaggactttcaatcatagaccacacacatgattgttcaagaaaggtgaaaagacattaggcaaaaattcacctcaaccaaggctgagtttcttggttcgtttgggctgctgtgacaaaataccataaaccaggtgtcaaataacagcagaaacttactagtcatagttctgcaggctgggaagtccactatcaaggtgctagcagaatccgttgtctggtgaaggctggcttcctagttcatagacagctgtcttgcactttgtcctcacatggtgaaaggggcamggaatctctcaagggcctcttttataagggcactagtgccatccattcacctcccaaagcccccacctcctattaccattgtcttgagggttagaatttcagcacatgaattttaggggtaaacaaacatttgaactacagcatgagctaccagaataccatagcaagctgcttctcaggtcagtctgggaaatggtagctgaatgtaggggccgaggaagccaagaattacgctgtgtccagattaggttccagctggatataggacaatcagtggagcagctgtggtagcagcaagca

SEQ ID NO: 179867 - DNA, 601 bp, Human
ctaagtttaaattcatccagtcacctcccttctggaaatttccacttggtgattctgctgctacctccatatcaacaaattctccatcaggatatattatttttttgcctgttaaatctattattgttaaaatagctccactgtcagataacgacaatgcaactggtatatcaaacaaacacaactactgaaacagcaaagccaattctatttttaatctcccctcctacttaaaattattcagtagaatgatctgggcaaatctcatgacttttttgttgacttaaggtaatgacagtcytagagcttccttatgttaaagcacagcctcaacttcatgattagaatatccagtctaagatattaatcaaaagtccaagttgatttaacatcaaatacctcccctctctgagactgatccttctggaagactagtgacatgacggaggggggatgaatgccttctcctctttctcctttccctgtttacttcctcccaactcctgtggctgttgtgccttctactaggctcaaaaataaacaggacagatctcgctgggctgggctgctctgtgctttctgggcttagcagacagtttaa

SEQ ID NO: 179868 - DNA, 601 bp, Human
ccgtaagatctttctgtgggacagaaagtcaatttatctttgtgtcctcagagcaccgtgcctgtacacggcaggcattttaaaagatgcttattgaactgaagccagaaagttaaattctagcaaattcttaacacattttgctaaactaatactcaattttaaactatataaatagttcctaattgatctgctccaaaataaatttactgcataagaatgaaaaattatttctaaatatcagtgcttatgggatgtcactgagaggtatatgaaatatgggcagttttctgccactgcyttgctatgaaaaatgtaatttatggttctattttgatgaaatggagattatacatttgaatatataaacctaatatttgaattcaagcttttaaaaatcaaagagtaaaaaataaaattattcatttaggcacctacctgtgcttaatatttgtttggatttttacttagtaggtcactatggagtggggtttttgtttgtttggttggttggttggctgattttgtatgggatctgggtaaaaaattacagtattgaaaataaaaaagtccctggtgaaacgtaagctctgacatattt

SEQ ID NO: 179869 - DNA, 601 bp, Human
atttccatttctatttctcattctgcacctcttgaaagttagctgcattctgacccctcattcttcagcatccctagctagtcttcactgtgtaaaagaaagccataaatcccagcagcccctcacatttaggatatttagacctaaggaagagtgggtttttaggtccttccctcaattccctgtacaactctggatggataaaatagattagtttctaaaggttcatcgtttatatttttaccaattacataggttttgtcttatatataaacatcttagtttgtttgcattataatakcacagcacctgagactggctaatttataaagaacagaaatttatttatttatttatttatttttattttattttattttagagacagagtctcactctgtcaccaagctggagtgcagtggtgcgatcttggttcactgcaatctctgcctcccagtttcaagcgattctcctgcctcagcctccgagcagctgggactacaggcgtgcgccaccacgcctggctaatttttgtatttttaatagagatggggtttcaccatgttggccaggataatctccagctcttgacttcatgatc

SEQ ID NO: 179870 - DNA, 601 bp, Human
gactggctaatttataaagaacagaaatttatttatttatttatttatttttattttattttattttagagacagagtctcactctgtcaccaagctggagtgcagtggtgcgatcttggttcactgcaatctctgcctcccagtttcaagcgattctcctgcctcagcctccgagcagctgggactacaggcgtgcgccaccacgcctggctaatttttgtatttttaatagagatggggtttcaccatgttggccaggataatctccagctcttgacttcatgatctgcccacctcagctcctaaagtgctgagattacaggcgtaagccacgtgcccagccagaaatttatttcttacagttctggaggctgagaagtcccagataaaggtaatagcatccagtctctggcgagggctttcttgctgtgtttccacatggtggaaaagcaaaatggcaaaaagggcctagctaattccctccagcccctttataagattcctaacgccattcattaaggctccagcctcatgacttaatcctttcctaaaggccccacctcttaatactgtggcattggagattaagtttctacatga

SEQ ID NO: 179871 - DNA, 601 bp, Human
aaagatccaagtagagggaacaacttatgcattgaatacacatcagtgtacttgtccaatcccttctgcatggatattttggctgcctcttttttttttcctgcacattcacacaatgcttcattacttaattacttaaattgaacatttaagtaataggctctcatgcacaaatccaagatttgctctagagaagcactgttgcattgtccaataaaaagataatgtgagttgcatatatattagagtttttagtagccacattgaaagtaaaagacaggtggaattaattttaataacwtattttatttaacccagtatatccaaaatattagcatttcataatgtcatcaatattcaaattattaatgagcaattgtactttttttcataagtctttttaatccactgtgtcttttacacttatggtacatctcagttctgactagccacatttcaagtgctcaacagccacctccagctaccataatgaacagctgtcttagcttgggctgctataacaaaatcctttagactgggtggcttaaacaaaaggcatttatttctcatagttctggaggctaaaaagtccatgatcaaa

SEQ ID NO: 179872 - DNA, 601 bp, Human
tccaaaatattagcatttcataatgtcatcaatattcaaattattaatgagcaattgtactttttttcataagtctttttaatccactgtgtcttttacacttatggtacatctcagttctgactagccacatttcaagtgctcaacagccacctccagctaccataatgaacagctgtcttagcttgggctgctataacaaaatcctttagactgggtggcttaaacaaaaggcatttatttctcatagttctggaggctaaaaagtccatgatcaaagtgccatcatggtcaagttccrgtgagggccctcttcttggcttgtagatggttatctttccattgtattctcacataataaagagaagcagcactgctgtatgtctcttcttacaaggacactcatcccaccatggggactctacctcatgacctcatctaagcctaattttcatctaaagacctcacctgctagtaccatcacattgggggttatggcttcaacatataaatgtgggggtacacaattattcaatctgtaacaacaacccagcttgagaccatacacctagaagtaggactgctgcttgtatgcattttt

SEQ ID NO: 179873 - DNA, 601 bp, Human
catggggactctacctcatgacctcatctaagcctaattttcatctaaagacctcacctgctagtaccatcacattgggggttatggcttcaacatataaatgtgggggtacacaattattcaatctgtaacaacaacccagcttgagaccatacacctagaagtaggactgctgcttgtatgcatttttagctttaccagcataatagtttcctattgctgcataaaaacttaccacgaactggctaggtgcagtagctcaggcctgtaatcccagcgctttgggagactgaggtggtcrgatcacttgagttcaggagttctagaccagcctgagcaacatggtgaaaccccctctctacaaaaaataaaaaaacaaacaaaaaaaattagctgggcatagtagtgcatgcctgtggtcctagctactcaagagggtgggaggatcacttgaacccgggaggcagaggttgcaaacagccatgatctcgccactgcactccagcctaggtgacagagagagaacaagagagcctgtctcaaaaacaaaaacaaaaaacaaaacaaaacaaaacaaaaacacacacacacacacaaacta

SEQ ID NO: 179874 - DNA, 601 bp, Human
aacaaaacaaaaacacacacacacacacaaactagggatgttaaaacaacaatcatttattatctcagtttctgtagatgagaagtctggacaaatttgctgtgttctctgctcagggtccacgaagctgagaagggtgttggctggggctgctgcagtctcattctaggttcaaggtcctcttccaagctcacgtagttgttggaagaattcactttttgcagacattattggcagcttgttcccttaagaccagaagagagcaaatctctgttttctaaatccctttttattaaagaamtattttgattaggtcagccctcccctgcaggataatcgtactttttattaagtcaaagtcaattgattacagatacctaattgcatcgcaaaacattcctttccctttgccataatcaatagaatgacacccaccatattctcaggtcccactcacactcaaggggagggaattacaaagggcataggtcacagaggttcatctcagaattctgcctaccacaactatatagtgtcaaatttctccatactatatttttctgttgcttcatggagatccctggctttatgttccctccat

SEQ ID NO: 179875 - DNA, 601 bp, Human
gcagttccacctcatggcaaatccacggtgtccaacagtagctaggctcctagggccacctctcaatccttttacttgtgtctactcatctcttccattcccctcggcaatttattatttcactgggccacaattcaaactttactaccttcattctcaacttactgccaacttatgtgagaaaattggccaggcgcggtggctcacgcctgtaatcccagcactttgggaggccgaggcaggcagatcacaaggtcaggagatcgagaccatcctggctaacacggtgaaaccctgtctytactgaaaacacaaaaaattagccgggcgtggtggcgggcgcctctagtcccagctactccggatgctgaggcaggagaatcgcttgaacctgggaggcggagtttgcagtgagctgagatccgccactgcactccagcctgggtgacagagcaagactctgtctcaaaaaaaaaaagaaagaaagaaaattgaacttagtaggtgtgaacaccttcaatttccaacaacccatttagcaaacttttttcatgcccattctctttctccaaaatcacaggatgagacattgtgccttttc

SEQ ID NO: 179876 - DNA, 601 bp, Human
gagaaaattggccaggcgcggtggctcacgcctgtaatcccagcactttgggaggccgaggcaggcagatcacaaggtcaggagatcgagaccatcctggctaacacggtgaaaccctgtctctactgaaaacacaaaaaattagccgggcgtggtggcgggcgcctctagtcccagctactccggatgctgaggcaggagaatcgcttgaacctgggaggcggagtttgcagtgagctgagatccgccactgcactccagcctgggtgacagagcaagactctgtctcaaaaaaaaaaaraaagaaagaaaattgaacttagtaggtgtgaacaccttcaatttccaacaacccatttagcaaacttttttcatgcccattctctttctccaaaatcacaggatgagacattgtgccttttcctcagtgtctacttgtgctgctgtccatcttttttcctctgctaagaatgccctttctgccactccctcttcttctatgttggactaaacccaacagctcagctcaggcatcacattttccagaaagcttttgcaaatagacacacacacacacacacacacacacacacacacacac

SEQ ID NO: 179877 - DNA, 601 bp, Human
acacacacacacacacacatttctcctttcctcatttatccaaaactacactgtgtatatcttcaccattgcatttttatcattgtactataaatacatttctatgtgtctacctctccagtacgcattgcatttcttggaaacaagaactgttaaattcattttattcacttagtacctagctctcttcctgcatatagtaggggctcaataaatcttggtgactaaataaataaatatttctttaaatataatatctcactcaaccagactaactagagcaagacatgaattcaacccmtgtggaatccattgttcatcttcatagataaaccatccataaataacatattgtttacctataatgataggcatctgggcaacaaagacaattatatgattaatatgatcaaagtaatttgagtaatttgagactgactaatctgatttttgggttttattgaccacattatctagctaattagacaagagccccattcccacccacttcacctatatgaatgtctcaggtttgtgatcctgcccatttagttgatttgcatgtacagaagccaatttattccatttcagaaaacaagcc

SEQ ID NO: 179878 - DNA, 601 bp, Human
tctgagaactgacttaaaattgtgggtgacctgacatggattacattgcttagatgaagggtgaatttcagatatttgtcattgtacagtactctgtggacctgagaaagacagtaattgtacagttattccatcagggctatgtttatacaatagatactgagtgagccttctttaattaaaaacaaatgaaataatgccatgatgaattgcatctaagtcttctattcaaaagtcaggactaagtataaacaaatttttgaaatccataaaatgccttctctgttctcttttccttttrctatattccccaagggtaccttggcctcttgatcttactctcagaaattctatactaaagtgttaacaaaaggaaagtttgttaaccaaatgaatgattaccttaattaatgagttattaattcatgtttaaaggtgtcactcctctcctgcacattcacaggccaatagggaattcctaaacttggaaagccttcaaaattcaaagaaaaatctcataagagttgaactgaggtgtaagaactgatttgggaatgcacaggaattgagtctgactgccccttcagttccaccaccaaag

SEQ ID NO: 179879 - DNA, 601 bp, Human
aacagatatgggggagtgcttgtcagggacaatagagttcttccacctcagtacttaagttactttaaaaccttctcagaggacatgagggttggcctcagctttggaggatgaattggagagtggcaggcagcatggtggggaagaacactccactcttgggaactggttggcggctgaatgaagtatggtaagaggttaaatggtatcagcagaggccagataatcaagggccttctatgctctactaaggatccagaacaattctgtgggccagagattctcacaattaagtgtgcaycaaatcacctgacaaaacctctgaaaatgaattacttctcacattcacttcccagaaacttagatgatcttatgcaagtttgagaaagattgcattttaggcattaagataaagttaattatgttgcccgtcctctacccctgtataattcaatataaccaatggcgtgaggtatatattacgatgtgctttatattgcattattcacaagtaaagcttcataacaatccacagtacggaagatattaatagacacatcaattaacttaaggcaaaataaacatggcctcgtgccctcca

SEQ ID NO: 179880 - DNA, 601 bp, Human
tcaagggccttctatgctctactaaggatccagaacaattctgtgggccagagattctcacaattaagtgtgcaccaaatcacctgacaaaacctctgaaaatgaattacttctcacattcacttcccagaaacttagatgatcttatgcaagtttgagaaagattgcattttaggcattaagataaagttaattatgttgcccgtcctctacccctgtataattcaatataaccaatggcgtgaggtatatattacgatgtgctttatattgcattattcacaagtaaagcttcataacratccacagtacggaagatattaatagacacatcaattaacttaaggcaaaataaacatggcctcgtgccctccacatgtcagactacataaggatctaacagagcaacacagacctgctatgagctcaccctgaggaacaggaggtagtgagaagggaagaagaaaggcctggatcaaactgttctttctccctaatttccagaacagcaggagagtcagagacgtgagctggagagtggatgggtcttgcagagaaggagggcaagccctctccactaacctcacaccattccttcttg

SEQ ID NO: 179881 - DNA, 601 bp, Human
tgagtcaccaaagtccgttgaatcattatttttttttcttttttgagacagtctcactgtcattcaggctggagtgcagtggcacaatctcggctcactgcagcccctgcctcttgggttcaagcaattctcctgcctcagcctcctgagtagctgggcctacaggtgcacgctgccagacccggctaatttttctatttttagcagagacgaggtttcactatgttggccaggatggtcttgatctcctgacctcgtgatctgcccgctttggcctcccaaagtgctgggactacaggcktgaggcatcgtgcccaacccattgtatcattcttttttttttttttttttttgacggagtctcgctctgttgcccaggctggagtgcagtggcacaatctcggctcactgcaagctccgcctcctgggttcacgcttttctcctgcctcagcctcccgagtagctgggactacaagcgcccaccaccacacctggctaatttttgtatttttagtagagacggggtttcaccttgttagccaggattgtcttgatctcctgacctcgtgatctgcccacctcggcctcccaaagtgctgg

SEQ ID NO: 179882 - DNA, 601 bp, Human
agttaatcaggagaagcagacaagtaagcaatcgatttcatgcagccatgtgtacattaatagggataattgcaggaaactatgggaaccctaggaagaatgctaaccctgtctctgaagtttaggtaaggcttcttggaggaagaaatatcaaagatgaaaggtgaaggacaattagagattatcaaggtgacactaagggacactaggtcatcctaagcctttcagtcagggtcaatgtgataaactggaactgagagattaatgagaataagtagtatcacatgtcaaatgccacagracaatggaaaggatatgcaaatgcaaatgagcatggagcaataaagaataaacagactttaaataaacatattctaaatcaaataagccattgcaaatcctcaacactggtctatacaatagcagcccagaaggcccttcagcatgccgtttggcctgaaatgcattaaggatgcagaggaaaatatttgaatctgatgtcacactccaggcctctgtcaatgtgacatttttaaaatactaagcaaaatattgatggcagatataaaatggtctctattccctatgctaatgaattgac

SEQ ID NO: 179883 - DNA, 601 bp, Human
ccatcttttatcactggtttttacttattataaaatgttttatacaatgatggctgatagcaaattttgctccacaccaagagagagaatgaaactaagctggatctaaatgagaacaagcccaacctattctaattaacatgattccattgaactgtaatgttattgaaacaactgacttttaccatttcaacttaattattctacaataggcagaatgtatgttgcttcatgcttaaagcaattttgaaagcgacatctttgaagtatggcatcaagcagttttttttctcactcacartttgtgaatattgttttaaaacatcattaagtcaaataaccatagtctaattaagtcttttgtagttttgaggcggtttcatgaaatgccacgggatttatttgactcttttcctcacttgactgaaagttcttgagaggctgagtgaattgaagccccagaatcctcagcctgaggaaataaatgctgaaaagtatttgagttgaagtagtattgcttaatgtgatgatagaaacacgaaactgaagggcttgctcagcaattctgctaaaatatcacgatattacttaggcaagccct

SEQ ID NO: 179884 - DNA, 601 bp, Human
accaagagagagaatgaaactaagctggatctaaatgagaacaagcccaacctattctaattaacatgattccattgaactgtaatgttattgaaacaactgacttttaccatttcaacttaattattctacaataggcagaatgtatgttgcttcatgcttaaagcaattttgaaagcgacatctttgaagtatggcatcaagcagttttttttctcactcacagtttgtgaatattgttttaaaacatcattaagtcaaataaccatagtctaattaagtcttttgtagttttgaggcrgtttcatgaaatgccacgggatttatttgactcttttcctcacttgactgaaagttcttgagaggctgagtgaattgaagccccagaatcctcagcctgaggaaataaatgctgaaaagtatttgagttgaagtagtattgcttaatgtgatgatagaaacacgaaactgaagggcttgctcagcaattctgctaaaatatcacgatattacttaggcaagccctattcctgtctttgtgctcagatgggcacagctgcaaaaggattagttaagaagttgtaagtaaatgagcacttgg

SEQ ID NO: 179885 - DNA, 601 bp, Human
agaaagaaagaaagaaaaaaaggaatagtgggccatgaaggcaaatggtgaatgcacactacacctgctcttaaggaagccatcatcatctggaggaaaatgcacacaacaaactgtaatacaagactgctatgatgtgggttataatatgatatattaataaataaaatactagtaaaccccaaagaaaaaaactatgcattccatccaaaagggttcggaacagcttcggagaggaggtgacatttgaattgaccttgatagattctatcgctcattcaacaagaacttagttaggatktactagttctgcgaaccgtccttatttgttgggatatattagtgtacacaagagatacccatccctgcctttgtgatgctcgctttctatcaagtaaggtttctaaaaatttactgggggagagaatttttagggagagagagtactgggaacaaattcgtgaattattatgtgcacaaagtctggggaagcatctacatagttggaacacaaagtttatgtgtagtagctattggggcagaacatggcagtagatggaggtggaaagcacagcagggaaaagtcataaatagtatatta

SEQ ID NO: 179886 - DNA, 601 bp, Human
gaaactccgtcccaaaaaaaaaaaaaaaaaaaaaaaaaaaagagggattttattctccaggcaattaaaaattttgttccaggaaagtgctcttatgaagaatctgaaacacaaagcaagttataactactgtttattgttgccatgctgaaacactggaaaatgcacagagatcagcgtaaatgcctccaggactgacgggatgcaggaggtcctgggccatgggtacagccctggtacttacaggcctccttcagatccatattaatgtatgagctttggattgctatggttgtgccakggaatctatcaccaggctagtgctccatttaggaaacgatgggggaaaaaaacttggtttgaggccatgctaggggttgttatctaaatccccagagaatgacctatgaggatatggtgaccccaagaataattataacaactaggatctttgggggcaaacctatttttttcagggcaagcagtctttgaaaagactcagcagatctcccttgcctacaatatattaaaaaccattttcccatagcaatctgtattttgcctgaaaatcctctagattatagggttatgggatccaata

SEQ ID NO: 179887 - DNA, 601 bp, Human
acaatatattaaaaaccattttcccatagcaatctgtattttgcctgaaaatcctctagattatagggttatgggatccaataagtacatgcccaaccatatgatgagagcatttcaacattccaataactatactgaaataaacaaatatgcagtttgtcagaccttgtttatcatcaatgactaactcaatgttttcatcttctcctaaaaactacattggccatactagccacagctcactttcccaattttataagacttttattagtgttactatttacctattaatttcctgtayatgggtggtggatggatagatagatagataaataccttaatcatcagagtaaacttcttcagaactgtaatcagaccccaagcttaataactggcttgaagttgtctggtgggattggtcagcaaacatgagtatcagacaaagatctatggagctgacaagctttgagcccttttccagtgattcttatggtgtagtgtgaggatcttcttttttaaagctaactaaagtacttatttaaaaacagtgttccaatgattttgtgctcatttaaaatgtaaaaaccactgcactatatta

SEQ ID NO: 179888 - DNA, 601 bp, Human
gcaattaaaatgctatttaagtagcattttaaattactattgttatgctgaaagtgtcttgtttacaatgtcaggtttatgactaaaatttgtttgtaaacaatatgtgaaaatcaatgcatagcctattagcggtatttttaaaattgtaaatgcaatgtgattctttttggtgaggccaatagaaacatattaatttactgtttatattaaattatcctgttttatctcaatctttctgttttccatacagcttttcaaatcacaaagtaattctatcatggattgccgtgtgatgtgytttataaaagccaagcatcattgatatctcagaatactagaaaaggagatattttgagttggtgagaaatgaatgcactgacaatgtactgaagggaagagaatgtagggcatattcaagaagtttcaatgtggggagagttgtgtgactagaggtaaaggactttaaaacatgctttactgtctcacagttaaatctgaagtcagcaaaagtcacccacacttatggtaatgtggtaactctatgagcagaaacacacaagtaatccaaaacagaaatcctagaaggtaaaaccgtcct

SEQ ID NO: 179889 - DNA, 601 bp, Human
tttcatttctttcacatcatctcattgatggaaatgcagtttggtgaagaaaaagaacatgagatagactggttctgaacccctctgggtacatcttactaactttaggatctctttcctctcaataaactggggaccatcctacttaccttatctagatgctgtaaggaccaaatgtgattacatttatgccactttgcatttgtcagtatataattttataaagttatcaacacgactctcatgcaaacataatgtaagcatgtgccaaaaatacacttaactccttaatgaaggaacsatctggatggtaaatctagttcaaaaaagaatcacagaaagagtggttatatagtccaacaggagaagctaatggaaatgaatatctgagttaaagacaaaattgattattgttcaacaagcaataaaaccataacctttgaggtcatcttctgtactagacttgcatcagttaggtctctgttgaacaaaaaatatctaagtccacatgtaatttcatagtcttgaccttagacaatagaaaatagtaaaacaaacaaaagtacaatcctctagaggattaaatcatccttgggtggac

SEQ ID NO: 179890 - DNA, 601 bp, Human
gggtacatcttactaactttaggatctctttcctctcaataaactggggaccatcctacttaccttatctagatgctgtaaggaccaaatgtgattacatttatgccactttgcatttgtcagtatataattttataaagttatcaacacgactctcatgcaaacataatgtaagcatgtgccaaaaatacacttaactccttaatgaaggaaccatctggatggtaaatctagttcaaaaaagaatcacagaaagagtggttatatagtccaacaggagaagctaatggaaatgaatatgtgagttaaagacaaaattgattattgttcaacaagcaataaaaccataacctttgaggtcatcttctgtactagacttgcatcagttaggtctctgttgaacaaaaaatatctaagtccacatgtaatttcatagtcttgaccttagacaatagaaaatagtaaaacaaacaaaagtacaatcctctagaggattaaatcatccttgggtggacctgttaggcaatgatcccatgtgactttgaaacgaaatacagtcgttgttcttttgttttatttccaagttttagataattttctc

SEQ ID NO: 179891 - DNA, 601 bp, Human
tttctcagcagttccctattgtgtcataaataatttccaaagattattcatattaccaaaagtctgatgtcattgtgcttagacctgattaatttacatgggggcagtgcaagatgttcattgaccatggaagcctctggatatgggtagcaaattcagagctgctgtttcaagcagctactaaggacagaaaattaacttctgtaagaaaatttcaaaagaaatctctcattgcattttcagaatcctttctccagaattttttttttctcttactggcttttttattccaaggtgtttkagtttcctattgctttttaggtgaattaccacaagcattgtcgttcaaagcaacacaaattaattctcctactgctttggcagtcagaactctaacacaagtctcattgggctaaagtcaagatgttggtaaggccgattctttctggatgctgtagagggaaatcagttcccttgcctttcacaaggtccagggattcctgtaatccttggcttatggaccctttcctccatcctcaaagccagcaatctttcaattgaaagtagcatctttcaatttttcagtctctttctctctgtc

SEQ ID NO: 179892 - DNA, 601 bp, Human
ctcctactgctttggcagtcagaactctaacacaagtctcattgggctaaagtcaagatgttggtaaggccgattctttctggatgctgtagagggaaatcagttcccttgcctttcacaaggtccagggattcctgtaatccttggcttatggaccctttcctccatcctcaaagccagcaatctttcaattgaaagtagcatctttcaatttttcagtctctttctctctgtcttctatttctgtcatcacatcatcttctgtctctctgacccttcctgggtcccttttataaggacyctgtggttacattaggcccacccagataatccgggatgatctccccactttaagatccttaacttgatcccatctgtgtagcttctgttgctaccttctaggttccagtgattagaacatggacaatggggaaaagcatgacatttattcaccctaccacacaaaggtaagaaactccattcaagaaatgcatctgcacaatattcctatagcacctagacattttggtgaatttctctgagtgcccaacatctgatagatttcctggtctactagaaaattgtcttcctttttacctgt

SEQ ID NO: 179893 - DNA, 601 bp, Human
taatgtgaaccatcacacctggtgtgaccttatttacacagccaatttattcaactatagcctggttataaaaaggacaaatttgtattgattttatacaaataaccacattgccataaaagctagtaagttgtctgtgaattctgagtggtcagggagaataaggtgccatataaagaatgtgtcatttataggttaccaaagagagagttaaagagatcaggaagagaatgaatctttttattcttttaataagatatgtaaagctatatcttattaaaagataatatattattatctwattatttaataatacctttttatcttatttattattatttaataatatcttattaaaagaccatatcttattaaaagaataaaagaaatgacccaggtatcccaagatatcttataataagatattaaagccatataaccacaattagattcccctcagcagttcacttaatcctacttgtcttataactagtggatgttggatcaacacctggttttcaaaggtcttctgctcctggactattaaaaagagtcctgaaaatcctgattccatcctctagtacagttagtcatctaagtg

SEQ ID NO: 179894 - DNA, 601 bp, Human
aaatgctcattaacatgactctaagttacagtttctctgtaacatatagaaataataagacgtatatagacatttataggtataagcagacatacacacactaatggtaatcatcatgccaatattatctcttaatgagaagcaacccagatatcccaagattatccaccagttaacttcttgattttacattagctcacgatctgaaacgtaatagaaacatggaaattccatgtcaactgataccttataaagtgtaaaaactgtttatataaaaattttgccaaaattctaactcaayataattacatataattttaaatcttcattttaaacattatgtgtcaatgctatcttgtctcattggtaaaccagtataagaagttttaaggagttcagattaactagcctcttttcaggaaaccaaaaacaaatctgtaaaacaaaaaagtacatcagaactctataattcagagtgataatattaagggagagatatgtaatgctatttaagctaatttttaaaaaaatcaattaaatgtggtcaaatatgcactttggttacatgaacttgcatttttacatacaagcaatttctgtg

SEQ ID NO: 179895 - DNA, 601 bp, Human
ggaaattccatgtcaactgataccttataaagtgtaaaaactgtttatataaaaattttgccaaaattctaactcaacataattacatataattttaaatcttcattttaaacattatgtgtcaatgctatcttgtctcattggtaaaccagtataagaagttttaaggagttcagattaactagcctcttttcaggaaaccaaaaacaaatctgtaaaacaaaaaagtacatcagaactctataattcagagtgataatattaagggagagatatgtaatgctatttaagctaatttttwaaaaaatcaattaaatgtggtcaaatatgcactttggttacatgaacttgcatttttacatacaagcaatttctgtgaactttttcaagggtagcaatacaatgtatttaaacttcagtttctctgcaacatgagaatcctgagaatattgatataagtaatcaaatctataaataataaaaacagaaaatccttatttcacaaggttttattcatacacaatgaggtgaaaaggcttttttttttttttaatttccagagataggcagctattgagggttgcagttttggttctataac

SEQ ID NO: 179896 - DNA, 601 bp, Human
gagtgtacttgggcaccatcgtaggaccatttccaattttaagccagttatatatgtgactctagcacaaacataagaaagcaagtattgaagatgtgtctaactgagggaaccagcaggatgataaagcttgctgtaaaaagacggagaggcacggtggttctagaggccaccagggaagtcaaagcatcaggataaatagctgatgcatgtggggcttaacacctagctgatgggtggatatgtgtggcaaaccaccacacgtttacctgtgtaaaaaaccggcatatcctgcgcatgyaccccagaacttaaaataaaataaaataaaataaaaagctggccaatgtccgataggtcaatacaattataatttttcaggttatcttttctattagatggaaatcatttacatctctgccacatacaaatcctataaattaacatgtaatttcacagaatctgcatcttaaacaacagtaaatttaaaaataaagagacacctctttagagaatcaaatcacccttggatgaggctattgtactatggccaccatgacaaagaaggtcacacaatcttttttttttttttttgcttcat

SEQ ID NO: 179897 - DNA, 601 bp, Human
tattcagtatggcaaaggacaatggctatgtcaaggaaaattctaggaagggaggatttacattcttttacatatttaaattccttttcaacagatgctggcgaggttgccgagaaaaagggatgctttcacactgttggtgggagtgtaaattagttcatccattgtggaaaacactatggcaattcctcaaagacctaaacacagaaataccttttgacccagcaatcccatcactgggcatatacccaaaggattataaatcattctattataaagatacatgcacacttatgttcaytgcagcatgattcacaatagcaaagacatggaaccaacccaattgcccatcaatgatagactgaaaaaagaaaatgtggtatatatacaccatggaatactacgcagccataaaaaggaacaagatcatgtcctttgcagggacatggatggagttggaagctgttatcctcagcaaactcatgcaggaacagaaacccaaacaccgcatgtgctcacttataagtgggagttgaatgatgagaatacatggacacatggaggggaacaaaacacactagggcctgtcagagatgcggac

SEQ ID NO: 179898 - DNA, 601 bp, Human
tatgtcaaggaaaattctaggaagggaggatttacattcttttacatatttaaattccttttcaacagatgctggcgaggttgccgagaaaaagggatgctttcacactgttggtgggagtgtaaattagttcatccattgtggaaaacactatggcaattcctcaaagacctaaacacagaaataccttttgacccagcaatcccatcactgggcatatacccaaaggattataaatcattctattataaagatacatgcacacttatgttcattgcagcatgattcacaatagcaaagrcatggaaccaacccaattgcccatcaatgatagactgaaaaaagaaaatgtggtatatatacaccatggaatactacgcagccataaaaaggaacaagatcatgtcctttgcagggacatggatggagttggaagctgttatcctcagcaaactcatgcaggaacagaaacccaaacaccgcatgtgctcacttataagtgggagttgaatgatgagaatacatggacacatggaggggaacaaaacacactagggcctgtcagagatgcggacaggggagggagagcatcaggaagaac

SEQ ID NO: 179899 - DNA, 601 bp, Human
aggttgccgagaaaaagggatgctttcacactgttggtgggagtgtaaattagttcatccattgtggaaaacactatggcaattcctcaaagacctaaacacagaaataccttttgacccagcaatcccatcactgggcatatacccaaaggattataaatcattctattataaagatacatgcacacttatgttcattgcagcatgattcacaatagcaaagacatggaaccaacccaattgcccatcaatgatagactgaaaaaagaaaatgtggtatatatacaccatggaatactaygcagccataaaaaggaacaagatcatgtcctttgcagggacatggatggagttggaagctgttatcctcagcaaactcatgcaggaacagaaacccaaacaccgcatgtgctcacttataagtgggagttgaatgatgagaatacatggacacatggaggggaacaaaacacactagggcctgtcagagatgcggacaggggagggagagcatcaggaagaacagctaatggatgctgggcttaatacttaggcgatgggatgatctgtgaagcaaaacaccatggcacacgtttacctg

SEQ ID NO: 179900 - DNA, 601 bp, Human
gggacatggatggagttggaagctgttatcctcagcaaactcatgcaggaacagaaacccaaacaccgcatgtgctcacttataagtgggagttgaatgatgagaatacatggacacatggaggggaacaaaacacactagggcctgtcagagatgcggacaggggagggagagcatcaggaagaacagctaatggatgctgggcttaatacttaggcgatgggatgatctgtgaagcaaaacaccatggcacacgtttacctgtgtaacaaacctgcatatccgcacatgtacccctgawcttaacacaaaagttgaagaaaaaaaaattccctttcagaaaaaataaataagtaaaagaaatcattttaactaatgacattaagagttgattatcataagagcccagagttaggtgctagccccttacttccctaataataaaatatgtgcatttaatttggacaataaatatcttgagaaagaatatacaaataagatattcatgaaaccttttatttttcttcttttacctcttgattcctgtctcttgattatcagataatgtgtccaataagaggaatgaggaaaactcacaata

SEQ ID NO: 179901 - DNA, 601 bp, Human
ataattgaaccaaattctgtagtcttttctccccagccagatagtaatatgttttacattgaaatttgagtataacaactgtgttttatgttttatatagcccagcttccagatcataggtgcttcatgaatcactttcattaaacccctctatggtatcttgcctatgattgtagaattccagagctaaagctcgttttatgcaaaatcttcacttactgtgcatttctctgtggcctaaaaaagggacaaaatgactcaaccaaggccgcaaaacttgatagtggcttaaagactaaayttggtttcttgactcccaatcaaagatatttcgctatttttagatggaattatgagttgagaaattatgggttaaaagagagaaacgagtgacagaagacagaaaagtaaaatacacaaattaataaaattttgttttggaacaaattagagcgagaaaaaaattaaagtgcctaagggctatgccattttgttaaatactaaagagaacacaatttagtaagataattaggtttgactgacaagcttccaatccaattgaggatataaggatttccaaactgaaagtgtaaaggtaagt

SEQ ID NO: 179902 - DNA, 601 bp, Human
gtgaaggccgctgtttcagctgtcagtcaggcagagagtaaatgctctcttcctctgcctttttgttcttttcaggctctacatgaattgaatggtacccactcacgtggagagggctgtctgccttgctcagtccaccatttcaaatgctaatcttttttggaaacaccctcacagacacacccagaaataatgtttgactagatatttgggcatcgtgtggcctaggcaagttgacacacaaaattaaccatcacaacctccaacgtaaagtcaaggtttagactaatttgtaggtagmatgaatccattatgtactttatgtgctggtgaaaattgcataaatacgaaaatttacttggggaccgtgaatctggtcgtgatttgtaaaatgaaatacagcacagccaagtaaaggctaaacgtgagatagtaatagccaaactctagaattatgaaagtgggaaaagtgagagacagttataaaaacaataaatgttaaaaattaaaacgcctcaagttcagtagcttgcctgaagttacactgcagatattcagccctagaggtatggaaaattcactgcattgctctgcctcttgg

SEQ ID NO: 179903 - DNA, 601 bp, Human
acaggtttgactgggttaggatgttagaattgacagaataaatgagtgctaataaaaagacgatgtgttctgctatcttgtcgctgaaccaatgcaatggtttataacagcatgatgaaaacaaataattggatactgtgatgaatttgaggtattataattttgatggtctcaggaattatgataaatgtttaacaataacagccacatttcttcttgtccacaggcccggtgggatggcttgactgggcatatcacctttaataaaaccaatggcttgaggaaggattttgatctggayattattagtctcaaagaggaaggaactgaaaaggtaacctccttaacaataaataaataaaataacaaatgaacattgttcaggcatttttactaaattgcaaagacaagtaggtgaatgatgaagtgattctctaagcatgttcttttacatccagttttttatctctctttcttttttctgcagatagaagttgatgtgctagattcttaaatttcatgtcttagtaatagcagtactaactagtgtttctattgtgcttcatttacatagcaagtgtgattatattattacatatat

SEQ ID NO: 179904 - DNA, 601 bp, Human
tgcttttgttaaccaggacacattttttttgcaggtgctaactacccctccccctcaaaaaaacattaatggaaacaaagatcatttaggctgaatgtattagaaggtgaccaccagtgtgaaatatttgaggaaaataatttgtttgcagttttgagagtacacattatacatgcaggttactcacttcaaaaatgtctctcccatcttctggcttcctcttcactctgatttgcccctctgttggtctgacatgccctgatagagcacagggcatccagccagtctccacgatggtgcrtgggatgttggctggagggaacaaaagaaaaaaaatacttgttatgatctaaaagcctataatttttttaagaaaatgtctgcttctcgaagcatgagtctttccccaactctgttctcctcttatgtatagcactgaagggggaagaaaagctgttaaggaaacatctttttggctaggtgaatgatgaaatagatggagctattgttatgctttcacagctatctatacaccgtaatattatgcacattgcattggtgtttttccatcaaaggcaaaatcaaattagatgaaagtgtt

SEQ ID NO: 179905 - DNA, 601 bp, Human
aaacccataatcaaagaacaagtcatcaagcatacttcttctttatatgtgtgtgtctgtgtgtgtgtgtgtttgtgtgtgtgtgtgtgtattgattgatttgctggttggttggttaattgattgattttagttaccaatgccttaaaagggtcttcttaaggaacaatgaagacccttaatactgcagcatacctgtatacattgaaaagcactttaaggcatttcttggtgtgtgaaaggaaaagtaaaaattgagtcttaccaccaggtaacttctgtgagacccaagtcttgattygtctctttgctgtacctattgtcaggctttatattgaattaagatgcaaattccaaacaatgggtgggaactgtaacactctaagcactcacacaccatgattccttctgggtttcacgctccattttaattaagtgctgtttttattttatttttctctctgaaaaccaaggctgctggcgaagtgtctaaacacttgtataaagtgtggaagaaggtttgtactctgacaacaactgcaggaaacctgggggtgggatggggaatgtcattggaaaggcctgtgcccttccaatgtta

SEQ ID NO: 179906 - DNA, 601 bp, Human
aaagcataggtttaaaagccttgttttaatcttcagtgaacaaggctactaagtgcatgtagaaggcgatctggtttcctcactaaaattttactggtaaatagatgaacctaaccggcacccagaaaaagaaaaaaaaaaaaaaaaacctattacactaatccatcttgagactctgggcactttgaattaatctaatacaaatgtcccagggaatggaatccaagctttgaaattatataaaggggaggggggatgtcctctatttgtcactaaactgcaagagccacacacactccckagggttgtaactttctgatcttgatcctccatgccttcatgcctcttccctcctggtagcccatcatgttccacattgtaagttgtatatactgtggtgtgctgttttgtgttataactccgtcaaaaattcacggtaacctgagttctagcacaggcgacccactcagacccaacaaacacattgcactttttccagaagtctccaacttaaacaaaaattcaccttcatcatattgaaatcccaaaagctttcctcgtactctgacttattttagaatagtattattcacccaaaatt

SEQ ID NO: 179907 - DNA, 601 bp, Human
cttccctcctggtagcccatcatgttccacattgtaagttgtatatactgtggtgtgctgttttgtgttataactccgtcaaaaattcacggtaacctgagttctagcacaggcgacccactcagacccaacaaacacattgcactttttccagaagtctccaacttaaacaaaaattcaccttcatcatattgaaatcccaaaagctttcctcgtactctgacttattttagaatagtattattcacccaaaattctttccaaaagaggaaggtagcaatctttacaacatccctcactraaatatttgttatataaggttcgtaatacaggaaacacatatacctttatctttgccctagatacctgattatttccctcagccactttagatgttgagtttacatgaatcactgtctaggtttagaagatagatactagtggctctctgaataccctttttattgcatcgctttttaaaaaaagtttgcttaatgtcatttgggcactcattttcaaatgcttttctcagttgtcctagataacacatggctgctcccttgtgccagcttacaaagtgaaagaaatcagggccaggtaa

SEQ ID NO: 179908 - DNA, 601 bp, Human
tatttccctcagccactttagatgttgagtttacatgaatcactgtctaggtttagaagatagatactagtggctctctgaataccctttttattgcatcgctttttaaaaaaagtttgcttaatgtcatttgggcactcattttcaaatgcttttctcagttgtcctagataacacatggctgctcccttgtgccagcttacaaagtgaaagaaatcagggccaggtaatttagatattgagtgctcctccccacaagtaactgatccaccctccactacttctcactggtaaatgactrctgtctgctttcactgtgaagcttgaaaactgaggttccgctccctggaggcactcctcctagttcgtagaacagtactgaaatgtcaaatgtccaggcatcttcttaactgtacctctgtctccagcacacatgaatcatgagatctgacttctttaaagggagacattcatttcctgagaacatattcatttacttcaagtaacagataaagccacatgactacttgggtttaaaagacacaggtacacacatgcgtgcacatacacacacacacacacacacatacacagttctgtt

SEQ ID NO: 179909 - DNA, 601 bp, Human
agagtcctgctagggctcacaagcactctttgcccagctttggctcctcaaagaagataggccctgaatttagtctacttctcatgcacatgacatgttttctttcatttatctttctctttttaaagaaaaaattactttattttttcagtgtctcgctctgtcacccaggctgaagtgcagtggtgcaatcacggctcactgcaatcttgacttcctgaacccaagccatcctcccatctcaacctcctgagtagctgagactgcaggcgtgcaccatcatgcctggctaatttttttwaattttttgtatagatcgggtctcactctgttgcccaggctggccttgaacacctggtctcaagagatcctcccaccttggccttccaaagcactgggattacaggcatgagtctcggcaccccactatctttcccttttagatgctgggtctctccaccattcaccctgccccttcaccccattattcataaattttaaataaactagtgatactactttggcagcctaaggtttctatcagtagaatgtaagctccacaagggaagaaactcttgtatattttattcattgttatgtc

SEQ ID NO: 179910 - DNA, 601 bp, Human
gcctttggaataggctaccctgaaggaaaccaatcaaaatatataaatcataagtgaatagtgaaattcagatgaaatttagataaagaaatgagaatagtcatagataggaaatgcaaagaatgaaaggaaatagttggtgatgtagatttctctgtcatgaggttcttagataaaagccaggtccgggcttggtggctcacaccggtagtcccagcactttgtgaggtgtgagggtggatcacgaggtcaggagatcgagaccatcctggaccaacatggtgaaaccccgtctctactaaaaaaaaatacaaaaaaatagtcaggcgtggtggcaggcgcctgtagtcccagctgctcaagaagctgagaaaggagaaaggcttgaacccgggaggtggagcttgcagtgagctgagatctccccactgcactccaggctgggtgacagagtgagattccgtcagaaaaaaaaaaaaaaagccagaagggtcatacaaaaaaaagcttaggtattggcacagcaggtggccaggcatgtgggcccccatttccctttgcgccttccttcttctcagacccaacatttaacagtgactgt

SEQ ID NO: 179911 - DNA, 601 bp, Human
accactgcactctagcctgggcgacagagtgagactccgcctcacaaaaaaaaaaaaaaaaaaaaaaaaaagaattttaaagttttcagctcagagcaaaatctcatcatgtcaattaatagtacaaccaagttgctcattccttctttttctcacatgccctttttaaaggcatcttcctgcatttttgtctttagttccagaatgatggatatatatttgtgtatgtatatgtgtgttttatactttctggtttctctttgctgatactgtttcataaacataactgtataaattggcttttttttattagaaccaaccatcacaggagcttcatgaatgagaagcatttagagttgagaataagaatcaggagtacccaggaaaagtctagacatttgcaaagaaactagactaagctgacaattttggacttgcttttgcagagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtc

SEQ ID NO: 179912 - DNA, 601 bp, Human
ctgtatttaaccattttgctctacacagttccttaaaggatttttatacctttcaatagatcatatattctgaatacttttgatgctaaatttgaaacagttattttatctttctgttggcttaaacatttgctgtccctagataaaccatgtaaaaaataattgcttttgtatgtccctacttgttttcaatctttttcacctttcaacaaaactcagtgaactttttccctaatcaatttttgttttccctccaggaatttctaagagaaatatttcttcatgctagctctttgtcatkgtccactgtctggttttgattaatgccaggtaactctttccctggtgtaattataaagaaagcttgggaaaataacacaggctggaaaggttttaaagatccacaaggcagacatactcaaactgaatcaacatgtgctctcacatgtgggtatttatacattcaatatgaaatgaatgttttgatgttctctaggccttataaactgtacccttaccaaagctcagattttatacttttactgaccaaagctctctttaaatatgccttacttcagaaaataaaatattgacagtatgt

SEQ ID NO: 179913 - DNA, 601 bp, Human
ttttgatgctaaatttgaaacagttattttatctttctgttggcttaaacatttgctgtccctagataaaccatgtaaaaaataattgcttttgtatgtccctacttgttttcaatctttttcacctttcaacaaaactcagtgaactttttccctaatcaatttttgttttccctccaggaatttctaagagaaatatttcttcatgctagctctttgtcattgtccactgtctggttttgattaatgccaggtaactctttccctggtgtaattataaagaaagcttgggaaaataacmcaggctggaaaggttttaaagatccacaaggcagacatactcaaactgaatcaacatgtgctctcacatgtgggtatttatacattcaatatgaaatgaatgttttgatgttctctaggccttataaactgtacccttaccaaagctcagattttatacttttactgaccaaagctctctttaaatatgccttacttcagaaaataaaatattgacagtatgtatatagtgatattatcctttgtattttaatactctaaatcagtggttctcaaccaggagggattttgtcccccaggg

SEQ ID NO: 179914 - DNA, 601 bp, Human
acatgtgctctcacatgtgggtatttatacattcaatatgaaatgaatgttttgatgttctctaggccttataaactgtacccttaccaaagctcagattttatacttttactgaccaaagctctctttaaatatgccttacttcagaaaataaaatattgacagtatgtatatagtgatattatcctttgtattttaatactctaaatcagtggttctcaaccaggagggattttgtcccccagggaacatttggaaatgtctacaaacatttttttagttgtcatggccggtagtaggragtgctattggtatcaagtggacggagtccagggatgctgccaaacatcttatggtgtacaggacaggtaccccccaaaagaattattcactccaaaatgtcaatagcaccaaggttgagaaaccatgctcgaaacaattaaagaagatattgctttgggtataaaatttttaaaaataaattgtttacctttggaggtatttttcattagtgactcctcagtgaagttaatattgcctcggaatggtcatttaataaatgactatcctaaggtgaagcaccttctaataagtaatcttg

SEQ ID NO: 179915 - DNA, 601 bp, Human
aaaataaaatattgacagtatgtatatagtgatattatcctttgtattttaatactctaaatcagtggttctcaaccaggagggattttgtcccccagggaacatttggaaatgtctacaaacatttttttagttgtcatggccggtagtagggagtgctattggtatcaagtggacggagtccagggatgctgccaaacatcttatggtgtacaggacaggtaccccccaaaagaattattcactccaaaatgtcaatagcaccaaggttgagaaaccatgctcgaaacaattaaagaaratattgctttgggtataaaatttttaaaaataaattgtttacctttggaggtatttttcattagtgactcctcagtgaagttaatattgcctcggaatggtcatttaataaatgactatcctaaggtgaagcaccttctaataagtaatcttgtgtttacttgttgcatacctctgcccggaggcccacacctgttgggtgatactaggactgatggagcaattcatgcagcccagggcaacagtagtttccatatttcgcagggcaaaagtgagtttccatattttgcagtctgaggct

SEQ ID NO: 179916 - DNA, 601 bp, Human
tttattacatgacttgaccaaagccagtaggagaagaaacgccagcagcatccaaaagttctcacaagcacacaggctgaaagtaccctttacacttaactccaactgtgcgcttaaatctccttatgtatgtcatcagagtatgtcagaatggcacgccattcaatagttttcccctctttgtctattcttccataagctcttggtgacccagacctccatatttttggacttcattcagtttatttctattaagataacagtacccccactaccaccatcaatgcaatccattcagtakttctactcaccgagagtatcatttataagccagtcctcccttatttagcttattcttcttgtctcctcttccactgccttcttgcccttgtcttggttcacacgtggaggtgttatacatccagtgcaaacttggaaacagtatagtgacgaaatacagaaaataactccctccagggcacaagtgtactgtcatgaagattctactttcaactacatttaccttctctacaccttagaatccatccctgcttctgcttcataaagccactaaatatatatttagacttgattcccaaaa

SEQ ID NO: 179917 - DNA, 601 bp, Human
cctagtctataacagagaaggggctaaagttttttttgggaaaaaaaaaagtattaatggtggtaaatgtgcatgtgaataaaaggaaaacaacagttgtaaacaaaataatctctaaaaacacccttgtcaaagattcatattcagattaccaaaaatggagttgtcacctcagcattgagtggactgtttggggttttttgtttgtttgtttcttttggggggcagctgtttttttgttttgttttttgttttgagatggagtctcgctctgtcgcccaggctggagtccagtggcgcratcttggctcgctgcaacctccaccctccgggttcaaatgattctcctgcctcagcctcccaagtagctgggacgacaggtgcctgccaccacacctggctaatttttgtatttttagtagagacagggtttcaccatattggccaggctggtcttgaactcctgaccttgtgatctgcctgcctcagcctcccaaagtcctggaattgcaagcgtgagccactacgctcagccaggggtatttttttttaaataatcttttcctttctattatttccattgagttcaaaatgaactctt

SEQ ID NO: 179918 - DNA, 601 bp, Human
ttttagaatgtttgcacatacataatgagaaaacctggggatgggacccaagtctaaacaaaatttatttattcatcatatataccttatgcatatagcctaaaggtaagtttatacagtattttaaataatttcgtacatgaaaaaagttttgactgcaacccatgccatgaggtcaagtgtggaactttccacatgggacaacatgtcagtgctcaaaaagtttcagatttgggatttttcagaatagagatgctcaacccagatttacaaagtgtcctttaaatgacaaagtgtcactttttttttttttttttttccagacggagtcttgctctgtcgcccaggctgggtggagtgcagtggcgcagtcttggctcactgcaacctcctcctcccgggttcaagcgattctcctgcctcagccccccgagtagctgggattacaggtgcatgctaccatgcctggctaatttttttattttaatagagttggggtttcaccatgttggccaggctggtctcaaactcctgacctcaagtgatccacctgtctcggcctcccaaagtgctggaattacaggcgtgagccactgcgccc

SEQ ID NO: 179919 - DNA, 601 bp, Human
ttgcctaatctaacctggagcatcctgatcagtttttggagcacaagtcatttgctaagatgggtcctgtctccactcaatcacaaggaaacttctaatgagaaacgttttctcatcacaaacagtgtaatttcaagtgtttttcttctcagaaaagcagtattcctctggcagtacccaaatgataaaaactggtctttttactttcaagttgatttaaaatcattttatagccaaagaatggccagttgcagggaggaaagggattcagacattttcaagatccatgatcaaacaaaayactcgaatgcctcacatttggtcgctaggccacaagcaagggatgtgcttagtgaagtttgtccttgaaatgtgtgcccagaagttgctcgctaaaatttcattcaaaatccgttgactttttctcctagacttggctattcttgcagacagcatgacactctacattttagatctgatgtatttggttctcaacaagaagaaaaccaaaatttagttttttaaaatagctcaggtgagattccactatctaccacctgagctcatataaggctgagggaactaagtggaattttttttt

SEQ ID NO: 179920 - DNA, 601 bp, Human
aaagggaatccataaattttttaaatgttggagagtctgcaaatgtcataacttttcatcaaatcaagataaagacataatcaactgcagtgttcatattatacacatttggaaggcagaggtcctaactatactataaatattttcttctgatcatcttccttcaaagcgatttttgtaaattaaatcatattttcaaaatagcatgagaatttattatttaatgaaataatatattaatcatgtctaaaagaaatggttgtttttaaggcaactattcacctctgatgtacctatttcrcaagtatgaagttctacatagccaatgtctatgtctttggttaatttttaagggttgtcttaaatcaggatttgcctaaagtaaaattaaattggagatcttaaaatataattgtttgtgatatttcatttgttctatatgcatatatttacatttataagatcacttttgataagataaaaagatcaaatatcaataacttatttctaatgtatatttcagtgtgtagagtaaaaacatacataaacacagatcgatatataaaatcatcagccatattagtgtgaagtagaattgcat

SEQ ID NO: 179921 - DNA, 601 bp, Human
atttgagatgaaaaatgctattctttgccaacaatgtttcatcagcatgaggatagccacataatcagatttaaacagataaaatgcatttatctaaacagatgcctctcaggattaaaaagaaaaaatcctgggtgatttcagatttaataaatgaggctttttcagttttagcaacttttgctaagaagctcagaagacattccaaatattctaattaacttttgacatatctagtgaaataagaggcaaccactatttctgtttttggaacatatattatttagagtgatttaggagrctggttgacattatatgtgatttagaagtacaaaaacacccaggctgtcattttaacactttgcctggtcttttaatatgtatgataatttttcatgaagtataatcctatttttaagaattactaagatttgagactcaaccatgaaaaaaagtctgctgaaaggaatacatgtaatttactcccaacattctacttttttatctaacaaaaaataaacattactgagcgtggcatgcagcggacagaactctgcagtaaagaagaaagagccctcaattctgtgctgtctcttccact

SEQ ID NO: 179922 - DNA, 601 bp, Human
catttgctgtccctgacctcaggacctgcatatgtgataggaaggggttggtctagagagtagaacgtggtggttgaagcatctccttatgtgaaactcgtctaagcatgacatactccttgcagttgcctagtgatagaaaactcactataccggctgggcatggtggctcatgcctataatcccagcactttgggaggccgaggcaggtggatcacatgaggtcagcagttcgagaccagcctggccaacatggtgaaaccctgtctttactaaaaatacaaaaaattagctgggcatggtagcaggtgcctgtaatcccagctactcaggaggctgaggccggagaatcatttgaacccacgagtcagaggttgtagtgagccgagatcgtgccattgcactctaacctggggaacaagagtgaaacaacgtctcaaaaaataaaaaagaaagctcactacacctttaaggtgctgaagctgtctgcagatatttctacctattaaaaaaagttattccttagccacattttgggtcttcctgcaaactctaatttccctagcatcccaagtagcctagaactctaactgtgaaacac

SEQ ID NO: 179923 - DNA, 601 bp, Human
actacggagatggtgcatcctgtgcctgccaagggatttgtctaatgtgtgcgagcactatatataactgtgataactggggttagcttaaaaataccaataattcccataatgtttttcatctctgaaataagtggagaatgctgatgcaaatgaagaaaaattaaaaaaaaaaattggaactgtatggaaattacagagtaaaatgcaaaatgtctaatcatagatcactattcaaaagaatggaaaattcatatttaagtaatatgaaaatttaggcagtatactttagcaaaaaaatataatgaagcagtggtacatatgtatatgtgcatatattacataacatatataatttattactgaatctatcaaaaagctgaagaatatgagaaaagacaaatatattaatagaacactttgaaatgagatattcagtccccattatctaaaatatgattacaattaaaattatacacataaaaaggcatataaatacagtatgaagatttttcttctttttttttttgagacagagtctcgctgtttttgcccaagctgaagtgcaatggcacgatcttggctcactgcaacctccacc

SEQ ID NO: 179924 - DNA, 601 bp, Human
tcctgtctgttaacaatgatttaaaataacaatgtgtatcatctctcctaagaacgtttgaactttaacatgagacttttaattgacattccttctacagcatggaatataacttgaaagctaaaatttctgatagtacagtgagtgacgcagggctggaggtaggagggaacaatgcatttcttcctaccactttcctaaatgaatgcagcactttgaaaatcgctacctgctttcctgcgaatgaagctgacctagtgttgagtaccattaatattaaatatacatataatacaaaaawatatatatataaatatacatataatacagagagatccaaaggtacccattcagtctccttttggccaacctcacccaagttccaaagttgaaaagccttccccacttcctagatgaaaagaaatacactccaggaatttttcacagttgttgtaaacctgtcatgcttttaaaccaaaaacaatgaaggaataattggaacagatggcagacctcatggagaatacatccattgagaatacagctgttggaaaaatttgtgagatgtttcttttatgatgaattgactctttacaaaaga

SEQ ID NO: 179925 - DNA, 601 bp, Human
aacctcaggagtggaaactatgtacatcagcagggccaccttaggtcctcaaaacacttcaatcatcaaattgctttcgaatgatgtcctgcgaccagaaaacaagttttgggaggccaagtgcatgatctgccgtttgggtggagagtgagcagcacccattaaggcgaacggaggtaacctaaggttaaaccaaatgccccatctcctggtctgtgggcaccagtgaccccgcctgtaggccacagggtcaaacaacaatcaggagaaggaagcctgcagaccaagggcctggctcccrgttcaggaaatcaaggcacagaaagggtaagtcatctagctagaagtggagcttcatcaaattttcagtgatctttttaagatataacgatgcctctggtcaggccaaaccccggcttcagacaatggttcccaacctcagctaacaattagaatcacctggggagctttccaggcgattcccagccccagagattggaatgggtttggagtggcctggaaatgggaatttttcaaagctccctagagactctgacgtgcagctaaggttgggagcactgctcaaaggtctctactcaca

SEQ ID NO: 179926 - DNA, 601 bp, Human
gtgctcttataagaagagacaccagagagcttgctcctctctccacacactgaggaaagaccacgtagggacacagggagaagggggccatctgcagcccagaggagaggcctcaccagaaagagaccatgctgggacctcgacctcagacttgcaggctccagaactgtgggaaatacatgtctattgctcaagcctcctaatctgtgttttttgttatggcagcctgagaagattaataatacagtgataaaataagacatgctattgttatgttgaggaactttctgaattaaataayatttttgtctcttaatcgtgaattcaggccgacctcagatacctctctctttggcattaattatgattgcacatgggaatttcatgcggcacctgctgaaattagtaacaaaaggaaaagtactggacctttccaagttataaaaggtttagcttcccgagttctttgttcagaaatatggtggggtaactgctcttgatactcagaaacttagtaacctagctatagtcctctcaatgaagtgttccatgttaaactatagtggctaaaactattcttttatggagctgaagctaaaaa

SEQ ID NO: 179927 - DNA, 601 bp, Human
atatacaaaataaagcacttcatattaatgaatagaaactattttattatctttaaaataaagcacaaagattaacaaaaattaaaggtgattatcatggattaaatgcttgcatcccccaagtccaaatgcagaagccctaatccccagtgtggctttatttggagatgaggcctctaaggaagtaattaggctaaaggaggtcagaagggtggggccctaatataataggattagtgctcttataagaagagacaccagagagcttgctcctctctccacacactgaggaaagaccacktagggacacagggagaagggggccatctgcagcccagaggagaggcctcaccagaaagagaccatgctgggacctcgacctcagacttgcaggctccagaactgtgggaaatacatgtctattgctcaagcctcctaatctgtgttttttgttatggcagcctgagaagattaataatacagtgataaaataagacatgctattgttatgttgaggaactttctgaattaaataatatttttgtctcttaatcgtgaattcaggccgacctcagatacctctctctttggcattaattat

SEQ ID NO: 179928 - DNA, 601 bp, Human
agggatcaacagttcctcacctgtgtgacctcagacaggtttacttggcctcagattcctcctctatagaatggggatgataacagtacctatgccacagagttcttgtaaagataaaatgatacgtcttgtggagtcctgataagtaaacaacaatgagaaaggggccccagatgggagagaacaatgaacagtgattctgagaaatggccaatcacaaacaaccccgggcacagtgacctttttcagcacataggcccctccagcgcaaccctataaaacttccttccagcctctgccrcttggcagacggccccttctctgctgtgctgcctgctgcacccttgcaacatatttttatactttctctaataaatctggctttctttacctgcaactgtcttggtaaattcctttactgcctgtgacactgaccccggctaggtgcacccgtgacatgtattacataaatagggtacttaatatacaaaataaagcacttcatattaatgaatagaaactattttattatctttaaaataaagcacaaagattaacaaaaattaaaggtgattatcatggattaaatgcttgcatcccc

SEQ ID NO: 179929 - DNA, 601 bp, Human
gcagtgagctgagatcgtgccattgtactccagcctgggcaacagagcaagactcggtctcagaaaaaaaaaaaaaaaaaaagatgatgagcagcacaggctttagagttagctgaaactgggtttgagtctagggatcaacagttcctcacctgtgtgacctcagacaggtttacttggcctcagattcctcctctatagaatggggatgataacagtacctatgccacagagttcttgtaaagataaaatgatacgtcttgtggagtcctgataagtaaacaacaatgagaaaggggcmccagatgggagagaacaatgaacagtgattctgagaaatggccaatcacaaacaaccccgggcacagtgacctttttcagcacataggcccctccagcgcaaccctataaaacttccttccagcctctgccgcttggcagacggccccttctctgctgtgctgcctgctgcacccttgcaacatatttttatactttctctaataaatctggctttctttacctgcaactgtcttggtaaattcctttactgcctgtgacactgaccccggctaggtgcacccgtgacatgtattacata

SEQ ID NO: 179930 - DNA, 601 bp, Human
acatgactgaaagaatgaagagtcgtaactcatgtgaatctctgtttcccgtaggtaaaaacactctcttcacagagctatcctaggattgaaatgagatgtgaaagatatatgaaaaattcactcgcattaatgccatgctttaagatgataagcagcagccaggtggagtggctcacacctgtaatcccagcactttgggaggccgaggcgggtggatcacaaggtcaggagtttgagaccaacctggccaacatggtgaaaccctgtctctactaaaaatacaaaaattagccgggcrtggtggcaggcacctgtaatcccagctattcaggaggccgaggcaggacaatcacttgaacccgggaagcagaggttgcagtgagctgagatcgtgccattgtactccagcctgggcaacagagcaagactcggtctcagaaaaaaaaaaaaaaaaaaagatgatgagcagcacaggctttagagttagctgaaactgggtttgagtctagggatcaacagttcctcacctgtgtgacctcagacaggtttacttggcctcagattcctcctctatagaatggggatgataacagtacct

SEQ ID NO: 179931 - DNA, 601 bp, Human
ctcagcttgtagacagcctattgtcggacctcaccttgggattgtgtgcgtcaatactccttaacaaactcccttttaactcctctttatatatatcgatctatcctattagttctgtccatctagagaaccctaatataatataaatacatgactgaaagaatgaagagtcgtaactcatgtgaatctctgtttcccgtaggtaaaaacactctcttcacagagctatcctaggattgaaatgagatgtgaaagatatatgaaaaattcactcgcattaatgccatgctttaagatgatragcagcagccaggtggagtggctcacacctgtaatcccagcactttgggaggccgaggcgggtggatcacaaggtcaggagtttgagaccaacctggccaacatggtgaaaccctgtctctactaaaaatacaaaaattagccgggcgtggtggcaggcacctgtaatcccagctattcaggaggccgaggcaggacaatcacttgaacccgggaagcagaggttgcagtgagctgagatcgtgccattgtactccagcctgggcaacagagcaagactcggtctcagaaaaaaaaaaaa

SEQ ID NO: 179932 - DNA, 601 bp, Human
gaatgtgtctgtgagggtgttgccagaggagattaacatttgagtcagtggactgggaaaggcggacccaccctctatctgcgtgggcaccatctaatcagctgtcagaataaaagcaggcagaagaatgtgaaaagactagactggcttagcctctcagcctccatctttctcctgcgctggatgcttcctgctctcaaacattagactccaggttcttcagctttgggactcagactggcttccttgctcctcagcttgtagacagcctattgtcggacctcaccttgggattgtgtgsgtcaatactccttaacaaactcccttttaactcctctttatatatatcgatctatcctattagttctgtccatctagagaaccctaatataatataaatacatgactgaaagaatgaagagtcgtaactcatgtgaatctctgtttcccgtaggtaaaaacactctcttcacagagctatcctaggattgaaatgagatgtgaaagatatatgaaaaattcactcgcattaatgccatgctttaagatgataagcagcagccaggtggagtggctcacacctgtaatcccagcactttgg

SEQ ID NO: 179933 - DNA, 601 bp, Human
tctgcctggtgccagtgtccaggcactgccttccacctgagcagcagggtgccacctgcctggcacgccatcggcatgcataaacatccattacatatatgtgatagttaatattaagtgtcaacttgattggattgaaagatgcaaagtattgttcctgaatgtgtctgtgagggtgttgccagaggagattaacatttgagtcagtggactgggaaaggcggacccaccctctatctgcgtgggcaccatctaatcagctgtcagaataaaagcaggcagaagaatgtgaaaagactaractggcttagcctctcagcctccatctttctcctgcgctggatgcttcctgctctcaaacattagactccaggttcttcagctttgggactcagactggcttccttgctcctcagcttgtagacagcctattgtcggacctcaccttgggattgtgtgcgtcaatactccttaacaaactcccttttaactcctctttatatatatcgatctatcctattagttctgtccatctagagaaccctaatataatataaatacatgactgaaagaatgaagagtcgtaactcatgtgaatctc

SEQ ID NO: 179934 - DNA, 601 bp, Human
ggaatgacaggcaagtgggctgtgagttccgtgaagggagaggtggtgtttgtcattcaccaagatctgtctagagctgtgccctccttacactggggaagtgggctgccagcctggggccccacagctggttttgcaaccagcacagtgctcagaacagagatggcacccaaaaggtatttgttgaataaatgaatgaatgaatggattgatggagccaggattcaaatctgggtctgcctggtgccagtgtccaggcactgccttccacctgagcagcagggtgccacctgcctggcaygccatcggcatgcataaacatccattacatatatgtgatagttaatattaagtgtcaacttgattggattgaaagatgcaaagtattgttcctgaatgtgtctgtgagggtgttgccagaggagattaacatttgagtcagtggactgggaaaggcggacccaccctctatctgcgtgggcaccatctaatcagctgtcagaataaaagcaggcagaagaatgtgaaaagactagactggcttagcctctcagcctccatctttctcctgcgctggatgcttcctgctctcaaacattag

SEQ ID NO: 179935 - DNA, 601 bp, Human
atctttataataatagcttctctgcagcacaaggcatgacttctcccttctgaaagtgcactttgcctttgatgcctgaaataaagtgtaagtcaaccagcaagctccactgcagcacacacatgaagttactgccccccggcggcgaccgctggtctttgaacagcattggacaggccctcggtgcaaagctctccggcccctccacaagctggagactgcttctccctacctgcggcctggggacagccttccctggcaatattaccgggttccagctggcttggactcccgaagtcctccggtttgtatgctccgggttcttttggatggcgctgggaaaggggagaacattattcgttggagaattaagtgggcagagtaaaaccagcaggctgcaagaaaaaaagacctgcttttgagttttgctagtatctattgagcacccttgaggaaatttcgtcacccttctcagcacgaatttctcactgaagagatgaaaggcacagccttggaagaaccttctggtcccaggacttcgagaaccccagagtcggatatccagttaccccgggattccacagtgcttattatttttata

SEQ ID NO: 179936 - DNA, 601 bp, Human
gctgataatttcagtcatcttcaggaggagggtcattcctttcaaaagtctccccttcaggtgagcacgttcccctatttgtattctaaacaaagcgggcagcatctcccagcagcagggaataggtccactcaggaagcggctttctcacctgcacagtttctgctggagggagaggggtgtctctccacttgaaaggttcaattacacacttatctttataataatagcttctctgcagcacaaggcatgacttctcccttctgaaagtgcactttgcctttgatgcctgaaataaagygtaagtcaaccagcaagctccactgcagcacacacatgaagttactgccccccggcggcgaccgctggtctttgaacagcattggacaggccctcggtgcaaagctctccggcccctccacaagctggagactgcttctccctacctgcggcctggggacagccttccctggcaatattaccgggttccagctggcttggactcccgaagtcccccggtttgtatgctccgggttcttttggatggcgctgggaaaggggagaacattattcgttggagaattaagtgggcagagtaaaa

SEQ ID NO: 179937 - DNA, 601 bp, Human
ctaaagaaaatagatgcacagaaaaataagcaaaaaattaaacattgacctaatataaaactggtaacaacatattcattgacattaaaacaagatccttcataaagactaaataaatattttctgagtatctcctgtccttgatacgatcacaaacgttaccatgctacatgcaattctcacagcatcctagtaagccaccatctagacctctttacagacacaaagctgaagatgctcagaatctcaggcacagccccgaaggcagccagctgggtccacttcattccaagccacaaaygcaacacagaatgctctgtgctgcctctgcataaccacccctttcactaaatgcaggaagtcacccccacaaccaacaagctctatacccgcaccccatttcaccctgtgtctagtttgaaagatacatcttgaatttagctattctagaaagagataccaatacaaatgaaccctgaatcactttccaaacacctgcaggtgtttccaggcagttcatgaactgtaacacagtgaatttttctgaagggtggtctgttttgaggggctgcacagcagttttactgattgcggaccagac

SEQ ID NO: 179938 - DNA, 601 bp, Human
acaccttcacactcactgcactctcagctgagccatgaaaattactaagattaataagcagcaacaaaacctgcacctaaagaaaatagatgcacagaaaaataagcaaaaaattaaacattgacctaatataaaactggtaacaacatattcattgacattaaaacaagatccttcataaagactaaataaatattttctgagtatctcctgtccttgatacgatcacaaacgttaccatgctacatgcaattctcacagcatcctagtaagccaccatctagacctctttacagacacraagctgaagatgctcagaatctcaggcacagccccgaaggcagccagctgggtccacttcattccaagccacaaatgcaacacagaatgctctgtgctgcctctgcataaccacccctttcactaaatgcaggaagtcacccccacaaccaacaagctctatacccgcaccccatttcaccctgtgtctagtttgaaagatacatcttgaatttagctattctagaaagagataccaatacaaatgaaccctgaatcactttccaaacacctgcaggtgtttccaggcagttcatgaact

SEQ ID NO: 179939 - DNA, 601 bp, Human
gcaggcacacaccactgcaaaatttttaagctgcaggaccccctggcctgaaaaaatgcacacagcttctgaaagtgcctaagttactcatgggaaaataaagcttattatttaatggacttaacaatattttcttgttcatgatgatgttttacttccactgatacacaaatatttattaagtgcctactatgtggcaggcactgtcccaggaacaggttaagcagctgcaagcaatgtagacactgtaatttctgcattttaataaaattgctaactcatactaaatacttactatgarcctgatattattgtaagccctctatttgtattatgtcttttcatcctcacaacacaaccccaggaggtaggagcttttataatcccacttgataaaccaggagacctaagtgcagagaagttaagttacttgcccaaggtcacacagctggttactggcagaactgggatttgaatccagaccaaccctccttactgctgtacattgatgtagtttaacaagaacaactctaaactaaggtgggtgtccatctataaagaaggtgaatgctaggctgggcacggtggctcacacctgtaa

SEQ ID NO: 179940 - DNA, 601 bp, Human
ggatttctttcttcaataataatgatttttatgctttatagttcatgaggctttcatattcattatgttgagatttattttcaaaaaagtgtttagagtcttaagttgtttgcaactttgtagcaaagctcatttcacattaaaacatccttttagcaaagtctcaacatactatagtgaaattaatacaggtttttctaagcatttataagtgttaataagccatgccagtctgctggcatagcatatatggtgctgcggtattctgaatattcagtatctaaatctgttcatttcatayacacatgcacgtgtgttcacaaacacacatgcatgcaggcacacaccactgcaaaatttttaagctgcaggaccccctggcctgaaaaaatgcacacagcttctgaaagtgcctaagttactcatgggaaaataaagcttattatttaatggacttaacaatattttcttgttcatgatgatgttttacttccactgatacacaaatatttattaagtgcctactatgtggcaggcactgtcccaggaacaggttaagcagctgcaagcaatgtagacactgtaatttctgcattttaat

SEQ ID NO: 179941 - DNA, 601 bp, Human
gctggttgagttgtgttatgttctaatcatgaatcatcagggagtcatcaaaagaagtgcattaaattagctgggtgtggtggcaggtggctgtaatcccagttgctcaggaggctgaggcaggagaatcatttgaacccgggaggtggaggttgcagtgagccgagatcacgccactgcactccagcctgggcgacagagtgagactgtttcagaaaaaagaaatacattgagtctactgacaagatatccacaacatgttaaaaagccaagtagcaaaatatagtatgcaatctaataytacgtaatgtaaacatgcagatggtacctatttaagtgtatttatctttccaaacacaccacatatgtttatacatgtgtgtgaaagggtatacatacactcaacagaggctatccctaaagaagggttgagagaagatgggataccaactattactttgatagttaattacgcctctgtgatttgaggcgtaattaacaaagtgatagttggtcataaaaaaatcatctaacgaatgtgacaatctatagttggtgcctactatcagcaaacggtacttactatgagtcatgctcttca

SEQ ID NO: 179942 - DNA, 601 bp, Human
aattccacttctagcaatgtatcttacaaatacatttacataaggaaacaaagaatgctatttgcaacattatttataatagggaaaaaaacctggcaacaacctaaatgacaatcaataggaatagctggttgagttgtgttatgttctaatcatgaatcatcagggagtcatcaaaagaagtgcattaaattagctgggtgtggtggcaggtggctgtaatcccagttgctcaggaggctgaggcaggagaatcatttgaacccgggaggtggaggttgcagtgagccgagatcacgcyactgcactccagcctgggcgacagagtgagactgtttcagaaaaaagaaatacattgagtctactgacaagatatccacaacatgttaaaaagccaagtagcaaaatatagtatgcaatctaatactacgtaatgtaaacatgcagatggtacctatttaagtgtatttatctttccaaacacaccacatatgtttatacatgtgtgtgaaagggtatacatacactcaacagaggctatccctaaagaagggttgagagaagatgggataccaactattactttgatagttaattacgc

SEQ ID NO: 179943 - DNA, 601 bp, Human
cccaaagcaatctcactcaaaatattaacaggtttggatgttccattttcgttttcattcttgtaagggagtagaggacagtttgaaagtaacagtatacttctagagttcccaaagaagaagcagcaaatgatactagccaggaaaacaaatactggaaaaaaagaataggacaattcactgtattaattgttaaatcaggctaaaatgtaagatcacagtcatgaaaacagtagtatgaaactggcttagaaatgaacaaaaagatcaagagaagaatcctgatagaagagcatatttkatcatttaggtggtatttcaaatcttcaaagaaagagcactgcttagcaaacaacattggaacatcccacaggtaacatgcaaacgagaaaaccagaaatctaactcactcctcataccagaatgtccagtgaattaaaagcaaacatcaacaacaaaaatgtacaagttctagaagaaaacctactcctatacatcttggcctaggtatgaaacaacctcaggagaaaggaaggcaaaatttctgcatctgaactacaaataaaaataatacaaaattctatggagtaaaaacaccata

SEQ ID NO: 179944 - DNA, 601 bp, Human
cattatttgcaggtgatacgattttatacctagaaaatgcaaaagaatcaactattagaaatagtcaaaggctttagcacaggtggttggttacaaaattaatacacagaaacaataatcttctctatatagaggtaaaaataagtgtaatttaaaaatcccatttttaaataatttcttaaatttacataaaaatgttcatattgaagaatctaaaacataaatacaaattaaagaaatagatagggtctatataaagaaaacttccaccctgtactgagtagagaaaagatggcttacmtaagtagaataacaccacaggaacctaggatgtaaagacgtcaactctccctaagtaactataaacccaaagcaatctcactcaaaatattaacaggtttggatgttccattttcgttttcattcttgtaagggagtagaggacagtttgaaagtaacagtatacttctagagttcccaaagaagaagcagcaaatgatactagccaggaaaacaaatactggaaaaaaagaataggacaattcactgtattaattgttaaatcaggctaaaatgtaagatcacagtcatgaaaacagta

SEQ ID NO: 179945 - DNA, 601 bp, Human
gtacagacccatctattcatcatagacttcactgtctgggaatgagccccggagcccaggctctgcaggttgttgctgttacgtaagccagtgcaggagccgtgctgagaaaaggaaactgcgcaatctgctcaggttcccaggaaggccagggtccttgtcccacctgaggagctgacttctcaactggcagcagattcaggcatgcacactgccttcgccggccactggaagggcactgctcccaacacccactcacacgctgcctggatggctctgatgggggccactgggcaggcckgacaggctgcctcaaggagctggggacctgtggtgtcagacaagctgaccaccccccggcaggggtgggacatacgtgtgaaaaggggagtctgggggtcccccacacagtccatctacgcagatgcaggccaagctccccagataagcctgcctcaaggattctggccgaggagcagagggggcccttcctggaggtcacctgcccttgaagcaggtagagaagacatcttagtgtggatcagtgctgacatctgtggagagtggactctcggcactttctgtctgtggactcacgtcc

SEQ ID NO: 179946 - DNA, 601 bp, Human
agagggagactccatctcaaaacaagaacaacaacaacaacaaaacgaagggtggcaaggtacccatttaggggagcctcaggcccctaagtcagttacttgcatttgacagtcgtaatgtgaggagcactgaataaggcacagtccaggtgctcagaaataacaatgaccaatgggccaggtgcacagcagagatcagtgttaggagtcagacctgcaggtgttgcatcggaatcccaagcaggcactggcccccatacaaactcgccaggcctccgtgtcttcactgtaaaatggaatygtaacaagcgcatacctcacagggatcctgggtggcaaacgaaatgggggaccagggtggacaggcagcatgggtagtggttaagaatgctaactctggaataagatggcctgggttcaaaccttgccccctcctccaacttagctgtgcaacatgggcaagttacttcacctccagatgcctcagtgactccatccataaaatggggacagtcatagtatctgcttcacagggtttatgtgaggatgaaatgcattcacacttctaggcagtgccatacttacagcagcacctggcact

SEQ ID NO: 179947 - DNA, 601 bp, Human
ttctcaatacatcattaccaattatcaaatcattacatctttatgaaaaagacttggcttatatgacacaggcagaagtgccaccctttcacaacattatgaaacgatgccaaataaggctagcacacctgccaccttttgcatttactgaagagctcttatgcatggacccacttggcctgtctcttagtcacagaagggggcatggggcagcctggctcggaacacctgtgcctgctgatagcagacgtgccagcctgccagagactgagaagctggacctcaaggtgttgggaggtcrggctgaggctgtggctgctgggccagctgatgcatggggaaaggatatgcatggtttccggagtaggaaaaaggtttaggaaataaacaagtggaaaaatatctggaaaatggaaccaggtacagtccctgccctcaaagagcaggtgctcagtctaaagaagtggtctatgcctgggtgcccactgctccagacagacttagaaattctataatacgtgtaagaaaaaaatcgttagtttccacttgttttttattctggggctggaggcgtggggcatggattcttaccctcttattt

SEQ ID NO: 179948 - DNA, 601 bp, Human
tagaataggcacaactgttctcaccatatgcaaggctcatcctcctccaaccttctcaatacatcattaccaattatcaaatcattacatctttatgaaaaagacttggcttatatgacacaggcagaagtgccaccctttcacaacattatgaaacgatgccaaataaggctagcacacctgccaccttttgcatttactgaagagctcttatgcatggacccacttggcctgtctcttagtcacagaagggggcatggggcagcctggctcggaacacctgtgcctgctgatagcagaygtgccagcctgccagagactgagaagctggacctcaaggtgttgggaggtcgggctgaggctgtggctgctgggccagctgatgcatggggaaaggatatgcatggtttccggagtaggaaaaaggtttaggaaataaacaagtggaaaaatatctggaaaatggaaccaggtacagtccctgccctcaaagagcaggtgctcagtctaaagaagtggtctatgcctgggtgcccactgctccagacagacttagaaattctataatacgtgtaagaaaaaaatcgttagtttccacttg

SEQ ID NO: 179949 - DNA, 601 bp, Human
agacacactcctggaacagcacagctctcatgagtccctgataatggcgtccgccacacgcccacacccttttggcactgtcttctgactgactgggctaaaaaaagcttcgataaaccccaaggatcagggctgggctgctgttcttctgaacataaacactggtcaggaggtgattacagttcaagcagaggggagcaaagtcccattttcccagcactaggattagatggcaaagtaatatcatgggcagtttttaccctcacaaatccctgacctccttccctgaggcccccttccyggagccgtctacatgcctgcctttactctacgccgggactccagtctataagaggataatcatttatgaataaacccatgatgatttacgttcccctcaaacgtgaacagaacccaatcatctgtttcttgtgttttccgattccaagaaaaaacatttcttggctgaggctgtcttgtttctggccagattttcctatatgatgtctatgttctctcgtgattaactcagagatatcaatctacaactacaggaaaacctcaatggctttacttaattggagcaccaggaggacatggt

SEQ ID NO: 179950 - DNA, 601 bp, Human
atctacagaattatagctgtatattggagtgctctgaatacttgatttggatggtctagaaatcctggggcacagcaatattttatgtcttcatctgggaggtcctaagaagggtttgcttatggaataaaagcccttatgatccgtgcacagcgaggcctctgtagtgttctgaagaagaaacctgacaggacacacaaaaattattttcctcgtggagggcatggaatcaagacagatccccgatccagtcctcactccctgaacactgcccagcttatgctaaatacgtatttatgcrcctactatataccaggcacagttctaggagctgataatgtagccgtgaacaaaatgaaacccctgcccacatgctgtccacattctgataggaaaagatggacaatctgtaatcagtacaacacagtgtgccctctggacataagggaggggcacagagaaaaaaacaaagtaggctgaggacagaagagcaggggatggggtcaggtagccagggacagtttcctgcaaagtgaggagccaagacctaaccaaggtgagccatggctttctgggtgaaaactgctccaggagaaggcaa

SEQ ID NO: 179951 - DNA, 601 bp, Human
aaaatgaataaacaaaatgtagtccatccatacagtagaatattattcaaccttaaaaaggaaggaaattttgaaacatgtacaatatagatgaaccttcaggacattatgctaagtgaggtaagccagtcatgaaaaaacaaatacttagaaacctaaagtagtcaaattcatagacacagaaagtagaatggtggttgccaggggctgagggaagagaaaatggggagttgatgtttgacggatacagagtttcagttgtacaagatgaaaagtgttctggagatgtgctacacaacartgtgaatatatttaatatttaatacctctgaactgtacatgtaaagatggtaaattttaagttatgtgcattttaccacaatttttaaaagtttagtaaagaaaaaaatcaaagcataataaagattgtattcatactttggatcatacaaaggatcaagaagaacatatttaattgtagatccattaaatggggtctcccactgcttttcattaggcttcagttgtgaaaaagctttgtggatagcaaagtgctaaaactggaaggctttttaaactctgatcttactactatctttac

SEQ ID NO: 179952 - DNA, 601 bp, Human
tttaaaaatacataattcaggccaggcgcagtggctcacacctgtaatcccagcactttcggaggccgaggtgggcggatcacaaggtcaggagatcaagaccatcctggctaacacggtgaaatcccgtctccactaaaaacacaaaaaattagccgggcatggtggcgggcacctgtagtcccagctactcgggaggctgaggcaggagaatggtgtgaacccaggaggcggagcttgcagtgagccgagattgtgccactgcactccagcctgggtgacagagcgagactccatctcaaaaaaaaaaaaaaaaaaaaaacataattcaaaggaagataagaaagaaaaggaatatagaacaagtagaacaaacagaaaacaaacagtaagatgacaggaaatagaaggatggaaaaatgtgctataaaaatactaaccaaacaagagctggcacatcatgcaaaatagactttaagacaagaagcattactagcaaaaaagatggacatttaataataaaaaagggtcaatttgccaggctgatacaacaatcctaaatctgtatatatccaataatatagcctcaaatctatatgaa

SEQ ID NO: 179953 - DNA, 601 bp, Human
ttctgctttctgactttcaccagaggattcataagagcatcctgaatccaaataacaaaattaaatatacactaaccacccgtccttaatcgcttcatgtaaatctgtggcattagaaactgaaaacaaaaattatctgagggtcatgttttgctatgcatttaatggatattacttctgcctgctccaagggcaatgttcagtttccacaaacagtgtagtttattatgaaaaataatttataaatcattcttgtttaaaacaaaatttttttaggagaattagtaacagaatttcaaaraagttgaataatttctaaagattaagatttcaacttcactcttttaatgtatttaaggtaataatcacttactttggtgattatttataacattaacagctctaagaggcctttaagggccattttgttatacaaaaaagaaacacatttataagcattcttagaataatgctaatgtcattagctacagaagcagcacatgctaagatatcagctttaattttaaattcatattagaccttaataaaataagtcaaggatgcattttgtaatatctagaataaccactaaaagaacagt

SEQ ID NO: 179954 - DNA, 601 bp, Human
aataaaacttcataatgatagttcgttcttgtgaataaatcctcaaatacatccctcttgcaaaaaaggttttctcttactgaccactcttcttccatcactgactgcagtggaaaattacattccactgtgaaatataatcctgttgatagtaacacctattgaggttttcatcaaattgctagatgagatggtgtaattagggacagccagggggaaaactacaaaggacacagaggacgtcagtccaaaggaggtaaaaactgaaaagataataccttcctcaaaccattgcagaagygtgtacctgcttgcctggtgacaaagtctttttgaaaatcaacctgtacccataattctgctttctgactttcaccagaggattcataagagcatcctgaatccaaataacaaaattaaatatacactaaccacccgtccttaatcgcttcatgtaaatctgtggcattagaaactgaaaacaaaaattatctgagggtcatgttttgctatgcatttaatggatattacttctgcctgctccaagggcaatgttcagtttccacaaacagtgtagtttattatgaaaaataatttataa

SEQ ID NO: 179955 - DNA, 601 bp, Human
tgatgaaaaataagccttccaacaccagagtatttctctttttgaatgtttctaccacatctaagaaaacagatgtcaccatggttaaaaaaaaaattgtaccttgcaaaaataaaacttcataatgatagttcgttcttgtgaataaatcctcaaatacatccctcttgcaaaaaaggttttctcttactgaccactcttcttccatcactgactgcagtggaaaattacattccactgtgaaatataatcctgttgatagtaacacctattgaggttttcatcaaattgctagatgagctggtgtaattagggacagccagggggaaaactacaaaggacacagaggacgtcagtccaaaggaggtaaaaactgaaaagataataccttcctcaaaccattgcagaagcgtgtacctgcttgcctggtgacaaagtctttttgaaaatcaacctgtacccataattctgctttctgactttcaccagaggattcataagagcatcctgaatccaaataacaaaattaaatatacactaaccacccgtccttaatcgcttcatgtaaatctgtggcattagaaactgaaaacaaaaatta

SEQ ID NO: 179956 - DNA, 601 bp, Human
cacagttggcgatagggcctttttttttttttttttttgagacagtttcactcttgtcgcccaggctagagtgcagtggtgcaatctcagctcactgcaacctctgcctcctgggttcagcgattctccttcctcagcctcccaagtagctgggattacagttaggtgccaccatgcctggctaattttgtatttttagtagagacagggtttcaccatgttggtcaggctggtctcaaacgcctggcctcaggtgatccacccacctcagctggagatagggcctttaaagaggcaatttagttaaaatgaggtcatgagggtggggccccaatctaatctgatcggtgtctttgtaagaggagagaatgtggacacataaagggacactaggcatgtgcgtgcacagagggaagaccatgtgaggacacagggagaaggcagccgtctacaagccaaggagagaggcctcaggaggagccaaagctgccggcaccatgatctcggacttccagcctccagaactgtgagagaaaaaaggtctgtcgtttaagcccccaatctgtggtattatgttagagctgccctagcacactgatag

SEQ ID NO: 179957 - DNA, 601 bp, Human
tcatctgaagaggcacccaggactggctgctgggttggctgtgcggtgtggagatggaggctgatgccattctaaagagtgtcagagagagagagagagcctcttgctggttgttttaggaacaacagtgttggctaataaattcctgcagacactctgaatataactgagagagctcagctggctctaacagcattatggactgaactatgttcatgtccttcactccccacaagtttatgtgttgaagccctaaccatcagtaccgtagaactggactacacagttggcgatagggcctttttttttttttttttttgagacagtttcactcttgtcgcccaggctagagtgcagtggtgcaatctcagctcactgcaacctctgcctcctgggttcagcgattctccttcctcagcctcccaagtagctgggattacagttaggtgccaccatgcctggctaattttgtatttttagtagagacagggtttcaccatgttggtcaggctggtctcaaacgcctggcctcaggtgatccacccacctcagctggagatagggcctttaaagaggcaattaagttaaaatgaggtcatga

SEQ ID NO: 179958 - DNA, 601 bp, Human
cacgaggtaggggaagatgcaagtttctcccgggggttgctttggacctaaagaggggtctatgctcattaccaaaggcagtctgcccagcataacctttgacaccacggactcacttgagccacagaatgtcatttatcaatttaatacatattcatgaagcaagtgctattcttaggtactaagaacttccaagctcctaaggtactgggcacctagtggtaaatgagacaaaagccttcgtgaagctgacgttctagcaaacacagacaacaggcaattatataccctgatgttgggragtgaccagtgctatgaagacactttgaggacagatggtctggggtggggggaatggtgcgctcgcttagctaggggctcgggaagacatttctgaggaaggagcatctgggcagcgacctgggaggagtgagggagtaagccatgtgggtatctgggggaagaaccttccgggaattccaggctttgaggaagggaccacacttggcacatgggagcagtagcagcaaggccagagtagcccagctgtggtattggagacgcgaggaggagctgaatctggagagggcagagcgggcca

SEQ ID NO: 179959 - DNA, 601 bp, Human
tagaagaaataagtcacaggaggttgaaaacaatgtactagcactggagaagtctgaacattttggtcaatgtctgtgaatgtttcaaagtttaaactggatggagtttactgagactctaatcaccgctcagcaagaaatctatgctaatcacatcaatattataacacaaacaagcaggtggaagaaaatccaaagatagctaatggataatactttgtctttggttcaattataggacttggtttctaaaggagctgctaactcattcattcactcatcaaacatgtattgatcacayataacatggcaatgactgtgctaggagctggcaatactaaaattgtttcttcattccagaacatcagagattagttgggaacagagtcaccctctactgagaaaaggccatcagaaggccggcaggggtcagctccatggagaagaggtctggggcatcccaggcggaggcaactgcagtttccatcctacggtgccctgtgtcctgggaacctcaggtagttgagcaccactgcactaatgagctgagtgagggagaagcaagagctgagacacaacagggtccaaatgagaggcctta

SEQ ID NO: 179960 - DNA, 601 bp, Human
gcttctagcgtatgccaagcactatggctgagacggtcttattctcaaggcgagcccactgaaaggaggtcaaacctacagcccggagaattgatgactaggggtgagaaagaagcttatgcaaagttaaagtgttttttatttcatttagatgtatatttttagagacaagctctcactctgtcacccaggttggagtgcagtgttacgatcatggctcactgcagcctcaacctcccgggctcaaacaatctgcccacctcagcctcccaagcaactggggttacaggtgtgtgccacmgtgccaggtgaaagtgtttttcaaaaggcatttaacataggaagattggtgactggacttcctaagcgcagttccattaacagcaacgacacgtgcaaaatgagctcctgtagctgaacctcagaagaagagacgagacagcggtgtgttaagggaccactagtgaccccaaaaggtgtcatttaatcctcaggacagccctgaggtaggcattattttacaaatgaggaaataaactcaaagaatttggacaggcccaacttaggtctgtctagcactagagtctgggttccttccatc

SEQ ID NO: 179961 - DNA, 601 bp, Human
tgtaaattttagagtagcctctgagcagtattatttagtcacactataggttgcataggtttctgtgggcttgagaatacagtattgtctctgtggaaaatgccttccagcactaaacagcaagtgcagagagagaatttttttagactatagcttatttttgaagttggaagaattgctatataggaatcaccataaatcctaaaagactgggcctcaaataagagcttttttcttttatctcaaaataatttaatacaaatactaacaaacgcacctttcttccatggtgatgttttaygtgttaccatatcctagattagaaacccacttatgatagcatctatgagctcagacagaaaggcagggcctgtccttcctccacctgcctaccctggagtcactgccagaggctaaggtggagaaatcactgtggcagagctttcaggatggagtgcctgatgggatacaggggaggaacaactggagagaaaaggaaggaaaaggaaggaaaaagcgactcacaatttaagcacatcctgtgtgccagcaactgtgctaggtgtttatatatatcatcttaaatttcttatcttggctc

SEQ ID NO: 179962 - DNA, 601 bp, Human
gaaaatgaggaagaaacaaaagtgaaacctctgataaacccatcagatcttgtgagacttattcactaccatgagaaaagcatgggggacaccgcccccaggattcaaatgatctcccaccaggtccctcccacaacatgtgggaattatgggagtacaattcaataggagatttgagtggggacaaagagccaaaccatatcacttagtgtgtaaattttagagtagcctctgagcagtattatttagtcacactataggttgcataggtttctgtgggcttgagaatacagtattgtcyctgtggaaaatgccttccagcactaaacagcaagtgcagagagagaatttttttagactatagcttatttttgaagttggaagaattgctatataggaatcaccataaatcctaaaagactgggcctcaaataagagcttttttcttttatctcaaaataatttaatacaaatactaacaaacgcacctttcttccatggtgatgttttatgtgttaccatatcctagattagaaacccacttatgatagcatctatgagctcagacagaaaggcagggcctgtccttcctccacctgcc

SEQ ID NO: 179963 - DNA, 601 bp, Human
cagtgacctggaaggccacattcaaatttaggattctcagctccctggagtccctcactggaatggacaaagaatggagagtgggaccaggcctcacctgaagacccaggccttacctgaaaaaaaggggcagaggaggggtcagaagcacaccaagcaaactcacttcactgttctctgacctgatggtttttgtgttggtccctgctgtgttgctctcagggaatacctgagactgtgtaatgtataaagaaaagaggtttacttagctcatggttctgcaggctgtacaagcacgcamcagctctgctcggcttctggtgtggcctcaggaagcttctactcatggtggaaggtgaagggggagcaggcgtgtcacatggcaagagaaagagcgagagaggaggaggtgccaggctcctttaaccaaccagctcttctgtgaactcatagagtaagaactcaactcactactgcaagaacagcacccagccgttcatgagggatctacccccttgacccaaacatctcccaccaggcctccctgcaacactggggatcacatttgaacatgacatttggaggggacaaacatccaaac

SEQ ID NO: 179964 - DNA, 601 bp, Human
aattctgtgcgaaccccagacccactcaatattccaggactagggtctgtggcaggttacccttcctgaacaaatggccactaacattccctgagtccacatggctgaaagttacacttcatggcaacaaactgtaaataaaatatgttccattttccttccttgaaaacaaatgtggtcacagtgacctggaaggccacattcaaatttaggattctcagctccctggagtccctcactggaatggacaaagaatggagagtgggaccaggcctcacctgaagacccaggccttacctgaaaaaaaggggcagaggaggggtcagaagcacaccaagcaaactcacttcactgttctctgacctgatggtttttgtgttggtccctgctgtgttgctctcagggaatacctgagactgtgtaatgtataaagaaaagaggtttacttagctcatggttctgcaggctgtacaagcacgcaccagctctgctcggcttctggtgtggcctcaggaagcttctactcatggtggaaggtgaagggggagcaggcgtgtcacatggcaagagaaagagcgagagaggaggaggtgccaggctc

SEQ ID NO: 179965 - DNA, 601 bp, Human
ggaagctgccttttcctgcgagtaggtagaggccgggcaaccatgtggcatgtggctgggcagtccagccccagagtggattgcttctgggcaaatgactcccagagtcttctcctaatccagggtctccaaattctgtgcgaaccccagacccactcaatattccaggactagggtctgtggcaggttacccttcctgaacaaatggccactaacattccctgagtccacatggctgaaagttacacttcatggcaacaaactgtaaataaaatatgttccattttccttccttgaaaamaaatgtggtcacagtgacctggaaggccacattcaaatttaggattctcagctccctggagtccctcactggaatggacaaagaatggagagtgggaccaggcctcacctgaagacccaggccttacctgaaaaaaaggggcagaggaggggtcagaagcacaccaagcaaactcacttcactgttctctgacctgatggtttttgtgttggtccctgctgtgttgctctcagggaatacctgagactgtgtaatgtataaagaaaagaggtttacttagctcatggttctgcaggctgt

SEQ ID NO: 179966 - DNA, 601 bp, Human
gcagtattaggtgaattcaatgagcctccttctatgtgtgctcggcaaaatgtgtggcttacataactagcacaaagagctggtataccttgtgatataatacacttcacagtatctcttccccagcgaccatgtatacacatttgcctgaagctctgcaagggcggagctcacacctgggttttgctccccaatgtgtgtgtgttcgtgtgaaccatctaccaggtgtcggggctggagactacgttcacgcaggaacactttccgtcacctgctgaacctgctacgtctctggaatgtmctacacaacagtacagcagaagtggagatatttctggcctaagggaaaggggcactatttcagagctgcataaagatgaaatgggctgtctagggacagaggaagctgccttttcctgcgagtaggtagaggccgggcaaccatgtggcatgtggctgggcagtccagccccagagtggattgcttctgggcaaatgactcccagagtcttctcctaatccagggtctccaaattctgtgcgaaccccagacccactcaatattccaggactagggtctgtggcaggttacccttcctga

SEQ ID NO: 179967 - DNA, 601 bp, Human
atgggaaaacatggcctacacaagaaatggtgccactacatagccccagaactctttcctgaccaacacattcattttttgtcattttaaaatgcagtattaggtgaattcaatgagcctccttctatgtgtgctcggcaaaatgtgtggcttacataactagcacaaagagctggtataccttgtgatataatacacttcacagtatctcttccccagcgaccatgtatacacatttgcctgaagctctgcaagggcggagctcacacctgggttttgctccccaatgtgtgtgtgttcrtgtgaaccatctaccaggtgtcggggctggagactacgttcacgcaggaacactttccgtcacctgctgaacctgctacgtctctggaatgtactacacaacagtacagcagaagtggagatatttctggcctaagggaaaggggcactatttcagagctgcataaagatgaaatgggctgtctagggacagaggaagctgccttttcctgcgagtaggtagaggccgggcaaccatgtggcatgtggctgggcagtccagccccagagtggattgcttctgggcaaatgactcccagag

SEQ ID NO: 179968 - DNA, 601 bp, Human
gctcacactctgtggcaatgtcacctatcctatcccgtgccctcaaatgggggctactgctccactgacacgctggttgggaaggtgagggcgctgcagctgaaacagctgtattacacaggagtacagccataactgaggaagatgcttctttaataaccacttatatgagtgtgtgtgtatatgtattgaacaaactgttcaacagatgggaaaacatggcctacacaagaaatggtgccactacatagccccagaactctttcctgaccaacacattcattttttgtcattttaaaakgcagtattaggtgaattcaatgagcctccttctatgtgtgctcggcaaaatgtgtggcttacataactagcacaaagagctggtataccttgtgatataatacacttcacagtatctcttccccagcgaccatgtatacacatttgcctgaagctctgcaagggcggagctcacacctgggttttgctccccaatgtgtgtgtgttcgtgtgaaccatctaccaggtgtcggggctggagactacgttcacgcaggaacactttccgtcacctgctgaacctgctacgtctctggaatgt

SEQ ID NO: 179969 - DNA, 601 bp, Human
tgttttcagggtaaaggaacatggggagacaaagaccccaacttgttagaactaacatctaaagcagaaagccagttctctcactttagccaccagaaacctgagaatacacagtaaaatctagcataaaactcaacttggggccaatctgacagaatatttttgagttaaaatttagggtttattgatgtggacactgaaaagtaatccaacctttctggaaaaccatttgacaaaatgcaatcatatttataaagggtccgtagtcttgagagttggtaattccatttggggaaattawtcctacattaaaaaagataagttgtataaagatgtttaagtctgctgtttatgacagaaaaaacatgtggggaaatgaagaaacagctaccgttcactcagcagagtgctggtttatcagcaccaagggcagggaagcatgaaaaggcttccagaactgcattgaacttagcatggctgaagtccatggggtagggcagtgtattagtccattctcacactgctatagagaactgcccaatggccaggcacggtggctcatgtctgtaatcccagcactttgggaggctgaggcaggtgg

SEQ ID NO: 179970 - DNA, 601 bp, Human
tcatgttgcatccatggcaacctgctgccaccagcacgccatcagcttatcttattaagttgcctattttgttcctcttcatttccacctttgtttgacacacagaacagggactcttccataaacaaaccttttaacttccccttacctccacacgcacaccattgccatcagtattgattgtggtgtccgctgttttcagggtaaaggaacatggggagacaaagaccccaacttgttagaactaacatctaaagcagaaagccagttctctcactttagccaccagaaacctgagaayacacagtaaaatctagcataaaactcaacttggggccaatctgacagaatatttttgagttaaaatttagggtttattgatgtggacactgaaaagtaatccaacctttctggaaaaccatttgacaaaatgcaatcatatttataaagggtccgtagtcttgagagttggtaattccatttggggaaattattcctacattaaaaaagataagttgtataaagatgtttaagtctgctgtttatgacagaaaaaacatgtggggaaatgaagaaacagctaccgttcactcagcagagt

SEQ ID NO: 179971 - DNA, 601 bp, Human
gggtggtgccacctcagtccctcttcccaaggtgctctcactcacctgaaacttatcctagactttgaaagtctagaatactttcaaaaggacactttcacatcaactcaggcaaatgcaaaagttaaattctccattgtcaacggtggtatcagggctctgggctacccaggatcaaatcccagattcgctcagccctcgccacctttggtaagttatttgatctccatgtactttagttttctcatccataaaatacaataataataacatggtacctagcttgtgcagtggtgatgargattcaatgagataggtgtaaaatgctcatggtacccagtgatattataataacgcacagtaggatattcttatctacgataatcagagatcctattcatgttgcatccatggcaacctgctgccaccagcacgccatcagcttatcttattaagttgcctattttgttcctcttcatttccacctttgtttgacacacagaacagggactcttccataaacaaaccttttaacttccccttacctccacacgcacaccattgccatcagtattgattgtggtgtccgctgttttcaggg

SEQ ID NO: 179972 - DNA, 601 bp, Human
aaggagtgatgtgggagagcagaggcgacatgggtggtgccacctcagtccctcttcccaaggtgctctcactcacctgaaacttatcctagactttgaaagtctagaatactttcaaaaggacactttcacatcaactcaggcaaatgcaaaagttaaattctccattgtcaacggtggtatcagggctctgggctacccaggatcaaatcccagattcgctcagccctcgccacctttggtaagttatttgatctccatgtactttagttttctcatccataaaatacaataataatamcatggtacctagcttgtgcagtggtgatgaagattcaatgagataggtgtaaaatgctcatggtacccagtgatattataataacgcacagtaggatattcttatctacgataatcagagatcctattcatgttgcatccatggcaacctgctgccaccagcacgccatcagcttatcttattaagttgcctattttgttcctcttcatttccacctttgtttgacacacagaacagggactcttccataaacaaaccttttaacttccccttacctccacacgcacaccattgccatca

SEQ ID NO: 179973 - DNA, 601 bp, Human
tccttccatgtgactgcattaaccagagtggggcactcccagatctgccccatactttctgtgaggtcatactgaacaagcacttcaagaaaatctgactgaatgctccatgaattccattatgaaggcatataaaacaatcatcttgctccatttccttcaggggcaatttcttaaggctacgttttggccagaagtcaataaagacttcatggagcaccgatttactctgcagtgacatcttttggtacattcttacgctcctggaaaatcaaacactctatattccatgacttccccraatattctgctccatttggtcatcactgattagatgcctaccatgtgccaggcattcccaggaaagcgtatttccatggtggcatatgaataaagccaggtgacaaatgctgtgggcaaggggagcatgcacagagggtccccaaggagtgatgtgggagagcagaggcgacatgggtggtgccacctcagtccctcttcccaaggtgctctcactcacctgaaacttatcctagactttgaaagtctagaatactttcaaaaggacactttcacatcaactcaggcaaatgcaaaagtt

SEQ ID NO: 179974 - DNA, 601 bp, Human
tgcaattttctataggcacacaggattgagggatttggttccttaaaaggctcgagatcctatcccttctcattcggagactacccagaaaatccctggtcatttatcactgcagtgcactggtgccacactcaattacatttccttccatgtgactgcattaaccagagtggggcactcccagatctgccccatactttctgtgaggtcatactgaacaagcacttcaagaaaatctgactgaatgctccatgaattccattatgaaggcatataaaacaatcatcttgctccatttccytcaggggcaatttcttaaggctacgttttggccagaagtcaataaagacttcatggagcaccgatttactctgcagtgacatcttttggtacattcttacgctcctggaaaatcaaacactctatattccatgacttccccgaatattctgctccatttggtcatcactgattagatgcctaccatgtgccaggcattcccaggaaagcgtatttccatggtggcatatgaataaagccaggtgacaaatgctgtgggcaaggggagcatgcacagagggtccccaaggagtgatgtggg

SEQ ID NO: 179975 - DNA, 601 bp, Human
tgggctgctcctgcccactgcaattttctataggcacacaggattgagggatttggttccttaaaaggctcgagatcctatcccttctcattcggagactacccagaaaatccctggtcatttatcactgcagtgcactggtgccacactcaattacatttccttccatgtgactgcattaaccagagtggggcactcccagatctgccccatactttctgtgaggtcatactgaacaagcacttcaagaaaatctgactgaatgctccatgaattccattatgaaggcatataaaacaaycatcttgctccatttccttcaggggcaatttcttaaggctacgttttggccagaagtcaataaagacttcatggagcaccgatttactctgcagtgacatcttttggtacattcttacgctcctggaaaatcaaacactctatattccatgacttccccgaatattctgctccatttggtcatcactgattagatgcctaccatgtgccaggcattcccaggaaagcgtatttccatggtggcatatgaataaagccaggtgacaaatgctgtgggcaaggggagcatgcacagagggtc

SEQ ID NO: 179976 - DNA, 601 bp, Human
gaaatacttgaaagcagaactgcaagaactagcactttctggaaagtgttgacctctttctggataattttataaagaagttagctacctcagtaaactgtttatgaaaaaaagagaagctaaacatgaatccatgcacagtgtcaatgcttttgatactgaattctaactcaagacctgaattttaactcaagaatattccgtcaatattggcccgacgttcagggccacggtggtcccacagctgaggacagctggagcacgctgggctgctcctgcccactgcaattttctataggcwcacaggattgagggatttggttccttaaaaggctcgagatcctatcccttctcattcggagactacccagaaaatccctggtcatttatcactgcagtgcactggtgccacactcaattacatttccttccatgtgactgcattaaccagagtggggcactcccagatctgccccatactttctgtgaggtcatactgaacaagcacttcaagaaaatctgactgaatgctccatgaattccattatgaaggcatataaaacaatcatcttgctccatttccttcaggggcaatttctta

SEQ ID NO: 179977 - DNA, 601 bp, Human
catttgtgcaggaagtacagtaagagcctgggggaagctaaatggaaaattagtggtcaaataaagaaacaaaagagagcaatgtccagtaaggccattctgactataaagccattctgactatactcttacaaactgatgtgatttggctctgtgtccccacccaaatctcaccatgaattgtaatctccataatccccacatgtcaagggtgggaccaggtggaggtaattggatcatgggggtggtttccctcatcctgttctggtgataatgagtgagtttcaggggatccgatgaktttataagtgcctatcatttcccctgcttgcactcactccatcctgccgccctgtgaagaaggttgcctgcttctcctttgccttcctccatgattgtaagtttcctgaggcctccccagcaatgcagactgtgagtcaattaaacctctttcctttataaattaccctctctagggtagttctttatagcagcatgagaatggactaattcacaaactagtgctgtgttgacatcatgatcagagtaaatacgggataaaagttcccaagctatgcaactttctccagcaggagaaact

SEQ ID NO: 179978 - DNA, 601 bp, Human
ttctgggcagtggcttatatgttcaagaatgagttcagatgagtgcaacttcaagtagagctccacaatgaatccaattacgtaggcggccaccacagcacttctttaactttcgtaggcaaggaagaagataaagaactcatttgtaaggtatacaaatgccctgctggtaatggtctaataagcctaacaatttaaatgccatgctctgaaataaccctttgtttcggtggattgagtcagccaaagtatccggaactgggtcccacagagggtcctgatgttctttggaacatagctmacattttccagtttattatgcaggttctgactgataataattctgtcacagtcaacctacactttgcagtttacaaggtcatttcacatgtattaactctttcaagtttctctaaaacctggagaggatatagggaaggtgttaactatccttacctttgaagaaaggaggcttggtgaattgagactacttgcctaaggtcaggcagctcacaatcgccagcatcaacattcacattcctgccctgtgattctgtggtcccggatggctgtacccaaatatttcttcctgaaggtcttt

SEQ ID NO: 179979 - DNA, 601 bp, Human
ggaaattgagagaatgcaaagatggatggatgtagtctacttattccaggaatagttggaaaatttggaataaggccaggattagggaaaaaataaaacaaaacttgcctgacaaattgagtagtgttgggaagtttaatacaatctgtgactgattcacagcgcaggagtctttctgtaagaagagccctgtttgttctgggcagtggcttatatgttcaagaatgagttcagatgagtgcaacttcaagtagagctccacaatgaatccaattacgtaggcggccaccacagcacttctttaactttcgtaggcaaggaagaagataaagaactcatttgtaaggtatacaaatgccctgctggtaatggtctaataagcctaacaatttaaatgccatgctctgaaataaccctttgtttcggtggattgagtcagccaaagtatccggaactgggtcccacagagggtcctgatgttctttggaacatagctcacattttccagtttattatgcaggttctgactgataataattctgtcacagtcaacctacactttgcagtttacaaggtcatttcacatgtattaactctttca

SEQ ID NO: 179980 - DNA, 601 bp, Human
tttctagctctcgcttttccagtaacaaactgagttgcactggggagaacatttcatctcctggatctcgccctgtctgtcgcaaaatcaacggtaaaggctccctgggctccaatgctccaatggaattcagggaatccaaaaggatgtgaccggaaagaacacaatcatggataatctcattcagcttatataagtgaacaaagtgtgggaaagcaaggcagaggtattagcactcaagtgtattaatatctatgctaatggaatactacaagaaacattccacctaaatgctaaaaayaggtttccaattaatcataatttaacaaaatacaaattgctgtcagtctagctacatgaaattcccactagggccactggaaattgagagaatgcaaagatggatggatgtagtctacttattccaggaatagttggaaaatttggaataaggccaggattagggaaaaaataaaacaaaacttgcctgacaaattgagtagtgttgggaagtttaatacaatctgtgactgattcacagcgcaggagtctttctgtaagaagagccctgtttgttctgggcagtggcttatatgttcaa

SEQ ID NO: 179981 - DNA, 601 bp, Human
ccaacaccctgagatcccagcaggcacctttaactatcacagtgtgcctttgccaagcctggggaagatgctaaaatgagtgacagattcagttacattagcaagtaacacgtggtggctttttaaaatttgagacaattttttaaaatagtaaacatcaacacaactttctcatttaacatacttgaaagatgagaaaggtggtggccatctttcacaaaaaaagatgatgctgatagatttaacagccactagtgatgaagatggcgatgatgaagatgatgagaaatagcagcgatcygaaattgactgccagtcacctatcaggtatggatgtaagcagtcaacactcactctctcatgtaaccctcaagccactctaggagacaggtactatcacttttttataggtgaggaactaaggctacatgttgtgcttaattctcttggatgtccgacctggaatcagaatttgaggtaaagtgacaatgaaattgtacccagcctaacacaaattcttaaaatagtgaagaataatccatcaagcctgtgatgaactatgttgacaagttcaagctgttgaggaggtgcttgtgcgtta

SEQ ID NO: 179982 - DNA, 601 bp, Human
ggtcacgtgattgctcaagtcggggaatgagtcaaagggaaggctagaaagacagtccaacccaacaccctgagatcccagcaggcacctttaactatcacagtgtgcctttgccaagcctggggaagatgctaaaatgagtgacagattcagttacattagcaagtaacacgtggtggctttttaaaatttgagacaattttttaaaatagtaaacatcaacacaactttctcatttaacatacttgaaagatgagaaaggtggtggccatctttcacaaaaaaagatgatgctgatagatttaacagccactagtgatgaagatggcgatgatgaagatgatgagaaatagcagcgatccgaaattgactgccagtcacctatcaggtatggatgtaagcagtcaacactcactctctcatgtaaccctcaagccactctaggagacaggtactatcacttttttataggtgaggaactaaggctacatgttgtgcttaattctcttggatgtccgacctggaatcagaatttgaggtaaagtgacaatgaaattgtacccagcctaacacaaattcttaaaatagtgaagaataatcc

SEQ ID NO: 179983 - DNA, 601 bp, Human
cctcacacttggatagctcactccagccacctatgtcagaaacactaactcataattcccacaacgccccactgaggtgtgcaggtggcagcccacatgtttctgttccatctatggaaggctggtgcaggtcacgtgattgctcaagtcggggaatgagtcaaagggaaggctagaaagacagtccaacccaacaccctgagatcccagcaggcacctttaactatcacagtgtgcctttgccaagcctggggaagatgctaaaatgagtgacagattcagttacattagcaagtaacaygtggtggctttttaaaatttgagacaattttttaaaatagtaaacatcaacacaactttctcatttaacatacttgaaagatgagaaaggtggtggccatctttcacaaaaaaagatgatgctgatagatttaacagccactagtgatgaagatggcgatgatgaagatgatgagaaatagcagcgatccgaaattgactgccagtcacctatcaggtatggatgtaagcagtcaacactcactctctcatgtaaccctcaagccactctaggagacaggtactatcacttttttatagg

SEQ ID NO: 179984 - DNA, 601 bp, Human
gagcccctggtaaaggtaatgtccattcggctagataagccacatggacacctcacacttggatagctcactccagccacctatgtcagaaacactaactcataattcccacaacgccccactgaggtgtgcaggtggcagcccacatgtttctgttccatctatggaaggctggtgcaggtcacgtgattgctcaagtcggggaatgagtcaaagggaaggctagaaagacagtccaacccaacaccctgagatcccagcaggcacctttaactatcacagtgtgcctttgccaagcctrgggaagatgctaaaatgagtgacagattcagttacattagcaagtaacacgtggtggctttttaaaatttgagacaattttttaaaatagtaaacatcaacacaactttctcatttaacatacttgaaagatgagaaaggtggtggccatctttcacaaaaaaagatgatgctgatagatttaacagccactagtgatgaagatggcgatgatgaagatgatgagaaatagcagcgatccgaaattgactgccagtcacctatcaggtatggatgtaagcagtcaacactcactctctca

SEQ ID NO: 179985 - DNA, 601 bp, Human
tgtaaaaggctgggcatggtggctgacgcctgtaatcccaacacttgggaggccgaggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggaggcggaggttgcagtgagccgagatcacgccactgcactccagccttggtgacagagtgagactctgtttcgaaaaataaaatwaaattaaattaaatttaaaaaagctgtgaagaccacaccagagcccctggtaaaggtaatgtccattcggctagataagccacatggacacctcacacttggatagctcactccagccacctatgtcagaaacactaactcataattcccacaacgccccactgaggtgtgcaggtggcagcccacatgtttctgttccatctatggaaggctggtgcaggtcacgtgattgctcaagtcggggaatgagtcaaagggaaggctagaaagacagtccaacccaacaccctgagatcccag

SEQ ID NO: 179986 - DNA, 601 bp, Human
gaagggtgctttcactgcactcctgatgaaaatatggggacacatttatggtcctttaaaagctgtaaaaggctgggcatggtggctgacgcctgtaatcccaacacttgggaggccgaggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggaggcggaggttgcagtgagccragatcacgccactgcactccagccttggtgacagagtgagactctgtttcgaaaaataaaataaaattaaattaaatttaaaaaagctgtgaagaccacaccagagcccctggtaaaggtaatgtccattcggctagataagccacatggacacctcacacttggatagctcactccagccacctatgtcagaaacactaactcataattcccacaacgccccactgaggtgtgcaggtggcagcccacatgtttctgttccatctatggaaggctggtgcaggtcacgtgattgctcaa

SEQ ID NO: 179987 - DNA, 601 bp, Human
ggttgcagggccatgctgagaagggtgctttcactgcactcctgatgaaaatatggggacacatttatggtcctttaaaagctgtaaaaggctgggcatggtggctgacgcctgtaatcccaacacttgggaggccgaggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggagkcggaggttgcagtgagccgagatcacgccactgcactccagccttggtgacagagtgagactctgtttcgaaaaataaaataaaattaaattaaatttaaaaaagctgtgaagaccacaccagagcccctggtaaaggtaatgtccattcggctagataagccacatggacacctcacacttggatagctcactccagccacctatgtcagaaacactaactcataattcccacaacgccccactgaggtgtgcaggtggcagcccacatgtttctgttccatctatggaaggctggtgc

SEQ ID NO: 179988 - DNA, 601 bp, Human
tagcaaaaatatttagaacacttttcaaaaggctaaaaaaatatgacagaacgtttcagtgcaccgttcaggtgaagaccaagtattattgaagtttttgtttcttccaatgtaacagaagaatactgagcccagtggtgtgacgtcaatcacattacctatgaggttgcagggccatgctgagaagggtgctttcactgcactcctgatgaaaatatggggacacatttatggtcctttaaaagctgtaaaaggctgggcatggtggctgacgcctgtaatcccaacacttgggaggccraggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggaggcggaggttgcagtgagccgagatcacgccactgcactccagccttggtgacagagtgagactctgtttcgaaaaataaaataaaattaaattaaatttaaaaaagctgtgaagaccacaccagagcccctggtaaa

SEQ ID NO: 179989 - DNA, 601 bp, Human
tctctgatactctgatgatactaaaaatatacaacagaactctcttggaaatagtttatttttgcaatcattgtaatacagtcagtagcaaaaatatttagaacacttttcaaaaggctaaaaaaatatgacagaacgtttcagtgcaccgttcaggtgaagaccaagtattattgaagtttttgtttcttccaatgtaacagaagaatactgagcccagtggtgtgacgtcaatcacattacctatgaggttgcagggccatgctgagaagggtgctttcactgcactcctgatgaaaayatggggacacatttatggtcctttaaaagctgtaaaaggctgggcatggtggctgacgcctgtaatcccaacacttgggaggccgaggcaggcggatcacctgaggtcaggagttcgagaccagcctggccaacatggtaaaaccccatctctactaaaaatacaaaaattagctgggtatggtggtacacgcctgtaatctcagctactcgggaggctgaggcaggagaatttcttgaacccgggaggcggaggttgcagtgagccgagatcacgccactgcactccagccttggtgac

SEQ ID NO: 179990 - DNA, 601 bp, Human
cgaggcaggtggatcacgaggtccaggagattgagactatcctggctaacacgatgaaaccctgtctctacgaaaaatacaaaaaattagccgggcatggtggcgggtgcctgtcgtctcagctactcgggaggctgaggcaggagaatggtgtgaacccgggaggcagagcttgcagtgagctgagatcgtgccactgcgctctaacctgggcaacagagcgagactccatttcaaaaaataaataaataaataaataaataaataaataattaaaggccaaaaaaaaaaaaaaaagagyagtaaagacttgaggctaggtgaggtggtacatgtctgtaatctcagcactttgggaggctgaggcgggaggatagcttgagctcaggagtttcggaccagcctgagcaacatggtgagaaactcaatctctacaaaaaatagaaaaattagccggacatggtggtgtgcgcctctagtcccagttacttgggaggctaaagtaggagaatcgcttgagcccaggaggtcgaggctgcagtgagctgagatcgtgccactgcactccagcctgggtgacagactgagaccttgtctcaaa

SEQ ID NO: 179991 - DNA, 601 bp, Human
cattagaatatcttccatgcttttgtatacacttgacaacctccataataaaaaggtatttttaaaaaaataaaaggcaggccgggcaccgtggctcaaacctgtaatcccagcactttgggaggccgaggcaggtggatcacgaggtccaggagattgagactatcctggctaacacgatgaaaccctgtctctacgaaaaatacaaaaaattagccgggcatggtggcgggtgcctgtcgtctcagctactcgggaggctgaggcaggagaatggtgtgaacccgggaggcagagcttrcagtgagctgagatcgtgccactgcgctctaacctgggcaacagagcgagactccatttcaaaaaataaataaataaataaataaataaataaataattaaaggccaaaaaaaaaaaaaaaagagcagtaaagacttgaggctaggtgaggtggtacatgtctgtaatctcagcactttgggaggctgaggcgggaggatagcttgagctcaggagtttcggaccagcctgagcaacatggtgagaaactcaatctctacaaaaaatagaaaaattagccggacatggtggtgtgcgcct

SEQ ID NO: 179992 - DNA, 601 bp, Human
gaatatagggagttcattagaatatcttccatgcttttgtatacacttgacaacctccataataaaaaggtatttttaaaaaaataaaaggcaggccgggcaccgtggctcaaacctgtaatcccagcactttgggaggccgaggcaggtggatcacgaggtccaggagattgagactatcctggctaacacgatgaaaccctgtctctacgaaaaatacaaaaaattagccgggcatggtggcgggtgcctgtcgtctcagctactcgggaggctgaggcaggagaatggtgtgaacccrggaggcagagcttgcagtgagctgagatcgtgccactgcgctctaacctgggcaacagagcgagactccatttcaaaaaataaataaataaataaataaataaataaataattaaaggccaaaaaaaaaaaaaaaagagcagtaaagacttgaggctaggtgaggtggtacatgtctgtaatctcagcactttgggaggctgaggcgggaggatagcttgagctcaggagtttcggaccagcctgagcaacatggtgagaaactcaatctctacaaaaaatagaaaaattagccggacat

SEQ ID NO: 179993 - DNA, 601 bp, Human
aagacggcatgtcattacaccttactcaaagggactcctcaatatttaatcagcgattttttacattattacctaaaggaactggagtactttaagttgcctcaatttgctggcattttaaggaagataaatgctttagaattacttatgattaagacaaaaatctcagaaacaatgcactattcgaatctttagctagagctctcgggaggagagtaaacaagataactctactggttgcttctcatactcatcttctttctttgagacagaaatctttttattttcctagttagtaatsaagtatgtgtttctatggaaaaaatgtaaacacattttgaattatgccatcgctttcaccttgaaatcattattttattaagaatcactcagtatttctaactacctactagcaagtcatttttagaaatctttctttcaaagtgaattctgtattaggtgctgaaagtgtggtgctgaaaccacagagctgctgatacatctggaggctggggtaaacactggctgctgaaaccaccaggtgagaggcggatcaggaattgcagaagctgggccagactgaacacacctgaagccaggg

SEQ ID NO: 179994 - DNA, 601 bp, Human
atgaagacaagtgggctgtgtaaaaaaaaaatcttagaatgaagacttaggaatagcgatcatgggtcccaggggaagacttagatgaccaacagttctaaccaccttccttgctcagaaagtgtccagtcaatggagaaaggaaggcattattagctcttgataaggctttggcagaatttgggacagatggctgtgtgctcagaggatcaagtgaagtttaagatacaaggtggaaaggccagtaggactcacgtgatgtctctatcagggttcctctccatcctagggtgttcctcastcctgctggagggctggtgtttatatgatgtagagaggtttgaggtcttggatacagaagggctggctctgcattactagcgttagaggcacgataccctttagggtttggcttcttgttgaactctacagatgttgtttggtatatagtgtccaagaacagtggcatcacctgtgagcttgccagaaacgcagaatctagagccccacctgagatctactcaaggagaattttcattttaacaagatccgaagtgactcctgtacatagtaaggtctgggaggcattggtctaaggtag

SEQ ID NO: 179995 - DNA, 601 bp, Human
ccactaaactttctgaactctccctgaatgttggaggatgaagacaagtgggctgtgtaaaaaaaaaatcttagaatgaagacttaggaatagcgatcatgggtcccaggggaagacttagatgaccaacagttctaaccaccttccttgctcagaaagtgtccagtcaatggagaaaggaaggcattattagctcttgataaggctttggcagaatttgggacagatggctgtgtgctcagaggatcaagtgaagtttaagatacaaggtggaaaggccagtaggactcacgtgatgtcyctatcagggttcctctccatcctagggtgttcctcactcctgctggagggctggtgtttatatgatgtagagaggtttgaggtcttggatacagaagggctggctctgcattactagcgttagaggcacgataccctttagggtttggcttcttgttgaactctacagatgttgtttggtatatagtgtccaagaacagtggcatcacctgtgagcttgccagaaacgcagaatctagagccccacctgagatctactcaaggagaattttcattttaacaagatccgaagtgactcctg

SEQ ID NO: 179996 - DNA, 601 bp, Human
tttaagtcaatcttaaagaattctgaagtctcccaaacctttgttcattggacttccagcatttttcccttgccactaatgtcaaaatcccttcttatcccactaaactttctgaactctccctgaatgttggaggatgaagacaagtgggctgtgtaaaaaaaaaatcttagaatgaagacttaggaatagcgatcatgggtcccaggggaagacttagatgaccaacagttctaaccaccttccttgctcagaaagtgtccagtcaatggagaaaggaaggcattattagctcttgatraggctttggcagaatttgggacagatggctgtgtgctcagaggatcaagtgaagtttaagatacaaggtggaaaggccagtaggactcacgtgatgtctctatcagggttcctctccatcctagggtgttcctcactcctgctggagggctggtgtttatatgatgtagagaggtttgaggtcttggatacagaagggctggctctgcattactagcgttagaggcacgataccctttagggtttggcttcttgttgaactctacagatgttgtttggtatatagtgtccaagaacagtg

SEQ ID NO: 179997 - DNA, 601 bp, Human
cttcagctagtccaaaacccatgttctggtgattggtgattctgaaatacagctgctgaagtttccacactgggacacttcccctagtgaacattcttttttgattctttaagtcaatcttaaagaattctgaagtctcccaaacctttgttcattggacttccagcatttttcccttgccactaatgtcaaaatcccttcttatcccactaaactttctgaactctccctgaatgttggaggatgaagacaagtgggctgtgtaaaaaaaaaatcttagaatgaagacttaggaatagcratcatgggtcccaggggaagacttagatgaccaacagttctaaccaccttccttgctcagaaagtgtccagtcaatggagaaaggaaggcattattagctcttgataaggctttggcagaatttgggacagatggctgtgtgctcagaggatcaagtgaagtttaagatacaaggtggaaaggccagtaggactcacgtgatgtctctatcagggttcctctccatcctagggtgttcctcactcctgctggagggctggtgtttatatgatgtagagaggtttgaggtcttggatacag

SEQ ID NO: 179998 - DNA, 601 bp, Human
ttgtttttaatatacatcaagcaaaacaaggtttaactctatctgtggcatctacagcagctgtctccaagatggaggacaatgatggggaccaggaggaggtcagcagcctcaatggctgatgttctgaaatatttctgagcggagctaagggggaagtggtttgccaacattatcagtttattcgtttgtccatccatcatccatccatccatccatccaccgaacacctacaggcactgaccatgccagctactagaacccagagatgaccatgccacccagacagactccaggaggyactgaacacagacccaggtgaagttctgaggcccaccttgctccttccccgagatgtgcctgctggtggtggcagtgacagggcggcacatcaatgatgaggtggagtatggaagaatggaagcactgccaagactcctgagtggcagaggcccattctattatctgtggacaccctcgttgtatttctaaagaggttttctcacagagcaaaaccacctgataccctaaaatatcatttagacaattatgttattattgtcccaattcttacttccacgacaaaacagcagatgtgtca

SEQ ID NO: 179999 - DNA, 601 bp, Human
taccagatgattcatggtggctgccgaggtggtgaataccgaggatcccaaaatgaaaaattacggagggaaacttagaaaagtagtactctctcacagccagagtggtgctggtgaccctccagtccaggctaaaacaggtaagcaaaatatttgccttgtttttaatatacatcaagcaaaacaaggtttaactctatctgtggcatctacagcagctgtctccaagatggaggacaatgatggggaccaggaggaggtcagcagcctcaatggctgatgttctgaaatatttctgagyggagctaagggggaagtggtttgccaacattatcagtttattcgtttgtccatccatcatccatccatccatccatccaccgaacacctacaggcactgaccatgccagctactagaacccagagatgaccatgccacccagacagactccaggaggcactgaacacagacccaggtgaagttctgaggcccaccttgctccttccccgagatgtgcctgctggtggtggcagtgacagggcggcacatcaatgatgaggtggagtatggaagaatggaagcactgccaagactcctgag

SEQ ID NO: 180000 - DNA, 601 bp, Human
gctaggtggtgttcaatcatctcacgcctgaagctcttcatcagtcttctgttgctcaggctcttcactgtctccatcccacgtgatgaaagacaggcgtgtctctggccagggactaaggcgccatgagcatgtgtgctttgtttgggtgttggtgtgctctgactcatgctctcagtggccctcgaaggcaccaggtgaaagaagagggtcagacaaccactagccacagctgtggcagcctcggttcaaaaatgtaaaatctgccatgcaggcagtttcaaagacttaacctatgccyttgtataattattatttttacttcttttatagcaacgttcattttctaacctgaaggtggttcaggtgatgttctaatctgcttttgagtttgaaaatgcatctaccagatgattcatggtggctgccgaggtggtgaataccgaggatcccaaaatgaaaaattacggagggaaacttagaaaagtagtactctctcacagccagagtggtgctggtgaccctccagtccaggctaaaacaggtaagcaaaatatttgccttgtttttaatatacatcaagcaaaacaaggtttaactc

SEQ ID NO: 180001 - DNA, 601 bp, Human
aaaactgtatttcttctaagttctattgtaaacaaagcaaaggactatgccagaatatatagcaattagagaaaaatgcctacttttcctctttgcacttattttgtgcgcttgtttcttgttttgtgtaggtttgatgattttgccaaattgcacggtcagcaaacagttcgttgtggtccaacacccaggatagggactatgagaccgtttgccaggtgctaggtggtgttcaatcatctcacgcctgaagctcttcatcagtcttctgttgctcaggctcttcactgtctccatcccwcgtgatgaaagacaggcgtgtctctggccagggactaaggcgccatgagcatgtgtgctttgtttgggtgttggtgtgctctgactcatgctctcagtggccctcgaaggcaccaggtgaaagaagagggtcagacaaccactagccacagctgtggcagcctcggttcaaaaatgtaaaatctgccatgcaggcagtttcaaagacttaacctatgcccttgtataattattatttttacttcttttatagcaacgttcattttctaacctgaaggtggttcaggtgatgttctaatct

SEQ ID NO: 180002 - DNA, 601 bp, Human
gtcagtaaatctactaaagtttagttcaaaatatgccggcaaaggaatcttaaattctcttagtgccatctaaataaaactgtatttcttctaagttctattgtaaacaaagcaaaggactatgccagaatatatagcaattagagaaaaatgcctacttttcctctttgcacttattttgtgcgcttgtttcttgttttgtgtaggtttgatgattttgccaaattgcacggtcagcaaacagttcgttgtggtccaacacccaggatagggactatgagaccgtttgccaggtgctagrtggtgttcaatcatctcacgcctgaagctcttcatcagtcttctgttgctcaggctcttcactgtctccatcccacgtgatgaaagacaggcgtgtctctggccagggactaaggcgccatgagcatgtgtgctttgtttgggtgttggtgtgctctgactcatgctctcagtggccctcgaaggcaccaggtgaaagaagagggtcagacaaccactagccacagctgtggcagcctcggttcaaaaatgtaaaatctgccatgcaggcagtttcaaagacttaacctatgcccttgta

SEQ ID NO: 180003 - DNA, 601 bp, Human
aacaactgcattttactactctttgagaagaactgaatttagccaatcaatgtaatttcacattgattttcattacttttgctttcaaagttacatatgaaattttttttgcatggctagatatgtgctggatgactaagaattttataattggcatatcaataatcaaatcagttttcctaataaaatgacatgtctgatttctgcaaaagctcttcagtgtcctctcaaactgagaaagctggaaagtagagttttcaaaagagtaaaaataataataaaaaaaagttaaggcagtacygctgagaatttaaattctctgcaatgtcgaaacttttgaaatataaaacttttaaaaacagtttcactgaggtataccttacatcccattttagcacttgtaaaacctttgtctttaactgtattgtgataacattgatatcctgcttaacataagaaatattattttaattgaaaacattattcatgataatttaaaaagctgctattaacttctacatctgtcagtaaatctactaaagtttagttcaaaatatgccggcaaaggaatcttaaattctcttagtgccatctaaataaa

SEQ ID NO: 180004 - DNA, 601 bp, Human
aaatctcttttatttataagttacccagtctgtggtgttatgttatagcaacagaaaatggactaagacatggtatttggaggtgaggcctttaggaggtaattagggttaggtgaagtcaggtgagtagagtcctttttgcaagaaggtgacagtctacaagccaggaggagagccctcaccaggaatcaaccatgctggcagcctaacctcagacttctcaacatccagaactgtgagaaataaatttctattgtttaaggcacctagaatagggcattttgttatagcagcccgagcrgatgaagacacctaccaccactcagctttggaaccaggattctgaaccaaagcctatagatcctatgttcttaacaactgcattttactactctttgagaagaactgaatttagccaatcaatgtaatttcacattgattttcattacttttgctttcaaagttacatatgaaattttttttgcatggctagatatgtgctggatgactaagaattttataattggcatatcaataatcaaatcagttttcctaataaaatgacatgtctgatttctgcaaaagctcttcagtgtcctct

SEQ ID NO: 180005 - DNA, 601 bp, Human
gggcatgggtgaaagggaaacactgagaaaatagatgtgacccccagtatgcttccttgaagaagtggggggctggccaggccaggcacaaagatcctttgtgttccctgagcctgtgacttctcccgctgtttctcagcagttacactaacgacattgtggaggaaacagcttctccttgcatggccctgccccttgcactctagactgtttagcctccctgctggtcagtcccctctccctacaaatgccagcagctttcccccagtccttgctgcaaccacaaagtctcgcaaggatkttcaaatgccactgggaggatagcggtgccacccatggagaataatgaccccaggccctaaaatgaaacaggttgctctaacattcgaagaatagccccagcacaccaaatgcattcacttaatttcttgttcaacagaaaagaatgacctcttttaatacagagctgctttgaaacatgtcatttcaaacaggtcctaagaagatcctgatatttgtctgtatcttaactggatctctgtgggttgaaaaacgctcatagaaatgttgaaggacatcagtcaatctttaataagatgag

SEQ ID NO: 180006 - DNA, 601 bp, Human
aggagagatgggtgggtgtggggcttcttgccatctacatatgtagggtctgccttttacttgcacatctgtgagaggtgtacaacagagttgtagaagtatggactctggagccaggccacctgggtctgaacctggtgttccatttcttagctgtgtgaccttgggcaaggttctcaagtcccatgtgcttcagattcttcatctgtaaagaggataatcacaggacctacctcatgtggtggtggtggcacaaattgacctaatgcctacattgaggcttggtgcataggaagtttcyatgaaagcgttcactgttatgatccacataggtgtgggcctcagactatgagctgggctgaatgacagcccctccctagtccctggagcttgtaaatatgttgccatacatggaagaagggactctgcaggtgtgactaagctaaggatcttgagactaggagatgatggattaccagggtgggcccagtgtaatcaaggtgtctttataagcaggatatggcagggctggagtcggagatggagacaggatgatggaagcagagattcgagtgatatggggccatgagccaaggaaagt

SEQ ID NO: 180007 - DNA, 601 bp, Human
tacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctttcaggaagcccaagcagcccatgaagaggcccatacagagacgaactgaggctgctggcccagagctctggctgagctcctcactggcagctggtatttttgccagctatrtaagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacatttctgcgatgggcagaagtggcaaggattgtaactcattagactcagaaggcgaggtcacctgagtaagcagggtccttagtggaacagtgggtgtaagaggaaggagaga

SEQ ID NO: 180008 - DNA, 601 bp, Human
aagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctttcaggaagcccaagcagcccatgaagaggcccatacagagaygaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacatttctgcgatgggcagaagtggcaaggattgtaactcattaga

SEQ ID NO: 180009 - DNA, 601 bp, Human
tgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctttcaggaagcccaagcarcccatgaagaggcccatacagagacgaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacatttctgcgatgggcagaa

SEQ ID NO: 180010 - DNA, 601 bp, Human
tgccatgtgtggtgtggtgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaagtttaggtcataaaaagccatgcccttctgccttgttctctcggggcacttcctcttggaacccagttgcccaccatgctktcaggaagcccaagcagcccatgaagaggcccatacagagacgaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaagcaaaacagatgactattgttatttacagccattacgttttgggtggcttgttgtgcagcaatagtaactggaacaacat

SEQ ID NO: 180011 - DNA, 601 bp, Human
ttggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacaccaartttaggtcataaaaagccatgcccttctgccttgttctctcggggcacttcctcttggaacccagttgcccaccatgctttcaggaagcccaagcagcccatgaagaggcccatacagagacgaactgaggctgctggcccagagctctggctgagctcctcactggcagctggtatttttgccagctatataagtgtgacaacttgggagtggaccctccagtcgccagccaagggaaacccagaggatgatgcatggaggagagaagaatcatctctgtgcaaactgcagattcacaa

SEQ ID NO: 180012 - DNA, 601 bp, Human
caggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagtgagactccatctcaaaaaaaataaaataaataaaaaaaatttttttaatgctattcatgcaacacatttttaaaattttggtaaggacataaaaataaatayattggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaacactgtctcctactccacatgctctcctacagccttgccattcctgttgggagaaggaatgtatgtcccctgcccttgaatgtggaggacctttgtgagtgcctcaagtgacactatatggtggaaaagacacca

SEQ ID NO: 180013 - DNA, 601 bp, Human
catatttcattttaaaaataaatgctattcacggggcgggagcgatggctcacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagygagactccatctcaaaaaaaataaaataaataaaaaaaatttttttaatgctattcatgcaacacatttttaaaattttggtaaggacataaaaataaatacattggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaacactgtctcctactccacatgctctcctacagc

SEQ ID NO: 180014 - DNA, 601 bp, Human
tgtcctggatttcttaggaaatcctacctttgcatatttcattttaaaaataaatgctattcacggggcgggagcgatggctcacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagatygcgccactgcactccagcctgggtgacagagtgagactccatctcaaaaaaaataaaataaataaaaaaaatttttttaatgctattcatgcaacacatttttaaaattttggtaaggacataaaaataaatacattggacaaaatcttgtgtttctgcatacacccaaatttgggcttggaaagtgcctataaacagaggtgaggtggggaggatgccatgtgtggtgtggtgggatgtcataggtagctatgataaagacaattctggaagaacaaattctctgaagatggctgcaac

SEQ ID NO: 180015 - DNA, 601 bp, Human
tgcatggcattgggttagtgctaatatctattaacggatgtcctggatttcttaggaaatcctacctttgcatatttcattttaaaaataaatgctattcacggggcgggagcgatggctcacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggygtgaacccaggaagtggagcttgcagtgagctcagattgcgccactgcactccagcctgggtgacagagtgagactccatctcaaaaaaaataaaataaataaaaaaaatttttttaatgctattcatgcaacacatttttaaaattttggtaaggacataaaaataaatacattggacaaaatcttgtgtttctgcatacacccaaatttgggcttggaaagtgcctataaacagaggtgaggtggggaggatgccatgtgtggtgtggtgggatgtcataggtagctatgataaagac

SEQ ID NO: 180016 - DNA, 601 bp, Human
acaagaatctgctcagtgtaggcgcttatactagttagttaacgttccactatcatccactgtcatgtggcatcaaataagcaggtgcttttattaaaggacatatatactttactcattttgaacaaatttgatggcttgtatttttttgcatggcattgggttagtgctaatatctattaacggatgtcctggatttcttaggaaatcctacctttgcatatttcattttaaaaataaatgctattcacggggcgggagcgatggctcacgcctgtaatgccagcactttgggaggccraggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagtgagactccatctcaaaaaaaataaaataaataaaaaaaatttttttaatgctattcatgcaacacatttttaaaattttgg

SEQ ID NO: 180017 - DNA, 601 bp, Human
gtataaggaaagctttccccaatcaacctacacaagaatctgctcagtgtaggcgcttatactagttagttaacgttccactatcatccactgtcatgtggcatcaaataagcaggtgcttttattaaaggacatatatactttactcattttgaacaaatttgatggcttgtatttttttgcatggcattgggttagtgctaatatctattaacggatgtcctggatttcttaggaaatcctacctttgcatatttcattttaaaaataaatgctattcacggggcgggagcgatggctyacgcctgtaatgccagcactttgggaggccgaggtgggtggatcacaaggtcaggagatagagaccatcctggctaacacggtgaaacactgtctctactaaaaacacaaaaaactagccaggcgtggtggcgggtgcctgtaatcccagctactcgggaggctgaggcaggagaatggtgtgaacccaggaagtggagcttgcagtgagctcagattgcgccactgcactccagcctgggtgacagagtgagactccatctcaaaaaaaataaaataaataaaaaaaatttttttaatg

SEQ ID NO: 180018 - DNA, 601 bp, Human
ggttgcagtgagccgagatcgcaccactgtattccagcctggaatacagagcgagactctgtctcaaaaagaaaaaaaagctcacagtgaaatcaatcaagaaatactaagccatgaccaggtgctcagtagtctactagggcctccaaaagcctcagtttctgtccctacaggggcttaagatggaagcttgagtgatgagactgcagctccagtgataatataaatgatctctcttgtgtgtcacagacactcagagctcaggatactagaagtggagcgtagcaatcagaaaagtctagctaggtatataagaatcccatctcaacctccaattggtccagttacaaaaagtcctacagatgaaggacttgagaatagggttaggctttaaataagtgggaaaaagatatacctctgcatttcctcattactacctaaaaagaaaaggtataaggaaagctttccccaatcaacctacacaagaatctgctcagtgtaggcgcttatactagttagttaacgttccactatcatccactgtcatgtggcatcaaataagcaggtgcttttattaaaggacatatatactttactcatt

SEQ ID NO: 180019 - DNA, 601 bp, Human
ggaggaccgggccttgatacccccacgttggtcagttctgggaaggggctaccctgagaagggggtggaacttgggcaaggtggctttgctctgccccaacagggctgactgtcaagggaggctgggagacaaattctatttttctgaagtgacctggggtgtgtcactgtgaccagtgcaccgaccagctaaccgaccaacccgcaaggcccaagctcaaggaattagaaggctccagacttgcaccctaagttaatcatctgaagtctcagaaatgtgacagcctttaaactgaacacyacaaaaatgctgcttattccactccaaatcattagctcatcatccatgtaaggagcttcaagaagaatatcggtaagattagcggtaaattcaaacagtttaaactttcagtataaaccgcatcaactcaaatcccgaatactgactcaacaatttcactcctaggaatttattctaaagaaatcctcatggctgtgggcaaacattagatgcaaatatgttcctgcaaggcaaataaaatatgcaaaaatatagttttatgtaaataaaatacatcaagatccgtgatcagataatata

SEQ ID NO: 180020 - DNA, 601 bp, Human
gtggtggggaggggaaaggaaactgggcagagggagagtgaagctaccaagtggtcctagtggaagcctagccgactctacagggagctttgaggatgagacgacccttatcggagcaggaggaccgggccttgatacccccacgttggtcagttctgggaaggggctaccctgagaagggggtggaacttgggcaaggtggctttgctctgccccaacagggctgactgtcaagggaggctgggagacaaattctatttttctgaagtgacctggggtgtgtcactgtgaccagtgcacygaccagctaaccgaccaacccgcaaggcccaagctcaaggaattagaaggctccagacttgcaccctaagttaatcatctgaagtctcagaaatgtgacagcctttaaactgaacactacaaaaatgctgcttattccactccaaatcattagctcatcatccatgtaaggagcttcaagaagaatatcggtaagattagcggtaaattcaaacagtttaaactttcagtataaaccgcatcaactcaaatcccgaatactgactcaacaatttcactcctaggaatttattctaaagaa

SEQ ID NO: 180021 - DNA, 601 bp, Human
caagctgttctatgcctaacaatttacaccgaattatacatggagagggcatggccctcactcccacatggtaattgtgtgtgtgtgtgtgtgtgtacttattttttcatctggcccatgtatgggcacatcacattcctatgggtgactccctgggcatctgtgaaatgttgtctcccactcctgaaattatgctgtaaatgccagggaatggtggtgacatggttatagcgacgatcttgattctgctcaaacataaaccacagttggtttctttagcaattattaagaaatgattggkccatgtcagaggaagacagaggaagaatctgaactgtaattcacttacagatttctacagaattagctcatgattcatggaggcaaaaaaagttttgtcaggaatggcattcgaagacacagaaaaacaatttgaaaggagcctgaggtccaggtgttttcagagtgtggtctttaagatagtttcttaaaagatcattcggagaagagagcattttaaactgctcttgtacaaatctatggtacattttattccttatgttgaaaatgatgggaagattgtgcctgtttcacccattta

SEQ ID NO: 180022 - DNA, 601 bp, Human
ccaccctgggcccagagctccatttcactgtggccgagcagatgccccttgttggggaacccatgctcttcaaataccccaggcctcatcactgtctgtggtctactcgcccctccaccaatgatggctgctggctgaccagcccccagggcatttcaatttgtggcttaatttggtaattcatcaaaaacagattagtcacctgctagggccagccatggtgtgaggtgccaggcgtacaggcagagaagtttacccagctctggggctcaagctgttctatgcctaacaatttacaccraattatacatggagagggcatggccctcactcccacatggtaattgtgtgtgtgtgtgtgtgtgtacttattttttcatctggcccatgtatgggcacatcacattcctatgggtgactccctgggcatctgtgaaatgttgtctcccactcctgaaattatgctgtaaatgccagggaatggtggtgacatggttatagcgacgatcttgattctgctcaaacataaaccacagttggtttctttagcaattattaagaaatgattgggccatgtcagaggaagacagaggaagaatct

SEQ ID NO: 180023 - DNA, 601 bp, Human
tgtgccaacctggttcatcaggaaaatctaggtgttcccgtcaagtgactaaaatgtgggcacacatctttgcaccgagtatctgattcctaagagctgttccctttccatcaggcctagaatggcccagttagttttctcctggtgaactgtagcccattaacattgacggaaaattagttgttaatattgaaaaattgggaggtgtcacacagaaatagaacttctgacttctttttggtggtggtggcccggggagatgtggccaccctgggcccagagctccatttcactgtggccragcagatgccccttgttggggaacccatgctcttcaaataccccaggcctcatcactgtctgtggtctactcgcccctccaccaatgatggctgctggctgaccagcccccagggcatttcaatttgtggcttaatttggtaattcatcaaaaacagattagtcacctgctagggccagccatggtgtgaggtgccaggcgtacaggcagagaagtttacccagctctggggctcaagctgttctatgcctaacaatttacaccgaattatacatggagagggcatggccctcactccca

SEQ ID NO: 180024 - DNA, 601 bp, Human
aaataagaaacgctgaagtatcttttgatactttgcctgaattactacaagagagtttacaaatatgtatttctgggataacacagaacttttattccttagataaaaaatctgagtggctgatttatgccagtgaccaaaatgatggctgcaattatgcctgctctatattcatgttgttaaaggtgaaaatgctaaagactttttttttagcagaatggtgatcatgatctgttaacacagtagaaacaaaaaaaaaatccaagtataaagaaaaaaaaaagaataaaaaagaaaagaraaaaataaaataattgggaaaaacagggaggaagagtgtgtacaaatgtacatcttaagactgaggtcacagttcatactagatttcatcttgtttgttaaattccatgtgcgctcagaattccattaactcttattccgtattgcctcaatctttccttaatatgtaaaggttaaccaccccactgtaacttcttggaaacgcactgcttgcaatgtttaagatgaaaaaatagccacaggcaaatcaaaactctacttaatgacttggagaccagcagatgaggattaggggaggcaa

SEQ ID NO: 180025 - DNA, 601 bp, Human
aggcacagttctgatactttgaaaaaaaaataagaaacgctgaagtatcttttgatactttgcctgaattactacaagagagtttacaaatatgtatttctgggataacacagaacttttattccttagataaaaaatctgagtggctgatttatgccagtgaccaaaatgatggctgcaattatgcctgctctatattcatgttgttaaaggtgaaaatgctaaagactttttttttagcagaatggtgatcatgatctgttaacacagtagaaacaaaaaaaaaatccaagtataaagaaaaaaaaaagaataaaaaagaaaagagaaaaataaaataattgggaaaaacagggaggaagagtgtgtacaaatgtacatcttaagactgaggtcacagttcatactagatttcatcttgtttgttaaattccatgtgcgctcagaattccattaactcttattccgtattgcctcaatctttccttaatatgtaaaggttaaccaccccactgtaacttcttggaaacgcactgcttgcaatgtttaagatgaaaaaatagccacaggcaaatcaaaactctacttaatgacttggaga

SEQ ID NO: 180026 - DNA, 601 bp, Human
ataactgatattaaacttcagccaggcacagttctgatactttgaaaaaaaaataagaaacgctgaagtatcttttgatactttgcctgaattactacaagagagtttacaaatatgtatttctgggataacacagaacttttattccttagataaaaaatctgagtggctgatttatgccagtgaccaaaatgatggctgcaattatgcctgctctatattcatgttgttaaaggtgaaaatgctaaagactttttttttagcagaatggtgatcatgatctgttaacacagtagaaacaaaaaaaaaatccaagtataaagaaaaaaaaaagaataaaaaagaaaagagaaaaataaaataattgggaaaaacagggaggaagagtgtgtacaaatgtacatcttaagactgaggtcacagttcatactagatttcatcttgtttgttaaattccatgtgcgctcagaattccattaactcttattccgtattgcctcaatctttccttaatatgtaaaggttaaccaccccactgtaacttcttggaaacgcactgcttgcaatgtttaagatgaaaaaatagccacaggcaaatcaa

SEQ ID NO: 180027 - DNA, 601 bp, Human
aaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgcccyggagaaaatacgggaggtgctggttctgcaactacagagaatgacaactaagaattctaaatctgaaataatgaaattgtttaaaaaaacactttgaagtttaatgagtattaattttctgtaagaaaacacaataactgatattaaacttcagccaggcacagttctgatactttgaaaaaaaaataagaaacgctgaagtatcttttgatactttgcctgaattactacaagagagtttacaaatatgtatttctgggataacacagaacttttattccttagataaaaaatctgagt

SEQ ID NO: 180028 - DNA, 601 bp, Human
cataaagtatccagcatataggagaatttgtatagaatttacaaataaaatgctttactggcagatgtactaaaaaatcttctaccaaggaggttcataatccaaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctytcttactggtaaaatttgcttggccacagggaagtggtataaagcaaaacacataaccttttttttttttgatgggctttgaaggtgttaaccagaatgccccggagaaaatacgggaggtgctggttctgcaactacagagaatgacaactaagaattctaaatctgaaataatgaaattgtttaaaaaaacactttgaagtttaatgagtattaattttctgtaagaaaacacaataactgatattaaacttcagccaggcacagttctgatactttgaaaaaaaaataagaaacgct

SEQ ID NO: 180029 - DNA, 601 bp, Human
ttggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggmaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgccccggagaaaatacgggaggtgctggttctgcaactacagagaatgacaactaagaattctaaatctgaaataatgaaattgtttaaaaaaacactttgaagtttaatgagtattaattttctgtaagaaaacacaataactgatattaaacttca

SEQ ID NO: 180030 - DNA, 601 bp, Human
cccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacacttggagaccatgtgtttargcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgccccggagaaaatacgggaggtgctggtt

SEQ ID NO: 180031 - DNA, 601 bp, Human
gcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacayttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttgatgggctttgaaggtgttaaccagaatgccccggagaa

SEQ ID NO: 180032 - DNA, 601 bp, Human
cggatgtgcttcctatgtccttgctgtggggggcctagcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaraaaatcttctaccaaggaggttcataatccaaaacacttggagaccatgtgtttaagcaatagtgtgattaaattcccagttttctttaggctttttcatgataagcaagtgtaagaaagagaacagaagaacattcttcttgatatagttaaaggaatttctatttttgttcacttttagggcaatcaggaaatgggctcaggagtgtatttctcttagtattgctctcttactggtaaaatttgcttggccacagggaagtggtataaagcaaaacacataaccttttttttttttga

SEQ ID NO: 180033 - DNA, 601 bp, Human
ttcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggtgtcacattcccggatgtgcttcctatgtccttgctgtggggggcctagcaggatgccaggcactggcccgcaccatcacatggagactgggaggcccgaccacatggacactgckgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaatgctttactggcagatgtactaaaaaatcttctaccaaggaggttcataatccaaaacacttggagaccatgtgtttaagcaatagtgtgattaaattcccagttttctttaggctttttcatgata

SEQ ID NO: 180034 - DNA, 601 bp, Human
atgaggacaatgcagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtrtgctctgtgggtgtcacattcccggatgtgcttcctatgtccttgctgtggggggcctagcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagcatataggagaatttgtatagaatttacaaataaaa

SEQ ID NO: 180035 - DNA, 601 bp, Human
gacttggcaatcttcatactacaacaaaagcttcatgaggacaatgcagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcytcaggggaagcactgtgcttgagggccacatgtgtgctctgtgggtgtcacattcccggatgtgcttcctatgtccttgctgtggggggcctagcaggatgccaggcactggcccgcaccatcacatggagactgggaggcccgaccacatggacactgctgagggccaggattcttcttatgggtacactgcagagatctccagcaccaaccccatgacaagaggaagagcagagtcaattggatgcatgtccaccttaaggacctgtctttagggcatgtttcataaagtatccagca

SEQ ID NO: 180036 - DNA, 601 bp, Human
cctcagccagctcctccctgtctcattcctgcctgttgaactcttgttcatcctttaaagcctatcattaagtccaattcctccaggagctcccccatcccccaactaagtgttctttcccacctgtaacctggtgactcccacctcccgctgtcaccatagtctgcttggcatcatagtcatgttgggacttggcaatcttcatactacaacaaaagcttcatgaggacaatgcagcttattctgcagctccccagagatgtagacaaaagcttgtgcaagtcaatgacaccaaaattcrgagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggtgtcacattcccggatgtgcttcctatgtccttgctgtggggggcctagcaggatgccaggcactgg

SEQ ID NO: 180037 - DNA, 601 bp, Human
tcttctccaaccagtgtccatacctcctccagggaccccctctgcagtacccactttctaaagctcctcagccagctcctccctgtctcattcctgcctgttgaactcttgttcatcctttaaagcctatcattaagtccaattcctccaggagctcccccatcccccaactaagtgttctttcccacctgtaacctggtgactcccacctcccgctgtcaccatagtctgcttggcatcatagtcatgttgggacttggcaatcttcatactacaacaaaagcttcatgaggacaatgcrgcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggtg

SEQ ID NO: 180038 - DNA, 601 bp, Human
ttcttctccaaccagtgtccatacctcctccagggaccccctctgcagtacccactttctaaagctcctcagccagctcctccctgtctcattcctgcctgttgaactcttgttcatcctttaaagcctatcattaagtccaattcctccaggagctcccccatcccccaactaagtgttctttcccacctgtaacctggtgactcccacctcccgctgtcaccatagtctgcttggcatcatagtcatgttgggacttggcaatcttcatactacaacaaaagcttcatgaggacaatgyagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaagggcagcctttgtctgtggtttgagcaaaggccaggccattcattgtggtcacaggaggtggtgtagggttgtgatgacatttctcacaggcctcaggggaagcactgtgcttgagggccacatgtgtgctctgtgggt

SEQ ID NO: 180039 - DNA, 601 bp, Human
aaggttagcatggtctgttatgacatgatttccatattacagaagtactctggtttctgtgttcagaatacagcgaaggggcgagggggaagcaaggtacccatgaggagacagctggggtaggcagggcagtgggagcttcttctccaaccagtgtccatacctcctccagggaccccctctgcagtacccactttctaaagctcctcagccagctcctccctgtctcattcctgcctgttgaactcttgttcatcctttaaagcctatcattaagtccaattcctccaggagctccccsatcccccaactaagtgttctttcccacctgtaacctggtgactcccacctcccgctgtcaccatagtctgcttggcatcatagtcatgttgggacttggcaatcttcatactacaacaaaagcttcatgaggacaatgcagcttattctgcagctccccagagatgtagacaaaagcttgtgcaagtcaatgacaccaaaattcggagaactgcaccagtgggggctcatctgatgcaaaccaagagccagaattcaccagggcatcaaaaggccatggcttctggtgtgacagactgaa

SEQ ID NO: 180040 - DNA, 601 bp, Human
aaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtaggggagtgaaccgttggatgctggggaacagcattctggcccagggaacagcaggtgtggaggccctgaggcaggagaatctggcatgctgcaagcccagcaaggaggctcagggtggctgyggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagtactctggtttctgtgttcagaatacagcgaaggggcgagggggaagcaaggtacccatgaggagacagctggggtaggcagggcagtgggagcttcttctccaaccagtgtccatacctcctccagggaccccctctgcag

SEQ ID NO: 180041 - DNA, 601 bp, Human
ccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtaggggagtgaaccgttggatgctggggaacagcattctggcccagggaacagcaggtgtggaggccctgaggcaggagaatctggcaygctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagtactctggtttctgtgttcagaatacagcgaaggggcgagggggaagcaaggtacccatgaggagacagctggggtaggcagggcagtgggagcttcttctccaacc

SEQ ID NO: 180042 - DNA, 601 bp, Human
tccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtaggggagtgaacygttggatgctggggaacagcattctggcccagggaacagcaggtgtggaggccctgaggcaggagaatctggcatgctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagtactctggtttctgtgttcagaatacagcgaa

SEQ ID NO: 180043 - DNA, 601 bp, Human
gccttctggttcacattcattcacgcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcrtgaggacctgaagcaggtaggggagtgaaccgttggatgctggggaacagcattctggcccagggaacagcaggtgtggaggccctgaggcaggagaatctggcatgctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggttagcatggtctgttatgacatgatttccatattacagaagt

SEQ ID NO: 180044 - DNA, 601 bp, Human
accttcaatgacttccctttgctcctgaagttgaacctaagccttctggttcacattcattcacgcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccrgccagggaaggcatccttgagaaggggacatgcgagtgcatgaggacctgaagcaggtaggggagtgaaccgttggatgctggggaacagcattctggcccagggaacagcaggtgtggaggccctgaggcaggagaatctggcatgctgcaagcccagcaaggaggctcagggtggctgcggaggagggtcatggagaaagtggttgggaatgaggacaagagagacctttagccattggaaggaccctggcttgtattctacagaagtgggagccataagggggtttgagcaaaggtt

SEQ ID NO: 180045 - DNA, 601 bp, Human
tacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatgctatatttaaacaaaacaaaccttcaatgacttccctttgctcctgaagttgaacctaagccttctggttcacattcattcaygcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaagcaggtagggg

SEQ ID NO: 180046 - DNA, 601 bp, Human
gtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatgctatatttaaacaaaacaaaccttcaatgacttccctttgctcctgaagttgaacctaagccttctggttcayattcattcacgcatccctccatttattcattcatttgtctaaacactgttctaggtactaggaattcaaatatgaacaaaacagacaaaactccccgccctcttggagcttacattccagatggggaaaaaagacacaaaacaagatagatgggtacaatccacagtatgtttagacagccttgagtgtgggcaacagagcagcgcggaggggcagaaaagctggaaaagtggtgaaagcaagcccggccagggaaggcatccttgagaaggggacatgcgagtgcatgaggacctgaag

SEQ ID NO: 180047 - DNA, 601 bp, Human
ccactgcccaccttatcagtctcatttaaacaaatatttttaaaatttgataatacagtcatatgataaaaaacaaaataaactttttttttttttttgagacggagtcttgctctgtcgcccaggctggagtgcagtggcactatctcggctcactgcaagctccgcctcccgggttcacgccattctcctgcctcagcctcccgagtagctgggactacaggtgcccgccaccacgcccggctaattttttgtatttttagtagagatggggtttcaccgtgttagccaggatggtctygatctcctgacctcatgatctgcctgcgttggcctcccaaagtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatgctatatttaaacaaaacaaaccttcaatgac

SEQ ID NO: 180048 - DNA, 601 bp, Human
cttactttcgaacattgcaaattccaaccccccactgcccaccttatcagtctcatttaaacaaatatttttaaaatttgataatacagtcatatgataaaaaacaaaataaactttttttttttttttgagacggagtcttgctctgtcgcccaggctggagtgcagtggcactatctcggctcactgcaagctccgcctcccgggttcacgccattctcctgcctcagcctcccgagtagctgggactacaggtgcccgccaccacgcccggctaattttttgtatttttagtagagayggggtttcaccgtgttagccaggatggtcttgatctcctgacctcatgatctgcctgcgttggcctcccaaagtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaattatgattttatttcccccactttaagtaaataaaaggtaacatg

SEQ ID NO: 180049 - DNA, 601 bp, Human
accctgccactaagatgagtagaactttggatagttttcctggatcttactttcgaacattgcaaattccaaccccccactgcccaccttatcagtctcatttaaacaaatatttttaaaatttgataatacagtcatatgataaaaaacaaaataaactttttttttttttttgagacggagtcttgctctgtcgcccaggctggagtgcagtggcactatctcggctcactgcaagctccgcctcccgggttcacgccattctcctgcctcagcctcccgagtagctgggactacaggygcccgccaccacgcccggctaattttttgtatttttagtagagatggggtttcaccgtgttagccaggatggtcttgatctcctgacctcatgatctgcctgcgttggcctcccaaagtgctgggattacaggcgtgagccaccgcgccaggcccaaaatatacttaaataggatacactgagaaagcttttcctacctctgtccctgtccactccattctcactctgcctgttaggtgtaacctcatttttttaaaccatttttattattttggggtttttttaatcaaataaaagcaa

SEQ ID NO: 180050 - DNA, 601 bp, Human
aacaatgaccccccgtgttaaaaaaatattattcaatgatgcctgctgaagcccgacaaggcagactttattcaggaccaccacgatgggtatagagaccaccacaaccaggtcttgcagtgggggctgggggcgggggtagattgagctcaactccgaatacagcatggccaagaagcagtgtcagggtcagtggtggaaaattactaagaggaggcatcggggtaaagaggactctggctaagctgacctaataggattcttgctgaagacaggcccgggtgatcagacatcacctgayggatggtagaagatgaagaacccaatcagatattaagggtgggggggttcctgttaaactgactttgcggggttctttgctaaaactgggttttataaggaagtgcacaggtgagcctaggaaaaggttcagaaacctgacccaaatttggccaagcaaaaaatgtttgtcaccccaaacccactcatacccttgtccaaggtttgttaagcactctccaaacttcctacgtctgtctccagcaccgtgctcacttcagtaggtgaccacctatgtgatgacaccctggttctaaacggt

SEQ ID NO: 180051 - DNA, 601 bp, Human
atccttcaccgtgcatagtgctgcaggtaggcagccctcagcaactgtaatatcttcccaactggcctcgcttggcctgtgtcttaccactccaacataatgtgcaagtctgacacataaaaatccctgatgctgaccaagctcggtcacgttcctctcccgctgtataagcttcagtgataagcactgttcctgctgtagcccaggcagactgttcaaggtcgtcttgtgtctttcttgtcacatatcctgccagtgctgctctcacttttatgttcctccaagacaaatggcttatatrcctcaaaacacactcccctcttctcttccccaagtctctgctcgtgctctccctctccctggattattcctcctttctcccctttcctttccttccttaagattgagtgcaggcatgtcgttctccaggaagccaacaatgaccccccgtgttaaaaaaatattattcaatgatgcctgctgaagcccgacaaggcagactttattcaggaccaccacgatgggtatagagaccaccacaaccaggtcttgcagtgggggctgggggcgggggtagattgagctcaactccgaatacagc

SEQ ID NO: 180052 - DNA, 601 bp, Human
gttgacaactgcaccaagaatgtgccccctgtgaagctgtctgcaacatgaactgaccaaagacagaaactgagttttgacttccaacactgagcaaaaaatgaggcaacttgcaaaggctctcttgtgaatgaacatgatgacagttacattttatttcagttttttgcttctaagatagtgaaatagtttttttttttttttttttttttttttgagacagttttgctcttgtcgcccaggccggagtgcaatggcgtgatcttggctcactgcaacctctgcctcctgggttcaagcrattctcctgcctcagcctcccaagtagttgggattacaggcgcctgccaccacgcccagctaatttttgtatttttagtagagatggggtttcaccatgttggtcaggctggtctcaaactcctgacctcgtgatccacccgcctcggcctcccaaagtggtaaagtagttttactgttacttcacatgtgtaaccattccctatagaatgtggagcattgttccccagcctaagttactacacaaaaacaaaacaaaacaaaaaacaaccccacaagggtttgctctcttcctcatctt

SEQ ID NO: 180053 - DNA, 601 bp, Human
gtgaggaaaaattaaggtttatgatgaattccatcattcccattacagcattctgaaagcatcattaggatgacttcagcacatccattatgaactctaaggagttgacaactgcaccaagaatgtgccccctgtgaagctgtctgcaacatgaactgaccaaagacagaaactgagttttgacttccaacactgagcaaaaaatgaggcaacttgcaaaggctctcttgtgaatgaacatgatgacagttacattttatttcagttttttgcttctaagatagtgaaatagtttttttttttttttttttttttttttgagacagttttgctcttgtcgcccaggccggagtgcaatggcgtgatcttggctcactgcaacctctgcctcctgggttcaagcgattctcctgcctcagcctcccaagtagttgggattacaggcgcctgccaccacgcccagctaatttttgtatttttagtagagatggggtttcaccatgttggtcaggctggtctcaaactcctgacctcgtgatccacccgcctcggcctcccaaagtggtaaagtagttttactgttacttcacatgtgtaacca

SEQ ID NO: 180054 - DNA, 601 bp, Human
ccctccccctctccaactctttgtctcccccttttctcttctcctggcatgcacctgggcaaattccattaaaaggtgatcagaagagacagaagaggctaatttagacacaagaggctgatttcactgtcttcttttctcttttaaaatcatgacacaaagttccagctcaattttgtgggcaaatctcaaacatctctgttcatctgagacaacagtgtgggctcacccgaatatacaattttgatttcgttatatggatggaaaaaaaaaaaaagaacggtgaggtatttgaagattrttcaactgtctttgctcatagaaatgataaatctttcactagattgcccaaaaacatgtaattctatatctgcctttgaattgatcggttctatctatctgaattgaatttagtaaacttgagcacttccatttttagatcaggagtaagagccggtcaaaatggtggctgccactttgtagggagactggaatgcatgttctctggcaaaaaaatcactggttcacaaattgtaccagagccctggatcagggggagggcacttaggatctgccaccttggttttccttggctaaaatg

SEQ ID NO: 180055 - DNA, 601 bp, Human
gccttgctgccaactgtagagttatgtaagaaaccagttatggtgtttgctttgccaaattatccataactcccaacctgaaaagacataaacgcatgtattccaaaaaagtgtagaatactgaacaatgcaacatgcatcaaacaccaaggggaagtggtcatcctggatgatgcttcgagagggaatgtgtatgcttgcagtcctgcattttcagtacagggagcctttgtctgtccagcaggcacatgaagattgtggtggtgggcaggagaggctaaggggaaacagaggtgagggsagcagacacagtcctgcattccactcctccagaggggcttggaacttctctgatgttccctccccctctccaactctttgtctcccccttttctcttctcctggcatgcacctgggcaaattccattaaaaggtgatcagaagagacagaagaggctaatttagacacaagaggctgatttcactgtcttcttttctcttttaaaatcatgacacaaagttccagctcaattttgtgggcaaatctcaaacatctctgttcatctgagacaacagtgtgggctcacccgaatatacaatt

SEQ ID NO: 180056 - DNA, 601 bp, Human
aaatggaatcctgccattcacatttaaaaattaacttcaaagaatcattaaagtcagccaataatttaaaatacatgcaagaggaagaaacaaagcagggcatttagccttccaaaaaaggaaaagcaaagtccttttggatgagtgagtgttgcttaatttcaacgcactgtgccttgctgccaactgtagagttatgtaagaaaccagttatggtgtttgctttgccaaattatccataactcccaacctgaaaagacataaacgcatgtattccaaaaaagtgtagaatactgaacartgcaacatgcatcaaacaccaaggggaagtggtcatcctggatgatgcttcgagagggaatgtgtatgcttgcagtcctgcattttcagtacagggagcctttgtctgtccagcaggcacatgaagattgtggtggtgggcaggagaggctaaggggaaacagaggtgaggggagcagacacagtcctgcattccactcctccagaggggcttggaacttctctgatgttccctccccctctccaactctttgtctcccccttttctcttctcctggcatgcacctgggcaaattccatt

SEQ ID NO: 180057 - DNA, 601 bp, Human
aagagggactcaaatttggcctgaaaaataacaataaaaataaaaggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcmaggctggtctcaagctcctgtcctcaggtgatccctcggcctcccaaagtgctgggattacaggcatgagccaccgtgcctggcctcctcaatacattttttactgaggaagtggatcatcaatcctttcaagaactcctaacttctttcttagagaaaagcctttcccctcttaggggactatggcctttagtcccaatgcaggtgattttacaagaaggtaagaaggtatgatttattacattcatcgaatcagcagaacagttgccaatacatagacactacttacggtaacaaact

SEQ ID NO: 180058 - DNA, 601 bp, Human
tcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattctgactcgtttgaagctcttaaaatactgaaaggtgatgtccttgtcatacgtcctaaagagggactcaaatttggcctgaaaaataacaataaaaataaraggagttgaaatttacctgcatatgacccttgactagatgatgtcattacttttttttttttcttcgagacagagtcttgctctgtcacccaggctggagtgcagtggtgcagttttggctcactgcaacctccacctcccaggttcaagtgattctcctgcctcagcctcccgagtagctggggttacaggtgcctgccagcacacctggctaatttttgtatttttagtagagacggggctttgccatgttggcaaggctggtctcaagctcctgtcctcaggtgatccctcggcctc

SEQ ID NO: 180059 - DNA, 601 bp, Human; identical to SEQ ID NO: 29993

SEQ ID NO: 180060 - DNA, 601 bp, Human; identical to SEQ ID NO: 29994

SEQ ID NO: 180061 - DNA, 601 bp, Human; identical to SEQ ID NO: 29995

SEQ ID NO: 180062 - DNA, 601 bp, Human; identical to SEQ ID NO: 29996

SEQ ID NO: 180063 - DNA, 601 bp, Human; identical to SEQ ID NO: 29997

SEQ ID NO: 180064 - DNA, 601 bp, Human; identical to SEQ ID NO: 29998

SEQ ID NO: 180065 - DNA, 601 bp, Human; identical to SEQ ID NO: 29999

SEQ ID NO: 180066 - DNA, 601 bp, Human; identical to SEQ ID NO: 30000

SEQ ID NO: 180067 - DNA, 601 bp, Human; identical to SEQ ID NO: 30001

SEQ ID NO: 180068 - DNA, 601 bp, Human; identical to SEQ ID NO: 30002

SEQ ID NO: 180069 - DNA, 601 bp, Human; identical to SEQ ID NO: 30003

SEQ ID NO: 180070 - DNA, 601 bp, Human; identical to SEQ ID NO: 30004

SEQ ID NO: 180071 - DNA, 601 bp, Human; identical to SEQ ID NO: 31974

SEQ ID NO: 180072 - DNA, 601 bp, Human
agcaggctaaaaagctcagagaactcttcagaaaacttttgcaaacttaactacgcccgctgtggactttggacatgctaattcctatagggcggttagagaaggggaaaaaaaatccctgacagtttccctagttagtttcttttcactgacttgaaggcagaaaagtcttactattttatttcctgatcctttcatctgaggaagacaaaatggtttgggtgttaatccagcggtaggggcagcagtaagttagcagacgggctgtctctgccgggctgggttataacttttcctactytgtatcaaagctaaggcccctgccagggaggtcccgaccggctcccagtggatatctttggggacaccctgatgttttcagccctcctgggaggccgccccagaaagctgagacgagtgcctcccgagggtcgccacggcaacacagcatcccccacatcccaagctaggaagaccgacccggggctgcgggggcccctttccagaatccggccccgcccgcctggccgctgccctcgcggatctcccccggcctcgccggcctccgcctgtcctcccaccaccctctccgggccagtac

SEQ ID NO: 180073 - DNA, 601 bp, Human
agtcaagcaagccaccacgttccttcgttccttctcctcatttccacccccactaaaaaacaaaacaaacaaaaaaaactgcttttagaaaagtgagtggaaaaagaggccaatctatagacacagccaactgcaaatttcgttttgttttagaaatcacaatctaagtgtggaaactgtataaagcttaaaaataaccgcaacaatacttttttaaaaagtgaatattcgtcgttgtaataagatcaagacccagctgaggcttggaactataaaaagcttatattaaattaatctcccyttaaaggggacaattatttaaactttttttttagtagcttatctttacacttggaaccacctgccttgattcgccctttaaacgaacaggaaatgacccgcactgattttacttagtcgcatcttttcaaacccaccaaagacaaaacagaatctccactgcagaaattaaattcctactgcttgctgctagtgtagtagggtgattgtttagaaacgcctggggttgttttcatacccctgttgaaggtcaaggtttttaaaggcagctcaaagctttggggatgatcaggggtgaaaa

SEQ ID NO: 180074 - DNA, 601 bp, Human
gaattcagctgagatgatatttaaggcatagctagggactgtgatcttgccgacaaaaatattacttatttcctttttatgaaaagaatattaccatcagaatccaagacctccgaacttccctgctgaaggcacgtttacgtctttggactctggtgtaccagggcctgaacaagctataacaccatggtattaccaaatacatcctaagtcatcaaaacagctttttaggctaattctgtaagtacagcaaaacacacagcaaacttaaggttttcttagtagtaaaaaacatgtatcyctcatactgtaaaaaataaaggtgttccatgggagggaaggagtagggggagaacaggttggggctcaaaataagcaagtagggttattgtaatctattttaaagaaaattcataattttaaatctctctttagttcagaagattgacgtagaggatttacctacagaacttcaggagattcctaagaaggccttcagtgatcttttcatcaatatcatcaggccttatcattgtttcacatttgcttctctttaccatagggaatataataattatttactggttaacttcctagggag

SEQ ID NO: 180075 - DNA, 601 bp, Human
tgcaaaaaaaaaaaaaaagaagaagaaggaaaaagaaagaaaaaaatctggcaggctttggtgttgacacttacacttgaaagagaaaaatcaagttatattttatgactatggaaagaaattatgacagagtcaaatcgggccttcagacagctcatttacttttgtagcgctgactaaaaaaaaaaaaaaaaatatatatatatatatacacacacacatatatatatacatctcaagaccaacaatattcatatccacagtaattacaattgggtcaaatgttccattagggtttccrtattttttattgcttattatcactggtgggaaggagagtctgttcaaaatattgtctgtttatggcatttcaattaattttctcattccagagtatgggaagacagcccagccttggttgcagctattttactttttggggtttatgcaaactcaagggcatactggcacgaatcctgcagccaaatgcaaacactccacaccttggggaaacagttcactgttacccaagtaaacacaagcacctattagtcacccactcaaaacagaaatggtcaatgagggatgcaagatcagccat

SEQ ID NO: 180076 - DNA, 601 bp, Human
ggcaggtggaccacccgagatcaggagttcaagaccagcccagtcaacatggtgaaacctcgtctctactaaaaatacaaaattagccaggcgtggtggtggatgcctgtaatccccagctacttgggaggccgaggtaggagaatcgcttgaacctgggaggtggaggttgcagtgagctgagatcacaccactgcactccagcctaggcaacaagagggaaactctgtctcaaaaaaaaaaaaaaaaaaaaaaaaagacagtacaccatctctccttgtcaacaagtaatttttccttaaaaaaaaaacaacaaaaaaaccagaaacacagaatatgttcttctttagccaaccttctccaccctctcttgccccttgccaaccagcacaaaaaagaaaatacaaaactgatttattagaaccagagcagggttgcagccgttggctggatcactgtttatgtctataatgcttgttgctgaaacaggaagctctaaaaatcactcaaccattatttctcttgcaggcactttctgattgatagtcttctgtcccgaccaaaaagaaatgcctccaccaaacacaagccggctggcaag

SEQ ID NO: 180077 - DNA, 601 bp, Human
actaattatagatagatagaaagatagatgattaatactgactatcctctatacaatagtttcaaatagaatgaaggaaaaaaatctgtaaagaccccaacccaatgccttgagcaaactggagtgtttccacctccagagatctgatgagcacacagatgaccaattatgctcaatctgcccatattcctgtgatttaccttggtttgcatacggtgactcaattagggccatacaccaccccagagtgctggccagccctcctattaactggacaggcacgtccttgggataggtgatsggggaggtggggtagttctgcagatggccctgcccatacattcttaatgatggtcttaaatctcaaggtaaaagcccaaattaatctaagttgagaaataaacaggaaatgtacttacatcttctttgagaaaaacacagtttaaatggctcctaaatgaatgcttcctcactaaggaaatcagaggaaacgcattttcagtctagcagcagaatggccgtgagcctctcaaaggaagttgctgggattcctctatggacctcaactgcctgacaccttcattggagaacgttcggtgat

SEQ ID NO: 180078 - DNA, 601 bp, Human
aagtttgtagggaggcagaatgtcagaataaaaggggcaagggaaacattttacaacctatgcatgatcagggcgagatcacgcatgactggagctagatgagtttctcaatctcagcacaactgacatttgggtctttgttggggaggctgtcaggttcatggtaggacgtttagtagatccctggcctctacttactagatgccaccggcactccccaacccaatacacgaccaccaaaaatgtctgcagatattgccaaatgtcttctgggagtcaaatcaccccagctgggaaacaytgagcaagattatgatcaaaattgataagcagggagacaagatactgataataaactgcccagtggtttcagatagaataatgaaggcaggacatttgtcctaggtactagagacacaccatttaaagaggcagacaaagccttattatgatgtgagttagactagctccttactaattatagatagatagaaagatagatgattaatactgactatcctctatacaatagtttcaaatagaatgaaggaaaaaaatctgtaaagaccccaacccaatgccttgagcaaactggagtgtt

SEQ ID NO: 180079 - DNA, 601 bp, Human
gagtcttgctctgtcacccaggctggagcgcagtggcataatctcggctcactgcaacctccgcctccctggttcaagcaattttcctgcctcagccttcagagcagctgggattacaggtatgtgccaccactcctggctaatttttgtatttttagtagagatggggtttcaccacgttggccaagctggtctcaaactcctgacctcagatgatcctcctgccttggcctcctaaagtgctgggattacaggtgtgagccagcatgcccggctctttatcacttttttaatatgagtrgacactgtccactgacatcaattcccattcctagatcagtggctccatggactctctgctgaagtattcagggaaaagcagtgagcctctggcagagggcttcctagtttctgcagtcctcgtggacctcacctgtgtgacattcatgagggggtggctacagtggggagccttctcggagaagctgccctgctgtgtgtaccacccccacctgcagccactcctccagccactgcacatccctgacccaggatagcaggcagggtcagtggcgccagggggatggtgcaattctatgca

SEQ ID NO: 180080 - DNA, 601 bp, Human
acctattgaacacagatggggagactgaggctggcacatctgagtcctacaggtgtgccctcttctcatattacattatgctacttttctaggactcacagaatcatcgctaatagatgtgtgtgttttctatgtcatcattacgaatcaaaggaatattaaataggacacaatgggttcggtgtaatctagagttcagggatttggccagaatgcaagataatagtgtagtaagaacccttccaagtgacagccagatgaaccagtgctgagtttatacgtggccaaaagagaaaaataygcatggatgttcacttgcagtttatgaaaatgctgagacacaaccttaagaatggcttccagcggaacatccggaagtcctcaagtagtccaaggcgagctgccgtggcactgctacaaaaccccttcaacttgggtggaggcagcaatgatcactcaggaagaatgtgatgctgccaggtgccagcctgtgtaacccagcgacaggacaaagggattattctgcttcattattaaaatgaagtgtttactgttaaaatacgattgggaattaaaaggggcacatatgaatcataaatat

SEQ ID NO: 180081 - DNA, 601 bp, Human
aggccacatcagagcagaatcctcctataacaccccgtgtctgacgggcgagccccgactcctgttgtgactcggcctcctcaggtctagtttgcaggtatccccggtctacctgagttggctctgcagcagactctgttcctgtcactctccttagtgtaggtctgtaagcatgagtcatcttcttcttttggggacagtttcaggggatgtgaaacttgccctttgtcacgcaaaggaaggctgcagacacaaaggagccgtctgccctgggggctcagagtccttaggaaacacaatygcaacatttttcactcttgtgtttgtctgcaggaaagccagttgtgcccagagtcttgaaacgcccaaagagtgagaaaggaaaaataaaagaaaaacatcgcagcttttaaaaaccaagagagtcagtgaaggctcaggttctgctctttgcaaattcaggaaatcccacaagatcctgaaaggttgcagggagatttctccttttacaatagatggctttgggtctaattttaattgcggataactaagtataaaaattaacgtaccctcggattccaggagtagtctgcatttggag

SEQ ID NO: 180082 - DNA, 601 bp, Human
aagtgcatccaggccacatcagagcagaatcctcctataacaccccgtgtctgacgggcgagccccgactcctgttgtgactcggcctcctcaggtctagtttgcaggtatccccggtctacctgagttggctctgcagcagactctgttcctgtcactctccttagtgtaggtctgtaagcatgagtcatcttcttcttttggggacagtttcaggggatgtgaaacttgccctttgtcacgcaaaggaaggctgcagacacaaaggagccgtctgccctgggggctcagagtccttagraaacacaatcgcaacatttttcactcttgtgtttgtctgcaggaaagccagttgtgcccagagtcttgaaacgcccaaagagtgagaaaggaaaaataaaagaaaaacatcgcagcttttaaaaaccaagagagtcagtgaaggctcaggttctgctctttgcaaattcaggaaatcccacaagatcctgaaaggttgcagggagatttctccttttacaatagatggctttgggtctaattttaattgcggataactaagtataaaaattaacgtaccctcggattccaggagtagtct

SEQ ID NO: 180083 - DNA, 601 bp, Human
agccacggctggaacctgcagttccgcatggcccagcgcactctccacttcctcaccacatctgggaagtggctaaacctcaggattgcttcaaatgtgcacactgctccccaaagagctgagggtggcaaggagattacaaagcaaaaagacatgcagctcggggtcatttcttgcctaggtgtgaagaacatatttaaaagtgcatccaggccacatcagagcagaatcctcctataacaccccgtgtctgacgggcgagccccgactcctgttgtgactcggcctcctcaggtctagyttgcaggtatccccggtctacctgagttggctctgcagcagactctgttcctgtcactctccttagtgtaggtctgtaagcatgagtcatcttcttcttttggggacagtttcaggggatgtgaaacttgccctttgtcacgcaaaggaaggctgcagacacaaaggagccgtctgccctgggggctcagagtccttaggaaacacaatcgcaacatttttcactcttgtgtttgtctgcaggaaagccagttgtgcccagagtcttgaaacgcccaaagagtgagaaaggaaaaataaa

SEQ ID NO: 180084 - DNA, 601 bp, Human
cactccccagggccagtcagcggggaggccccaggtctaggcttgattagtcttgacgttggcggccctggggctggtgaactctgacagccaattgtggtcaaataaagccacggctggaacctgcagttccgcatggcccagcgcactctccacttcctcaccacatctgggaagtggctaaacctcaggattgcttcaaatgtgcacactgctccccaaagagctgagggtggcaaggagattacaaagcaaaaagacatgcagctcggggtcatttcttgcctaggtgtgaagaacrtatttaaaagtgcatccaggccacatcagagcagaatcctcctataacaccccgtgtctgacgggcgagccccgactcctgttgtgactcggcctcctcaggtctagtttgcaggtatccccggtctacctgagttggctctgcagcagactctgttcctgtcactctccttagtgtaggtctgtaagcatgagtcatcttcttcttttggggacagtttcaggggatgtgaaacttgccctttgtcacgcaaaggaaggctgcagacacaaaggagccgtctgccctgggggctcagag

SEQ ID NO: 180085 - DNA, 601 bp, Human
aggcaacctacttaggttcaaaacctcgctctgccacttgctagctgtgtgacctcaggcaagttacttgacctctctggggcctcagctttgtcatctgtaaaagggggttaataacagtcattccatctcgtagcattgttctgcaggttaaatggaatgctgaatatacaagcagagcacagggaaaggtctcagtaaatgtcagtggaatgatcattaaagacatgataaaggtgattccacaaagaccagagctgtgacagatcccgtaagaaggagctggggatgaagtaggcaytgacgtctgacatgaggaggggttttgtgcgtgtgtgtgtgtgtgtgtgtgtgtgtgtgtgtgtgtgtgtgtgtgttcagcaggtgatggggctgctaccaggcctaaacgcaacttgaacttcaagttcaagttcactcctgccccgccagctggcgacctttgtaaggcacaactgtgagtggctgatatgctatgtaaacaagccaggccagtgctcctcactgcaacatgtgttgtctccctcgacgccagtgtgtccatccaaatgccagggcaaaatactaactgctttattta

SEQ ID NO: 180086 - DNA, 601 bp, Human
caaacccaatagcaccagtacaagaaatctggactggagatactttatccacacctaccactgccccaaaaagtaaaatctgactctgtgattctaatgtaccaatggtactcaacctgggttatagctcaaaagcattttcttactgagctgcgtttgggcctctggcagttgagcactcatgacaccccgtctggtaaaccacagactaacctatataatcaggagtaaaacttaatcaaagtgataatttgtgaaatgaatggtcattatctgaattctcattatttcatgcccatcttttttttttttttttttttttgagatggagtcttgcactgtctcctgggctggagtgcaatggcgtgatctcggctcactgcaacctctgcctcccgggttcaagcgattctcctgcctcagcctcccgagtagctgggattacatgtgcataccaccacacccagctaattttttgtatttttagtagagatggggtttcactatgtcagccatgctggtctcgaactcctgacattgtgatccgcccaccttggcctcccaatcatgcccttcattttaagcacagtcacaagacatt

SEQ ID NO: 180087 - DNA, 601 bp, Human
tggttgcattcataatactggcatttttaagtcgtgtagaacttacaactttttaaacaccttcccatatactatttcatttggtcctcacaccaatctcatgaaataaacaagatggattttattgttcttgatgaataggtagcaaagctaaggcccagaaaggttaagtaattttcccaaagtcacacagctttgatatacagcaaaactcatatccctgagctttctactcactgttcttccggttattatccctgaggtcataaatctccacccgcaaacccaatagcaccagtamaagaaatctggactggagatactttatccacacctaccactgccccaaaaagtaaaatctgactctgtgattctaatgtaccaatggtactcaacctgggttatagctcaaaagcattttcttactgagctgcgtttgggcctctggcagttgagcactcatgacaccccgtctggtaaaccacagactaacctatataatcaggagtaaaacttaatcaaagtgataatttgtgaaatgaatggtcattatctgaattctcattatttcatgcccatcttttttttttttttttttttt

SEQ ID NO: 180088 - DNA, 601 bp, Human
agtccagtatgactttatctcgattacacctgtaaagaccttaagccatattttaaggttctaggtggacatacactttttggagaacactatttaactcagtacaaatagcaatgtagtaagagctcccatcatggctctaccagtgacaactgctctacaggcacgcgtgtgttttaccctctggaacagtcttgctccgatagtggctctcctaccaccacgctatccacgactacccaaatgacaacaaagaatggttgcattcataatactggcatttttaagtcgtgtagaactyacaactttttaaacaccttcccatatactatttcatttggtcctcacaccaatctcatgaaataaacaagatggattttattgttcttgatgaataggtagcaaagctaaggcccagaaaggttaagtaattttcccaaagtcacacagctttgatatacagcaaaactcatatccctgagctttctactcactgttcttccggttattatccctgaggtcataaatctccacccgcaaacccaatagcaccagtacaagaaatctggactggagatactttatccacacctaccactgc

SEQ ID NO: 180089 - DNA, 601 bp, Human
aacaatagaaattaagactttcacaattctggaagtcagaagtcccaaatcaaggtggcagcagggccacactccccctgagggctctagggaggatccttgcctctttctcgcttcggatggtggccagcatttcttggcgtttcctgacttgcagctgcagcactctagcctctgcctccatcttcacatgactgtcttcctactgggtgtcccctccctcttcttagaaggacatcagtcattggacttatggcccacccaagtccagtatgactttatctcgattacacctgtaaakaccttaagccatattttaaggttctaggtggacatacactttttggagaacactatttaactcagtacaaatagcaatgtagtaagagctcccatcatggctctaccagtgacaactgctctacaggcacgcgtgtgttttaccctctggaacagtcttgctccgatagtggctctcctaccaccacgctatccacgactacccaaatgacaacaaagaatggttgcattcataatactggcatttttaagtcgtgtagaacttacaactttttaaacaccttcccatatactatttcat

SEQ ID NO: 180090 - DNA, 601 bp, Human
tgtcccagtcctgagtaggtctaggggtgcatgtgggtgtatgagagagagagagagagagactgaggtggttctttcagcaagagagttacaagtttggggatgcaatacaaacgattttacctctccagatctcagtttcctcatcagcaaaatgaggggggttcatgggatgcatgcaatgtccctttcaactctctgatttcatcttccaagaatgcagctggcctgagatgcccatagccatgtgcaggcgggcaggtccacgtgtgattcttctgttgcctacaactctagcacytcagtgacttcataaaaatactgtatttgtttcctggggctgctgtaataaattatcacaaactgggtggcttacaacaatagaaattaagactttcacaattctggaagtcagaagtcccaaatcaaggtggcagcagggccacactccccctgagggctctagggaggatccttgcctctttctcgcttcggatggtggccagcatttcttggcgtttcctgacttgcagctgcagcactctagcctctgcctccatcttcacatgactgtcttcctactgggtgtcccctccctctt

SEQ ID NO: 180091 - DNA, 601 bp, Human
accccctctcctccgcatacctgactcccagtgtgcaccctccgagttctacccatgagccatggcattgagatgctgaggtcttccttcctccagccacttcgccaatccaaggctccttgctgcacccttcacccgagtcttcctgcccttcagcatctggcaacgggcagtcactcagtcacttgttttccaggcagccttccttgatgactacattttgctttatggctgtttgggctgcctcataaatcatccttcacctttgattatttagggtgtcatactgaatgcagtttgmggctgtgtagacctagtctcccagaaggtggggacccttttctatatacccatgtagccctcacagaaaggtgggaaagggtgcaagtgggaaggggctttaggagagagggggtatttaaaattaaaaaaaaaaaagtcccttgaggacacaacaatagataatgccattgtcccagtcctgagtaggtctaggggtgcatgtgggtgtatgagagagagagagagagagactgaggtggttctttcagcaagagagttacaagtttggggatgcaatacaaacgattttacctctcca

SEQ ID NO: 180092 - DNA, 601 bp, Human
aggaagatgctgccgcagagggaggcaggtcctgggggcaactgcccatctcactgggcagtctctggctttccaagaacagatccaggagcaatgacagccacagacggggagcagccacatccacatgttccagagctgactaacagattgtcctacaagcctcatggtcagcctgttccctctctgtcaagaacccatgaaggttatcacctgtatcatcaagactgaactccagaacctgcttttaggatcttctcactaataagaccctgccccaagtaatttctcactcaccccstctcctccgcatacctgactcccagtgtgcaccctccgagttctacccatgagccatggcattgagatgctgaggtcttccttcctccagccacttcgccaatccaaggctccttgctgcacccttcacccgagtcttcctgcccttcagcatctggcaacgggcagtcactcagtcacttgttttccaggcagccttccttgatgactacattttgctttatggctgtttgggctgcctcataaatcatccttcacctttgattatttagggtgtcatactgaatgcagtttgcggctg

SEQ ID NO: 180093 - DNA, 601 bp, Human
ttctggggagtgacttccatggagcagagcatcagggatgccaggagactctgcctccaaatccatctttcccatcaactggcctgtccccagaacctagagacgagtcttgttggcctttggggatttgccagttttaggacatcgttcagatgttatcaggcgacactctggatgctttcctaccgtggcatctagctgaaggagaggactgggtagaagaggccttggccaggcccagcaagcagggtatgtgatgtgatgtggaggaagatgctgccgcagagggaggcaggtcctrggggcaactgcccatctcactgggcagtctctggctttccaagaacagatccaggagcaatgacagccacagacggggagcagccacatccacatgttccagagctgactaacagattgtcctacaagcctcatggtcagcctgttccctctctgtcaagaacccatgaaggttatcacctgtatcatcaagactgaactccagaacctgcttttaggatcttctcactaataagaccctgccccaagtaatttctcactcaccccctctcctccgcatacctgactcccagtgtgcacc

SEQ ID NO: 180094 - DNA, 601 bp, Human
tgtttctcacgggtctataataggaccctaacatttgattaagtctgatgttcaatcttcctacatcaatacagtagttctttaatcaacatagtttctcctcttaatcatgtagcataaagtaaatcaaagacagatgaaaggaaaatattttcaattgtcacacatgtcttaatacaaaggaaggccacagaaaaacaaatgtcatgcgtgtcttaatacaaaggaaggccacagaaaaatgctcaatgaaaatataatctttggccacagcaagccacgattcctaatcgtgagaaayctccaccgaacactccccaaagatgtggattctatctgtattaaagtctataataaaaagagcaatagcaagtaacaattagatgatgaaggctgctctgcccattgtgcctttataactaaagtctcagctgacctgtccaataaacgaggtgaggatgcttctggggagtgacttccatggagcagagcatcagggatgccaggagactctgcctccaaatccatctttcccatcaactggcctgtccccagaacctagagacgagtcttgttggcctttggggatttgccagtttta

SEQ ID NO: 180095 - DNA, 601 bp, Human
atttataaaaggtgagaaaatcttcattgcatagatttactaatctaaaaacatttcttgttggtaaagtgattcagaagataaatctggctagctgacctttggcaagtcactagacacctctatgttcctcagtatccttaccaggaagatggttacatgcaaattttcctaccttagagagttttaggggagattaaatgatttaccgtgagtaaccctgttaaaacagttatctggcacacggtattcaacagggtgtgtctgtgcgtgtgtgtgtgtgtgtgtgtgtgtatgttgyctgctttatttctcttctctgtttctcacgggtctataataggaccctaacatttgattaagtctgatgttcaatcttcctacatcaatacagtagttctttaatcaacatagtttctcctcttaatcatgtagcataaagtaaatcaaagacagatgaaaggaaaatattttcaattgtcacacatgtcttaatacaaaggaaggccacagaaaaacaaatgtcatgcgtgtcttaatacaaaggaaggccacagaaaaatgctcaatgaaaatataatctttggccacagcaagccac

SEQ ID NO: 180096 - DNA, 601 bp, Human
agacgaagtctggctgattttaaatattatttgaaaatgccagatgttattagaggtactcatgggatcagtcagaataaaattgatgactcataaatggacttaagtatatgtaactgacagactgagattcaataagtactagtaataaaaaatgcacaaaatttccattacacattttacatatatttataaaaggtgagaaaatcttcattgcatagatttactaatctaaaaacatttcttgttggtaaagtgattcagaagataaatctggctagctgacctttggcaagtcacyagacacctctatgttcctcagtatccttaccaggaagatggttacatgcaaattttcctaccttagagagttttaggggagattaaatgatttaccgtgagtaaccctgttaaaacagttatctggcacacggtattcaacagggtgtgtctgtgcgtgtgtgtgtgtgtgtgtgtgtgtatgttgtctgctttatttctcttctctgtttctcacgggtctataataggaccctaacatttgattaagtctgatgttcaatcttcctacatcaatacagtagttctttaatcaacatag

SEQ ID NO: 180097 - DNA, 601 bp, Human
aattcagggcaaataagagtagaagaaaccatatccatctttctcttcttactttgtacctttgaagatcaggaaagatagaatttctaagtttgaaaacaggctaaattagaatcattctgtctatatttttaaaagacgaagtctggctgattttaaatattatttgaaaatgccagatgttattagaggtactcatgggatcagtcagaataaaattgatgactcataaatggacttaagtatatgtaactgacagactgagattcaataagtactagtaataaaaaatgcacaaaayttccattacacattttacatatatttataaaaggtgagaaaatcttcattgcatagatttactaatctaaaaacatttcttgttggtaaagtgattcagaagataaatctggctagctgacctttggcaagtcactagacacctctatgttcctcagtatccttaccaggaagatggttacatgcaaattttcctaccttagagagttttaggggagattaaatgatttaccgtgagtaaccctgttaaaacagttatctggcacacggtattcaacagggtgtgtctgtgcgtgtgtgt

SEQ ID NO: 180098 - DNA, 601 bp, Human
ctctccacttctggttcccaacttccctgctcccatctttcccaattatttataattcagggcaaataagagtagaagaaaccatatccatctttctcttcttactttgtacctttgaagatcaggaaagatagaatttctaagtttgaaaacaggctaaattagaatcattctgtctatatttttaaaagacgaagtctggctgattttaaatattatttgaaaatgccagatgttattagaggtactcatgggatcagtcagaataaaattgatgactcataaatggacttaagtataygtaactgacagactgagattcaataagtactagtaataaaaaatgcacaaaatttccattacacattttacatatatttataaaaggtgagaaaatcttcattgcatagatttactaatctaaaaacatttcttgttggtaaagtgattcagaagataaatctggctagctgacctttggcaagtcactagacacctctatgttcctcagtatccttaccaggaagatggttacatgcaaattttcctaccttagagagttttaggggagattaaatgatttaccgtgagtaaccctgtt

SEQ ID NO: 180099 - DNA, 601 bp, Human
ccctgcatcttggcttttggggacagtaggaagccctgtttttcaatatccctcactccaagaagagagtatattaattttccaccagggacctgatacggtttggagacatctggatgctgggcgggggtgctgggcagttccacagacctggaactgtaacccagcctcagatcctggggaagggtgtggttctggaaaagagcgttactctggtgtttactcaaagatagtcattaagtcactgtgaagacatcttttctgcagactaaacaacctcactcatttttttaaaagcttycctcacaggagttattttttggtactatctttctatatttactggttttccccagacattcttctaccctcccactctctatcttaaaaatgcctgtaataagattttgatctgtgccatagaaagaaaagggtcattttcatagttttcatctctggccctcatgaattaataaaaggccagcatagacggtaattactcccttgtggtccactctgaccctcagacctctttgggctgcctctgtgcctggccaatcttccatttactatttgtttctgatcctgttgaactttactg

SEQ ID NO: 180100 - DNA, 601 bp, Human
tttgttttctgaagctcaataactttgttatttctttgaatgttacaggaaatgctggcagtgaggcaaaacccagccttctttatgcatgaggaaataagagaagtagagggtatacccagggtcacctggcttcggcttcttcaggctggtcggcatttcaactgtcccagagacggctgttgcttctagttctaaatacagtggttctacagcctcctgaaggagcatttctctaagtttagtcaccctcaaagtcgattttcttatacctaacaactgcctccctcccagccaggcmccttgccataattcaagcctgcttcctctttggtcctctgtggagaacaaacttgctttggtgtttatgttctgtttaatgcagggttacattaacgtaggaatgtccaggttgacattcctactctggaaacctaagaagagctcacagtcattccttagacctgtgtggtcctgtctgtgtctatggcctgcttttcactcataaagaagaatcagggtctgttatcaagtcccacagtctcccaagtctaggcatggccagaaagtctcgatcagaaaaagctgagagggccctctg

SEQ ID NO: 180101 - DNA, 601 bp, Human
agacatcttttttcccctctgactgccaattcttaaaagtcagagtcgccaccatttgttttctgaagctcaataactttgttatttctttgaatgttacaggaaatgctggcagtgaggcaaaacccagccttctttatgcatgaggaaataagagaagtagagggtatacccagggtcacctggcttcggcttcttcaggctggtcggcatttcaactgtcccagagacggctgttgcttctagttctaaatacagtggttctacagcctcctgaaggagcatttctctaagtttagtyaccctcaaagtcgattttcttatacctaacaactgcctccctcccagccaggccccttgccataattcaagcctgcttcctctttggtcctctgtggagaacaaacttgctttggtgtttatgttctgtttaatgcagggttacattaacgtaggaatgtccaggttgacattcctactctggaaacctaagaagagctcacagtcattccttagacctgtgtggtcctgtctgtgtctatggcctgcttttcactcataaagaagaatcagggtctgttatcaagtcccacagtctccc

SEQ ID NO: 180102 - DNA, 601 bp, Human
agtcaacctgggagtctgcatgcacttggcttttttctagaagtcccttgtaaaatgtgagactttctacctggggctattgcacctctatatatcatacttatacttattccacgcatttagtttttccccaggccccaaattccatttggcagggaagactgtgtaaaaatggatgcttctttggcgcaaatcccttctgtctgctcagagggtgcttctccatataacaactgttttcttaagttgtaaaacagcaggggcagagtaaactgtatatacagccagaccgttacaatcrcatagacatcttttttcccctctgactgccaattcttaaaagtcagagtcgccaccatttgttttctgaagctcaataactttgttatttctttgaatgttacaggaaatgctggcagtgaggcaaaacccagccttctttatgcatgaggaaataagagaagtagagggtatacccagggtcacctggcttcggcttcttcaggctggtcggcatttcaactgtcccagagacggctgttgcttctagttctaaatacagtggttctacagcctcctgaaggagcatttctctaagttt

SEQ ID NO: 180103 - DNA, 601 bp, Human
tcctttcgctctatcttttgtgcttaaggaggagacactctcagtatatcaacaagctactaagtgctctacgtgctaaccgaaaacagagcccaccttggtgctggtaagaacccattccaggcagaggataccttttgatggtgctcttgctccatgataaagttaatttttcaacaattaataatttctatattactctaagatatttcttaaaatcctatggaatatgagaaaaacaagttttgattttctaaggggcaggtccattactgtaaaagagcaagaaaccatctgaaaygaaaaacactttaaattccctttggcgtatacttttggctacagcttcaccactgaaaaccctggaagaggggagggatgcatcaagtttacccgtcggcatgaaaaacagacgagctgtggcacagcttctcattctcagtccttaacttagtcagcggaatggcaggttgaatggcagtttgtccctccaaatgccagataactgctttatttagttaagcttgcacgcatacctcaagtcaaaggctccacacctgcaatgaggcactaccatttgcccttctataatagacagtct

SEQ ID NO: 180104 - DNA, 601 bp, Human
tgcagtgagccgagattgtgccactgcaccccagcctgggcaacagagtgagactctgtctcaaaaacaaacaaacaaacaaacaaaaaactctcaaatatccttttcttgaaaaatcctttcgctctatcttttgtgcttaaggaggagacactctcagtatatcaacaagctactaagtgctctacgtgctaaccgaaaacagagcccaccttggtgctggtaagaacccattccaggcagaggataccttttgatggtgctcttgctccatgataaagttaatttttcaacaattaayaatttctatattactctaagatatttcttaaaatcctatggaatatgagaaaaacaagttttgattttctaaggggcaggtccattactgtaaaagagcaagaaaccatctgaaacgaaaaacactttaaattccctttggcgtatacttttggctacagcttcaccactgaaaaccctggaagaggggagggatgcatcaagtttacccgtcggcatgaaaaacagacgagctgtggcacagcttctcattctcagtccttaacttagtcagcggaatggcaggttgaatggcagtttg

SEQ ID NO: 180105 - DNA, 601 bp, Human
ctgcccaatccataccaccaggaccagccccccaagacgggtcagttagggtccccactgctcactctcctcaacctctccttggcaaaatatcttcctccatggcattgaaccaattcctgcattgaaattatttaatgaaatctctgtagagaagatgctttgggatctcaatattagcatagagacacctaaattacagatttgtgagctgagagctggagtttttcattagatcctagaaatataaaacatacattaaaaaaacaactctcagccattcgtagtagctcatgcctgyaatcccagcactttgggaagccaaggtgggcagatcacttgaggtcaggagttcgagaccaggctggccaacatggtgaaaccccgtctctactaaaaatacaaaaattagctgggagtggttgtgggcatctgtagtcccagctcctccagaggctgaggcgggagaatcgcttgaacctgggagtggggcagaggttgcagtgagccgagattgtgccactgcaccccagcctgggcaacagagtgagactctgtctcaaaaacaaacaaacaaacaaacaaaaaactctcaaatatc

SEQ ID NO: 180106 - DNA, 601 bp, Human
ttacatgctggcttactagttgcgtgactttgggcaaggtatacgatttattttttcttcaatttccctgcctgttcttttgaagattatataaattaatatgcgtgaagcactgtgaacagtgttgggcaaataacactatttaatgttagctattgctattatcgagtatttttatgattaagagaaaataacaatgtgaactaggtgttactcaatcctaagagcaattatttttaggtccattatcaccaccagtttacaggttggttccttcccttccttcccttccttccttcatttttttttttttttgagacaaggtctcactctgtcacccaggctggagtacagtggcaccatctcggctcactgcaacttccgcctcctgggttcaaccgattctcctgcctcagcctcctgaggagctgggactacaggcgtgtaccaccacaccaggccgatttttgtattttctggtagagatggggttttcctgtgttggccaggctggtctccaactcctgacctcaagtgagccgcccgcattggcctcccaaagtgctgggattacaggcgggagccactgcgcctggcccat

SEQ ID NO: 180107 - DNA, 601 bp, Human
agggcagccacttacagccagagaatttcagaacaaattagaaagccctttaaaaactttacagcaaaaaaacgacgtctatctcatgtaccacctgagtgcatgtggatttgcctgatgtgatttaggatggcactgcccagggaaggcctggaggcctcggcctctaaggggccagtttacgggaacgaacttacggctttattttgctgaccatattttgttaccctttttgcatgagaactaatttagagattatctcgtcccattgcctggttcaacaggagaggaaaatgaagaygaaagtatttaagataattgctcaagttcacacccactggcctggtggcaccagtgtgaaaacccaggtccctaaattcaggatccagaaaactttttacatgtttgaagcttaagaaacagaagcctaaatgcagacagggttttttttttcttatggcatgtcatacaatgaattctaacaaggactgcaatatattagtttagatcctgacctcactggtgtggcattcaaattagtgatatggttttgcgagggtccagacggaaagagaaattcaatgtaatggtgtaagtttct

SEQ ID NO: 180108 - DNA, 601 bp, Human
tggagaggctcagtcagaccagctgctcccccaggaatcggctctcatagtgttagcaagtgccaaaatggagacctcaacccctagtcttgattacatgttggtggcagagaaggcagggcagccacttacagccagagaatttcagaacaaattagaaagccctttaaaaactttacagcaaaaaaacgacgtctatctcatgtaccacctgagtgcatgtggatttgcctgatgtgatttaggatggcactgcccagggaaggcctggaggcctcggcctctaaggggccagtttacrggaacgaacttacggctttattttgctgaccatattttgttaccctttttgcatgagaactaatttagagattatctcgtcccattgcctggttcaacaggagaggaaaatgaagacgaaagtatttaagataattgctcaagttcacacccactggcctggtggcaccagtgtgaaaacccaggtccctaaattcaggatccagaaaactttttacatgtttgaagcttaagaaacagaagcctaaatgcagacagggttttttttttcttatggcatgtcatacaatgaattctaaca

SEQ ID NO: 180109 - DNA, 601 bp, Human
gcttgtgatatgtctgataatatagccataatgtacggtaatagattatacctaatttaccctttctgtattgccaacttttcataattaatactttgatagcaaaaaaaagcaaaccttctctaaaagttgcctttaaaggaaaagaatatgcgatgaacaggagaacacagaaattgcctatcagctcaaatgaatttaaatgcagatatggtgtaagggggtagcttttacttatttaagctaaactggaattattattattattattactattattattttggtggtagtagtggarttccatgagacccagtgtatcaaattcttactaatgcctttcctagttacatggcttacaggaaaaaacaacaacaacaaaaaaaactgaagcctttgagaaaactcaaggagaaatttttcaaaatgaaaaatggaaagtggctagggtatgagaaaaattctaaatctacctgaaagcacaggagttgatgtattttaatgtgctgggatgctgtgactgccaaccgcaatccatctgaaagctgtgggtccatccatccccatgggagacgtgcacccaatgacaaggcctgaccat

SEQ ID NO: 180110 - DNA, 601 bp, Human
ttcatgacagcaaattttaccagtgacacggcataatttacacatagaagttgatgaaaatataccatgtgtcaatcatactataaaaaaggaatttcacatccaactaaatgtcactggcttgtgatatgtctgataatatagccataatgtacggtaatagattatacctaatttaccctttctgtattgccaacttttcataattaatactttgatagcaaaaaaaagcaaaccttctctaaaagttgcctttaaaggaaaagaatatgcgatgaacaggagaacacagaaattgccwatcagctcaaatgaatttaaatgcagatatggtgtaagggggtagcttttacttatttaagctaaactggaattattattattattattactattattattttggtggtagtagtggagttccatgagacccagtgtatcaaattcttactaatgcctttcctagttacatggcttacaggaaaaaacaacaacaacaaaaaaaactgaagcctttgagaaaactcaaggagaaatttttcaaaatgaaaaatggaaagtggctagggtatgagaaaaattctaaatctacctgaaagca

SEQ ID NO: 180111 - DNA, 601 bp, Human
attttattcaatccgcacaataatccccaacagagggatatcatactcctggttttatacccaaggaggctgagggtggggaggttaatctgatcccgaaggggaggccaggctgaatcaggaagccagctctggagcttcgccatcagccactgctccagctcgcctttcaggctatctcttttaatcctcacatcccctagcaagagaggtatcatgcagtccattctacagatgggaaaactgtgaaacgcagttttagacttgaagctccaaactcctttctcgctcaccgaggctmcctgagcaccctggttcactttattttttgagacagagtctcactctgtcacccaggctggagtgcagtggagcaatctcggctcacagcaacctctgcctctcgagttcaagtgattctcctgcctcagcatcccgagtagctgggattataggcgcctgccaccatgcccggctaatttttgtatttttagtagagacggggtttcaccatgttggccaggctggtctcgaactcctgacctcaggtaatcggcccacctcgggcttccaaagtgctgggattacaggcgtgagctac

SEQ ID NO: 180112 - DNA, 601 bp, Human
gtgagggccaaatctgccaagcttttttttttcttctttttttttaagtacttggcaatggtaaatatttggcccccacttgaacagaattccatttgtttcctctcataaggtctttgggacatggtcaaggggcctacccgtctagagcatgtgctttaataatagcagctaatatttaaggaacacttctgtgcccagcacggtgctatgccctaacatgaattattttattcaatccgcacaataatccccaacagagggatatcatactcctggttttatacccaaggaggctgarggtggggaggttaatctgatcccgaaggggaggccaggctgaatcaggaagccagctctggagcttcgccatcagccactgctccagctcgcctttcaggctatctcttttaatcctcacatcccctagcaagagaggtatcatgcagtccattctacagatgggaaaactgtgaaacgcagttttagacttgaagctccaaactcctttctcgctcaccgaggctacctgagcaccctggttcactttattttttgagacagagtctcactctgtcacccaggctggagtgcagtggag

SEQ ID NO: 180113 - DNA, 601 bp, Human
taacattgggagggaaagttctgtttattccaagacactagtgcctcctattcaccttggtgaccacatttgagccagttaggaaatgaaggaagggaaggttccatccttgccagggatggagacagggatggagggcaaggatggacgcccaggacagccttctgtccggcaacattccccctcctcaatcctttcccgattcgaaaggtacacaacttccccctggcctgtctaccttgagtctctgcctatggctgcctggcctggtgagaccagcctcccagctcctctgtgttaygcaggcaataggagagctgccttttcaacaactgttttgaactttcctctccttttaactccttcaacagtccctcttctgtgtgaacactctggtgtgtgaaagcaagacctcagctcagggagacagccctcataaactgccgcagattaccctgtcttttcccagccggagggggaccccgccccactcccttcccagtctcttccccacccccaacttttttttttaaccacttctgcttccttcattttctcagcagctgcagcggagagatatagtaaagctactgtataggat

SEQ ID NO: 180114 - DNA, 601 bp, Human
acagccatacacataaaaacatacagatgcagctgggcgcggtggctcatgcctgtaatcccagcactttgggaggctgaggcggacagatcatgaggtcaggagttcgagagcagcctagccagtatggtgaaaccccatctctactaaaaaatgcaaaaagtagccgggcatggtggcacgtgcctgtagtcccagttacaagtaagtggctgaggcagaagaattgctagaacccaggaggcagaagttgcaatgagccaagatcatgccagtgcactccagcctgagcgacagagcragactctgtctcaaaaaacaaaacaaaacaaaatatagatacacatggacacacatgtataaacacacatacagacacacatggacatatacacacaaacacaggcatgcatgtaaacacatacagacacacacatacacagacacctggacacacacacagatataaaacacacatggggatacacacatataaatacacacagacacatgtacatacgtcacacagacacatatattaagacatgcacagacacacatacacatacagacacaaaccaggacagacacatatatacag

SEQ ID NO: 180115 - DNA, 601 bp, Human
tttacccactcagcgatttctagaggggtgatgctttagccccagagaatcaccagcaggaatagcagagcctttggtcggaaagagcttttgtactcttgtgggtggtaacaggaaagcaagcactcactgggtccacctgtgtatggggctttcctactctgggccttcccgaaccatggtcctacagtggcctctcaggtgacatgaagtacaggtcatgtcacctgaggtcaggtggcattttcttaagcctgttttctaaggcaaatgcctcctacttgaaactagaaggcagatrggttgagctcccctctttgctccggcagcagtggccaccttgctcttgcccctgtgtcactgccctggggcctttgcacttactgtttcctctgctcaggaagctcttccctgagatccctgtggacctgatccctcccacccttcaagtatttgctgaaatgtcatcttctccctgaggagttcctggagatccccttttaagttgcagactatcccacatccagccagtccctagccctttggcttaggttttctccatagcacatgttaatgttatccagggtctgtctgcacccat

SEQ ID NO: 180116 - DNA, 601 bp, Human
cacttcctaggaatcccttttacccactcagcgatttctagaggggtgatgctttagccccagagaatcaccagcaggaatagcagagcctttggtcggaaagagcttttgtactcttgtgggtggtaacaggaaagcaagcactcactgggtccacctgtgtatggggctttcctactctgggccttcccgaaccatggtcctacagtggcctctcaggtgacatgaagtacaggtcatgtcacctgaggtcaggtggcattttcttaagcctgttttctaaggcaaatgcctcctactygaaactagaaggcagataggttgagctcccctctttgctccggcagcagtggccaccttgctcttgcccctgtgtcactgccctggggcctttgcacttactgtttcctctgctcaggaagctcttccctgagatccctgtggacctgatccctcccacccttcaagtatttgctgaaatgtcatcttctccctgaggagttcctggagatccccttttaagttgcagactatcccacatccagccagtccctagccctttggcttaggttttctccatagcacatgttaatgttatcca

SEQ ID NO: 180117 - DNA, 601 bp, Human
gccagtcaattggatactcactacatgaatctggatataaaaatatggggttttcttcctttgatttgctactgttttatgacaatggaaaagaaatcaatgtgtgtagagaacagcttacttttcctggtatcacagtctaacctttaggttgcagggtcattaggatttcaaagtgacagtactgaatgtgactcttcctgaagccccttgcagatggtaaaataaatctccctaattgcaaacctaaccatatgctggctaatttaatgttgggaaatattcttcaatattatttacsataccacatgtatattatatatactatataatataaactatataatggtatatagtatgtcagtatacattctaattcatattatatatgcatgcttatatattgtccagtgctacgtaactatgggtagcctcactttcccccaccccaatttcttctcatatcgttaagctaagacaacaccacaaggttggagtacttcagaactggagaatggccacagaaatcagccttggtttttaactaatgtgtgggaagtgaggttcagagaggttatgtcatttgcccaatctcacacgg

SEQ ID NO: 180118 - DNA, 601 bp, Human
gatgaagccttccttagctcctccctcctcttatctctgccatagatccttggcttcctgatgatcaaactgaaaaatctgcagttttcttgcagaaaaacaaacaattccaatggaacaaccattcaaaacataataactcagccctttaacctcctaccacagtctaatgcctggcattacgagttggggtaaagaagaaggcaggaacaatgattgtggagagctctatctgcctcagaaataatgccagtcggcaaaggctgccggcaggttttgtgctcatttcaaaacttcacawtcctcaggcacttagtggcatttttgaagaacactgtgtcaaggacagtgggtgacccaggagagtgatgtgagcgaggtcattctgaatacacagcacttgacgtggtagagtctacagccacagcttggaaaaacagctcttggcagttgtgtctctcttagccagcaagcgtggggacctgtgccacggagacacccaacaggaatcatcattccaggtaagccagtcctgtggtcaggcacaacgtgaggtattttttgtttgtttgtttctttgttttttattttaattagtccc

SEQ ID NO: 180119 - DNA, 601 bp, Human
tggggggacctgcattctctattgatttgcaaataacacccttgatgtgatgacatccatacatttcaactatttcttaataataaaaaaacactagatacaaaacccacaaataatctggcaatagcgagaacttgaaacatcccatcttcactttgcttgacgtgtgtgtgtgtgtgtgtctgcgtgtgtgtcttcaagcctaatgggtaggtaaaaaaatagcatagccaaagctaactcttaaaaaattcaagagagctatctatccaatatggatatccatacccagagctcctcatatcctctgtagcagtgcttttccttgtggggatctggttacaatgcagatctgactcggtgggtctggggtgggtggggcccaagactctgcatttccaacagctcccaggtggtgctgttggttcgaggcctttctctgagcatcaaggggaaaccccagttggtctgggaaggtgtgtgcacatgggggccagttgtgggtggtggcccaggtgcaggagaggcgggcagtgggctccatctggtacttaccctgcatctgactctgaggctgagggttaaaggcagtggagtggtt

SEQ ID NO: 180120 - DNA, 601 bp, Human
tcaagtagaagaaccttccccagaaacctaacagtgagagctaatggcatgggctgtcaagctccatgggagacagtgggcatgccttttgagaacccatgtttttgtttgtttgtttgtttgttttttgagatggagtctcgctctgttgcccaggctggagtgcagtggtgcaatctcggcttactgcaacctccaacctcccgggttcacaccattctcctgcctcagcctcctgagtagctgggactacaggcacccgccaccatgcctgcctaattttttgtatttttagtagagwtggggtttcaccatgttagccaggatggtctccatctcctgacctcgtgatccgcccgccttggcctcccaaagtgctgggattacacgtgtgagccaccgcgcccggcctgagaacccatgtttgaacccaaaatagagagctactggcctggaaacccaaaggaacagatgatatttgtacatcccacaatacaactcacatacagaaaatgcctggggaagctaattcctgctgtccgagaggggcaaagagctaccacatcgattgctggccacctgcccttttccccagatgtgt

SEQ ID NO: 180121 - DNA, 601 bp, Human
ctggtaagccttctccctgctcatataccccctctttcactcttatttagagattcattattctgagttttcttttctcccaaactttataaacaaatgcacatgtaccaaaggagacagtttattaaggtgcccaccacacagcctggccccaaaattcttcttattatcaacatctaattataatagaacatgttcaatacaagaatgccaagtgagtggatagcccaacactttttccatccctcctttggtgattgggattcttctcgacactggtcagccctgtagtaaatcgatgcttgacccaagagtgcacgcccagggaacggccatcccacttgcactggctttgtagcaaggaaggtctgggtttgcgtccaagttcatcacttacaatctttgagatactgggcaatttttaacctctgaatttcgatttctctgtctataaatgataccacaggattgttgagggaatggaataatatgtacaaatgtctgacccacgtcaaaatagctcacaactggtccagttaaagagttaaatcttcttcctacatgcttatgacaaccagcatgcagaagaacaacaaaatgg

SEQ ID NO: 180122 - DNA, 601 bp, Human
agtggattagatgttgactgggtttggatgataagcacttggtcccaatgaacttcaaaagtaggaaggcaatggccccaataaagtaaacagagtggctggtaagccttctccctgctcatataccccctctttcactcttatttagagattcattattctgagttttcttttctcccaaactttataaacaaatgcacatgtaccaaaggagacagtttattaaggtgcccaccacacagcctggccccaaaattcttcttattatcaacatctaattataatagaacatgttcaatayaagaatgccaagtgagtggatagcccaacactttttccatccctcctttggtgattgggattcttctcgacactggtcagccctgtagtaaatcgatccttgacccaagagtgcacgcccagggaacggccatcccacttgcactggctttgtagcaaggaaggtctgggtttgcgtccaagttcatcacttacaatctttgagatactgggcaatttttaacctctgaatttcgatttctctgtctataaatgataccacaggattgttgagggaatggaataatatgtacaaatgtct

SEQ ID NO: 180123 - DNA, 601 bp, Human
ctctgcttcctgcatcctggtgcagcacaccttggccaccccagctgtggcttcagtgggcctaggtatagctaggctgccattctgaagggcacaagcagtatgccttgatggtctctatgtggtgctaattccgtaggcatgcagaatacatgctgtggaagcatggcttcctccacctagattacgaaggatgccacagactgcctagaagctcaggccaagacctaccacaggggaataccactgcagacagtacctagcagggcaatgttgaacagaaatgtgaggttgaagctgccacaaagagtccccactaaggctgtgcctaatggagacacagaattggggctatccctgagaacccagaactgcagagccaccagtgtgcaactctagcctggtaatgctgcagacacaagacttcaacgtgagagaggtgaagtttgggctgagcccagcaaaactgtaggggcagggctgcccaaggccttgggggcctagtcttagccccattgtatccagaaggcagaacatggagtcaaaggagattattctccagttttaagacttaatattgtttaccctgttggattttgaa

SEQ ID NO: 180124 - DNA, 601 bp, Human
agcctcccgggtaactaggactcaggtgtgtgccaccatgcccagctaattttttttttttgtatttttagtagagatgggggtttcaccatgttggccagcctgctctcgaactcccgacctcaagtgatctgcctgccttggcctcccaaagtggtgggattacaggcatgagccactgtgcccagctgtgaattaaatttattttctttataaattacccagtctcaggcatttaacaaaagaactaagacagaaagttggtaccaagatgtggggttgttactacaacaaatacctgaaagtgtgtaagtggctttggaactgtataaccgtgaaggctgaacaagtttggaggagcaggctagaaaaaagcctgcattgccaagaacggttctgccattaggggcaattctggtgagggctctgaaagaagaccttagaactaggggaagtctaaatcttcgtagagattacttaagtgattacttaagtgtatgtgaccagagtgctggtagaatgctggtaaaggccattctgatgaggctgcagatagaaatgaggaacaaggtattggaaactggagtaaaggccatattta

SEQ ID NO: 180125 - DNA, 601 bp, Human
aacagatccatgtctgggcaacggcttctctcatttaggaacatatggtggctcagagcctctcacacagcagaactataaaggctccttccaaataagcagcagagtgaggggctctggggcaaccctactggttttcctgagaatgttagttaggggtgaccattaattcacgggaactgcagtatccagaatgacagaatgttagtgttgaagacaacctggttaatcacttacatgatagatgagggactgggacttggtggtaaaggaaacagtgctgggtcacgtgaaaacaaascagacaccacaggcaggaccttccgggcaatgcttccccctaaccatgtcatgcacctacaggtgactggtggtggggattcaatgaaccagcaacattggtctgttctataaatacgagctatcattattttattactcccttcagtaaacatgtgaaccaggcaatgtccttgtcataatcttgctgtcataactgctctgtgataacccaggtatagacacaatcacaaacaaaggctatcattttaaaacggggaagtgggtgagtctcatgcttcaaaagcttctgcattcatct

SEQ ID NO: 180126 - DNA, 601 bp, Human
cagcccccaagcaggcttaaagggccgggcttgtgggaggaatcggcacaggatggtatttactcaaaatcacacaggacggtgaaacttggttaaaagaaatccttttgtagctgcttcattaaaaacaccaaagaggctgaccattcacatttgttgaatgcatccaattcatgcaagtaatgggacaggtcagggttcacccttgcctgctacccacgtgggctttgtgctcaggaagtgacctgtcggtctcctgtagctggttgtccccaacagggagcagggctggggtgccggstggggctgcggagggtgggcatggctttgaggaggatatcccttccttgctgggtggggctgagtagaatgggcgtggctttgaggaggatttcccttccttgctgagtggggctgaggagggtaggtgtggctttgaggaggacttcccttccttgcatgctttaagaatccctcctccagccaggcatggtggctcatgcctgtaatctcagcactttgggaggccgaggcgggcggatcacctgtggtcaggagttcgagacgagcctggccaacatgctgaaaccccatctgtact

SEQ ID NO: 180127 - DNA, 601 bp, Human
ctgggctcatccatctaacaaggggtctagttttctgcgattcactcatctctaatgctcagaagttcaaagtcactgtaagaagtgcccaagtcagaggaggtcattacacttgggaggaaactcacagcaccattgaatgctgtttctgagtggatccatgtctttgagcaagaaaagtctctcctcctcatacctgttctttagaaacttgtggttctcagactgctgaggcaagcccagagctcgagcccccgggagtgtggtcatgacatggcaagagccacacgctatgggaggsgaagatggagatgacaggtctgcactgctagttactgccatgctccagtccctcttcctaatcaattcttagataagtttcattgaggagggaggattaccaagtcaccaagtcttagtgaagggagggggcccagaagccacccgtcaatgcgggagcccccactctggtgcctctgaaagaagggcatttggtctctgcaaattcctgtgacattccagggtagcttttggccctgccattcgtcaccctgaccctgaattcatggacaaggacgtggccgtcacagggatgccttca

SEQ ID NO: 180128 - DNA, 601 bp, Human
atcataccctgcctgtttgggttatttgagactctttttctgtaatataaagatgagaaactgggtggagcagcgtgcagaggcacacgggtgtttgtcctgtcttgttccaacagcccctctttcgcctaagtgctgttttgaagggactgctcaggacggttcacattgctacatccaaatcctaggaatgtgtccaagctggggaggaggggaaaggaaagctgagcgctctgatatgggtggtatctgtgtgaccctgggcaagtctcttaacctctctgggctcatccatctaacraggggtctagttttctgcgattcactcatctctaatgctcagaagttcaaagtcactgtaagaagtgcccaagtcagaggaggtcattacacttgggaggaaactcacagcaccattgaatgctgtttctgagtggatccatgtctttgagcaagaaaagtctctcctcctcatacctgttctttagaaacttgtggttctcagactgctgaggcaagcccagagctcgagcccccgggagtgtggtcatgacatggcaagagccacacgctatgggaggggaagatggagatgacaggt

SEQ ID NO: 180129 - DNA, 601 bp, Human
gaggatggaccagccgaccggcagcttcttgggcagatgcctgcagactgtctgcagatcataccctgcctgtttgggttatttgagactctttttctgtaatataaagatgagaaactgggtggagcagcgtgcagaggcacacgggtgtttgtcctgtcttgttccaacagcccctctttcgcctaagtgctgttttgaagggactgctcaggacggttcacattgctacatccaaatcctaggaatgtgtccaagctggggaggaggggaaaggaaagctgagcgctctgatatgggyggtatctgtgtgaccctgggcaagtctcttaacctctctgggctcatccatctaacaaggggtctagttttctgcgattcactcatctctaatgctcagaagttcaaagtcactgtaagaagtgcccaagtcagaggaggtcattacacttgggaggaaactcacagcaccattgaatgctgtttctgagtggatccatgtctttgagcaagaaaagtctctcctcctcatacctgttctttagaaacttgtggttctcagactgctgaggcaagcccagagctcgagcccccgggagtg

SEQ ID NO: 180130 - DNA, 601 bp, Human
gcggtttcatcaatgaataatatggagctggggacaaagtcccctctactttctgcggctgtcactgaaatgtcagcagtggagggaaaaccagaagagaaaacctctcactgacaggcgccctcagtgtgcaaagagctcaagtttcagtgctggggtggggtgggggctgcgcccctgcctattcaccccactcctcccctgggctgctccactcccatgatgactgggaatttatcctacaacaggccacgagctccttgttctgcagtaggaaattatccttcataagagggcaacygttagtattgtttgtttgttttttaatttccaaaagtaaggagaagtttattaaataagagcgggggaagggaggagggagaaggagagggaaagggcccgagaggcagctgaccccagcatttcccgtctccccttggcttctcccatcccccttgtcccagacccccctccttctggttctgaatgtgaaaaataagcagcctgcacctcctcgactggagatgtgtctaacaaggccctcattgtctcagacaggtgtgagattggacttgattcggggccaacacctccagtaccg

SEQ ID NO: 180131 - DNA, 601 bp, Human
ctgggaagtcctaacttcatttatgtcttctctccaccctgaaacgatgccaaaatgaccccaaatctcaaataaaagttggtgtctgttgctgtaaatgtacaaataacccaaagtcaaaattagggatggaagttaccattccttttgccttctgtgttttgaggtggtcgtggggaggaggaaggctttcagggacaagcagacggcgacagggatcacactgtcacctgtgtgcgccttttcttctaatggccttaaactgccaagtggctgcaactgcagcgtgctgattttaaaygcttttatggaaagcaccatccccttttcgactagcatcacttaaaataatgagttagatgcacttgtattattctgtctttcaagtggattaaattcacaggctcgctctcctccagtctcgcaagctttggcctggctgtctgaacctccagattagactgatgagcacatgccagacagcaatgaaatgcaattacccaggcaaacttttgaaggatttgagccctggggcacaggctgtttacgaaagactaaaagcaccgtttgtgctgagcaggaccagttgcctccgtctttt

SEQ ID NO: 180132 - DNA, 601 bp, Human
aatgatagagcagaaagcaacctccgagacagcagagacaaccatgccagccccatctcagagaaagctgcagtgcggaatggtgaagggactccccctattctccacagcagatagcaacagagcagggacagaccttctggctctttgtagactactgctttaactacatgatagttagaaactataaccctcccatcaatctagttaccatgtactgacagaacaaaaagacctagctaaacctcaaaaaaaaagaagtcactggaaagcacattgtccagatggttctggtggggarcacctttgcctgcttatagctctgtgagatcctgagcttggtgagatggactgggaagtcctaacttcatttatgtcttctctccaccctgaaacgatgccaaaatgaccccaaatctcaaataaaagttggtgtctgttgctgtaaatgtacaaataacccaaagtcaaaattagggatggaagttaccattccttttgccttctgtgttttgaggtggtcgtggggaggaggaaggctttcagggacaagcagacggcgacagggatcacactgtcacctgtgtgcgccttttcttct

SEQ ID NO: 180133 - DNA, 601 bp, Human
gcatgagtcacatgtaactagataatgacgcaaatcaccgtcaacattacttaaggtttcattctaatgtcttatggaatgatagagcagaaagcaacctccgagacagcagagacaaccatgccagccccatctcagagaaagctgcagtgcggaatggtgaagggactccccctattctccacagcagatagcaacagagcagggacagaccttctggctctttgtagactactgctttaactacatgatagttagaaactataaccctcccatcaatctagttaccatgtactgacaraacaaaaagacctagctaaacctcaaaaaaaaagaagtcactggaaagcacattgtccagatggttctggtggggaacacctttgcctgcttatagctctgtgagatcctgagcttggtgagatggactgggaagtcctaacttcatttatgtcttctctccaccctgaaacgatgccaaaatgaccccaaatctcaaataaaagttggtgtctgttgctgtaaatgtacaaataacccaaagtcaaaattagggatggaagttaccattccttttgccttctgtgttttgaggtggtcg

SEQ ID NO: 180134 - DNA, 601 bp, Human
attgggattgcagtgggttaataacacaggttggtgaggtggaatttgcagcataaaggaaacacttgaagataagagccatttgtgctttcataagctcatccctggtgctctgaacaaaggacacaaactaataaagtcagattcatctaggggcaatctacactcgctcaccccaaactctgattcagaaaggcaaatggaaatctgccagaattcttttaaactccaacacagatctcgatttaaaaaatgacacacacaaaaccgcttggtaataagcagacctctgatgatctamagatccacagcttcgtttattgacttagagaaagtaaatggcatttcaaatacaaccttcatacttcaatagatgaggtcaccctgagaaagatgatactcagcccagcagtgggaaacctccctccagagaactgctttgatttacaaggccaaggaaggctttctcatagaagccatatacttgggctaaaatggagtaattttttttaaaaaaattaaatgtagaggttgagatagcagacaactatgaaactcttgctcaacaagagggatgacctatggaagacaggaatgctag

SEQ ID NO: 180135 - DNA, 601 bp, Human
gggaagcttcaagcagaagaggcacagcatctcccaggactgcacacagctaaagaaacagaattttctgaagaacactccattgaggtggcacctgatatcaagaggattgtgcacgcttgatagtctatgcttggaaggcctgggttgggagactgtcatctccaacctgcagtccaggctgggcatggaaggccgtgctttacagccaatctccactgtgctgatgaggggccggtgggatttcctagagaggcacctgtgatatctctggctaaacagatacagttaagagctgtcsctggggcagatcatgttaagtaacatggctgagatttgccagggtccatgtaatgccttagggtgtcagcacgcaagaaaaaaaaagaagtgactttacgtctgggactgcagaggctacaaaatgatgaaccccctaacctatgagttgtcgatattggagaatacgatgcttttgagcccagctcagatggagatctgttccacacaggtgtgtgtcatgccagtttgcagcctgggcttcctctggtgactaccccatccatctctgccactgccccagctctctgtgcccaagtgc

SEQ ID NO: 180136 - DNA, 601 bp, Human
tccctgcttccgggacccgtattcatcacctcgccggggaagctttgtggctttgtggtcagggccctgtgaatcaagaatgctggttcctcacatcaggccgcccccaaccctgctggttcaccctggagtccttttcttttcaaacctctgtttcctcacctctaaaaatgggggtaaccaggctcacttgcctcacaggtgtgagagttaattaatgtttgtggggcagctttgagatccacagatgaaaggtgctctataaacgcaaaatgcaattcctcattagcactgtcagacrgttcccaggggaaacagttcaccctgcaccacgaggctgctaccctcagccagatgagtctgagacacgtctgggaaagggctacgtatttaggcagagtgcttttggagggagggttcaaggataggtcactagcttccagaaaagatgggtgtttttagaacatgtctcattctcagttggcatcgtgtccctgaggcagagggagagtggccttcagtgcacacagctggagggaccatagttcagagggaacagaaggcaccttctggtttctgctgcctcctcccttgcagacag

SEQ ID NO: 180137 - DNA, 601 bp, Human
gggagccctgtgtccgcctctccaccactccctgcttccgggacccgtattcatcacctcgccggggaagctttgtggctttgtggtcagggccctgtgaatcaagaatgctggttcctcacatcaggccgcccccaaccctgctggttcaccctggagtccttttcttttcaaacctctgtttcctcacctctaaaaatgggggtaaccaggctcacttgcctcacaggtgtgagagttaattaatgtttgtggggcagctttgagatccacagatgaaaggtgctctataaacgcaaartgcaattcctcattagcactgtcagacggttcccaggggaaacagttcaccctgcaccacgaggctgctaccctcagccagatgagtctgagacacgtctgggaaagggctacgtatttaggcagagtgcttttggagggagggttcaaggataggtcactagcttccagaaaagatgggtgtttttagaacatgtctcattctcagttggcatcgtgtccctgaggcagagggagagtggccttcagtgcacacagctggagggaccatagttcagagggaacagaaggcaccttctgg

SEQ ID NO: 180138 - DNA, 601 bp, Human
cactgacactttcttattctcacctccgaaggaggtgatccctaaatcctttccaatggtgacagagcaggattctaattccaataggtcctacacagtatttctttgctttacttgtacattaagcagagtcagggaagaatcagatgtggggtgaagagtggtgcctgtaataataaatttgtgtattctaggaagaggaagtagaggagagtacgatgggagttatccagaaaaggccccaggctgaggaagagaaccactgtaaatcattctccagagcacagggctacttgttctggaaagagttgcctctgataagtcaatccatctaaaagaacaaaagcttattgaacatttacagtgtgccaggaatgtgctaatttacctggcaggagagtgatgaataagaccaacatggtccctgccccacaggcacttacagtcagtgaagatcccaggatcttgtgatgcttggaaaggcatcttcctgtggcattaatcatcatactgggtgttgcttcattcatttattcattcatgtgttcatgaaattactttttcattcactcatatttccaacaaacatttttgcttcact

SEQ ID NO: 180139 - DNA, 601 bp, Human
atgttgatataatcctagggttggcaaactgcagcctgccagccaaatctggcatttttgcatgtcccaggaggtaagaatgcattttacattttttaaatggttgaaaaaaaaatccaaaaaagaatacttcctgacctgttaaaatgacaggaaattcaaacttcagtgtccatccatacttcggaacacatcctcactcattctttcatgtactgcctgtggttgctttagagccactactgtaaagtcaggtggtcagtatagggactgcaggagccacagagcaaatatttattcttttttttttttttggagacaaagtctcgctctgtcaccaaggctggagtgcagtggtgtgatctcggctcactgcacccaccacctcctgggctcaagcaattctactgcctcagcctcccgagtagctgggattacaggcgcccgccaccaggcctggccaatttttgtatttttagtggagatgagatttcaccacgttggctaggcaggtctcgaattcctgacctcaagtgatccacctgcctcagcctcccaaagtgctgggattacaggcatgaaccaccgtgcccagccctaa

SEQ ID NO: 180140 - DNA, 601 bp, Human
tcacagtttccctccgggaatcttcctgtttgctttccagcgcgtcccctgggtgctggggccggcggacaccctcgaggtgcgtcgcctcggacacctccgcgagggccggggcgccagcagacggcggcggcgtgggcttctgggcgcaggaggctgcgcgggcctgacctacagcgagatcctggccgtcgggcgccctcggccccaggacggtggccgggcccagggcccgggatcccggcgggcttgtcgcgaacaggaggcccgcgcgcccggaggcgaaggcggcggcccgcgkggcccagccgggccaggcctggcgcctcagtagggcctccacacggcctcctccaggcgcgcggagggcgccatgttggtgggggagttgctgtggctgccctcggcctccaccacgtcgctctggttcgggaggctggggttgagcagcgcggagccggtggaggcgttggtgcagggcggcaggatgcgcggcggcgagcgctcgccgcccaccatggagaactggtaggagccggccgaggcgccgtagtacaggtggtaggagggcgagctggcttggaacgggcctccctgcgct

SEQ ID NO: 180141 - DNA, 601 bp, Human
gtgcatctgccaagcctgtgccccgcgcctcgcgggtggacccgggctggtgggcggggcctgcagcggggtgggagcccggtcgcccggcccctccccaccccgccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccggraggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccacc

SEQ ID NO: 180142 - DNA, 601 bp, Human
atcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgttkgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcc

SEQ ID NO: 180143 - DNA, 601 bp, Human
tactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcakctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcact

SEQ ID NO: 180144 - DNA, 601 bp, Human
tgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcrgcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgt

SEQ ID NO: 180145 - DNA, 601 bp, Human
tccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattgrttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggc

SEQ ID NO: 180146 - DNA, 601 bp, Human
ttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttc

SEQ ID NO: 180147 - DNA, 601 bp, Human
tctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccagrttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttct

SEQ ID NO: 180148 - DNA, 601 bp, Human
gggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctrattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagc

SEQ ID NO: 180149 - DNA, 601 bp, Human
cagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtrcaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaa

SEQ ID NO: 180150 - DNA, 601 bp, Human
gggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatyctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagc

SEQ ID NO: 180151 - DNA, 601 bp, Human
tatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagytgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataac

SEQ ID NO: 180152 - DNA, 601 bp, Human
actcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatyggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagc

SEQ ID NO: 180153 - DNA, 601 bp, Human
ttcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaagkttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgt

SEQ ID NO: 180154 - DNA, 601 bp, Human
gagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgayacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacag

SEQ ID NO: 180155 - DNA, 601 bp, Human
tctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtragcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgc

SEQ ID NO: 180156 - DNA, 601 bp, Human
acaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctmctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaaggg

SEQ ID NO: 180157 - DNA, 601 bp, Human
agcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgygattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattg

SEQ ID NO: 180158 - DNA, 601 bp, Human
cacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcayctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttaga

SEQ ID NO: 180159 - DNA, 601 bp, Human
catgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacacccygctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctg

SEQ ID NO: 180160 - DNA, 601 bp, Human
cacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcggga

SEQ ID NO: 180161 - DNA, 601 bp, Human
cagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtaraggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgcc

SEQ ID NO: 180162 - DNA, 601 bp, Human
ctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggaycacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgagg

SEQ ID NO: 180163 - DNA, 601 bp, Human
atgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcaygcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaata

SEQ ID NO: 180164 - DNA, 601 bp, Human
tccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatccyaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaatac

SEQ ID NO: 180165 - DNA, 601 bp, Human
cctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgmgagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcc

SEQ ID NO: 180166 - DNA, 601 bp, Human
caaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccrctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctga

SEQ ID NO: 180167 - DNA, 601 bp, Human
gtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagawtcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcc

SEQ ID NO: 180168 - DNA, 601 bp, Human
acagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcraactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgc

SEQ ID NO: 180169 - DNA, 601 bp, Human
ggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccytgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataa

SEQ ID NO: 180170 - DNA, 601 bp, Human
agttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctrtgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaa

SEQ ID NO: 180171 - DNA, 601 bp, Human
aaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctkccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaagg

SEQ ID NO: 180172 - DNA, 601 bp, Human
gctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcayacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccg

SEQ ID NO: 180173 - DNA, 601 bp, Human; identical to SEQ ID NO: 90390

SEQ ID NO: 180174 - DNA, 601 bp, Human; identical to SEQ ID NO: 90391

SEQ ID NO: 180175 - DNA, 601 bp, Human; identical to SEQ ID NO: 90392

SEQ ID NO: 180176 - DNA, 601 bp, Human; identical to SEQ ID NO: 90393

SEQ ID NO: 180177 - DNA, 601 bp, Human; identical to SEQ ID NO: 90394

SEQ ID NO: 180178 - DNA, 601 bp, Human; identical to SEQ ID NO: 90395

SEQ ID NO: 180179 - DNA, 601 bp, Human; identical to SEQ ID NO: 90396

SEQ ID NO: 180180 - DNA, 601 bp, Human; identical to SEQ ID NO: 90397

SEQ ID NO: 180181 - DNA, 601 bp, Human; identical to SEQ ID NO: 90398

SEQ ID NO: 180182 - DNA, 601 bp, Human; identical to SEQ ID NO: 90399

SEQ ID NO: 180183 - DNA, 601 bp, Human; identical to SEQ ID NO: 90400

SEQ ID NO: 180184 - DNA, 601 bp, Human; identical to SEQ ID NO: 90401

SEQ ID NO: 180185 - DNA, 601 bp, Human; identical to SEQ ID NO: 90402

SEQ ID NO: 180186 - DNA, 601 bp, Human; identical to SEQ ID NO: 90403

SEQ ID NO: 180187 - DNA, 601 bp, Human; identical to SEQ ID NO: 90404

SEQ ID NO: 180188 - DNA, 601 bp, Human; identical to SEQ ID NO: 90405

SEQ ID NO: 180189 - DNA, 601 bp, Human; identical to SEQ ID NO: 90406

SEQ ID NO: 180190 - DNA, 601 bp, Human; identical to SEQ ID NO: 90407

SEQ ID NO: 180191 - DNA, 601 bp, Human; identical to SEQ ID NO: 90408

SEQ ID NO: 180192 - DNA, 601 bp, Human; identical to SEQ ID NO: 90409

SEQ ID NO: 180193 - DNA, 601 bp, Human; identical to SEQ ID NO: 90410

SEQ ID NO: 180194 - DNA, 601 bp, Human; identical to SEQ ID NO: 90411

SEQ ID NO: 180195 - DNA, 601 bp, Human; identical to SEQ ID NO: 90412

SEQ ID NO: 180196 - DNA, 601 bp, Human; identical to SEQ ID NO: 90413

SEQ ID NO: 180197 - DNA, 601 bp, Human; identical to SEQ ID NO: 90414

SEQ ID NO: 180198 - DNA, 601 bp, Human; identical to SEQ ID NO: 90415

SEQ ID NO: 180199 - DNA, 601 bp, Human; identical to SEQ ID NO: 90416

SEQ ID NO: 180200 - DNA, 601 bp, Human; identical to SEQ ID NO: 90417

SEQ ID NO: 180201 - DNA, 601 bp, Human; identical to SEQ ID NO: 90418

SEQ ID NO: 180202 - DNA, 601 bp, Human; identical to SEQ ID NO: 90419

SEQ ID NO: 180203 - DNA, 601 bp, Human; identical to SEQ ID NO: 90420

SEQ ID NO: 180204 - DNA, 601 bp, Human; identical to SEQ ID NO: 90421

SEQ ID NO: 180205 - DNA, 601 bp, Human; identical to SEQ ID NO: 90422

SEQ ID NO: 180206 - DNA, 601 bp, Human; identical to SEQ ID NO: 90423

SEQ ID NO: 180207 - DNA, 601 bp, Human; identical to SEQ ID NO: 90424

SEQ ID NO: 180208 - DNA, 601 bp, Human; identical to SEQ ID NO: 90425

SEQ ID NO: 180209 - DNA, 601 bp, Human; identical to SEQ ID NO: 90426

SEQ ID NO: 180210 - DNA, 601 bp, Human; identical to SEQ ID NO: 90427

SEQ ID NO: 180211 - DNA, 601 bp, Human; identical to SEQ ID NO: 90428

SEQ ID NO: 180212 - DNA, 601 bp, Human; identical to SEQ ID NO: 90429

SEQ ID NO: 180213 - DNA, 601 bp, Human; identical to SEQ ID NO: 90430

SEQ ID NO: 180214 - DNA, 601 bp, Human; identical to SEQ ID NO: 90431

SEQ ID NO: 180215 - DNA, 601 bp, Human; identical to SEQ ID NO: 90432

SEQ ID NO: 180216 - DNA, 601 bp, Human; identical to SEQ ID NO: 90433

SEQ ID NO: 180217 - DNA, 601 bp, Human; identical to SEQ ID NO: 90434

SEQ ID NO: 180218 - DNA, 601 bp, Human; identical to SEQ ID NO: 90435

SEQ ID NO: 180219 - DNA, 601 bp, Human; identical to SEQ ID NO: 90436

SEQ ID NO: 180220 - DNA, 601 bp, Human; identical to SEQ ID NO: 90437

SEQ ID NO: 180221 - DNA, 601 bp, Human; identical to SEQ ID NO: 90438

SEQ ID NO: 180222 - DNA, 601 bp, Human; identical to SEQ ID NO: 90439

SEQ ID NO: 180223 - DNA, 601 bp, Human; identical to SEQ ID NO: 90440

SEQ ID NO: 180224 - DNA, 601 bp, Human; identical to SEQ ID NO: 90441

SEQ ID NO: 180225 - DNA, 601 bp, Human; identical to SEQ ID NO: 90442

SEQ ID NO: 180226 - DNA, 601 bp, Human; identical to SEQ ID NO: 90443

SEQ ID NO: 180227 - DNA, 601 bp, Human; identical to SEQ ID NO: 90444

SEQ ID NO: 180228 - DNA, 601 bp, Human; identical to SEQ ID NO: 90445

SEQ ID NO: 180229 - DNA, 601 bp, Human; identical to SEQ ID NO: 90446

SEQ ID NO: 180230 - DNA, 601 bp, Human; identical to SEQ ID NO: 90447

SEQ ID NO: 180231 - DNA, 601 bp, Human; identical to SEQ ID NO: 90448

SEQ ID NO: 180232 - DNA, 601 bp, Human; identical to SEQ ID NO: 90449

SEQ ID NO: 180233 - DNA, 601 bp, Human; identical to SEQ ID NO: 90450

SEQ ID NO: 180234 - DNA, 601 bp, Human; identical to SEQ ID NO: 90451

SEQ ID NO: 180235 - DNA, 601 bp, Human; identical to SEQ ID NO: 90452

SEQ ID NO: 180236 - DNA, 601 bp, Human; identical to SEQ ID NO: 90453

SEQ ID NO: 180237 - DNA, 601 bp, Human; identical to SEQ ID NO: 90454

SEQ ID NO: 180238 - DNA, 601 bp, Human; identical to SEQ ID NO: 90455

SEQ ID NO: 180239 - DNA, 601 bp, Human; identical to SEQ ID NO: 90456

SEQ ID NO: 180240 - DNA, 601 bp, Human; identical to SEQ ID NO: 90457

SEQ ID NO: 180241 - DNA, 601 bp, Human; identical to SEQ ID NO: 90458

SEQ ID NO: 180242 - DNA, 601 bp, Human; identical to SEQ ID NO: 90459

SEQ ID NO: 180243 - DNA, 601 bp, Human; identical to SEQ ID NO: 90460

SEQ ID NO: 180244 - DNA, 601 bp, Human; identical to SEQ ID NO: 90461

SEQ ID NO: 180245 - DNA, 601 bp, Human; identical to SEQ ID NO: 90462

SEQ ID NO: 180246 - DNA, 601 bp, Human; identical to SEQ ID NO: 90463

SEQ ID NO: 180247 - DNA, 601 bp, Human; identical to SEQ ID NO: 90464

SEQ ID NO: 180248 - DNA, 601 bp, Human; identical to SEQ ID NO: 90465

SEQ ID NO: 180249 - DNA, 601 bp, Human; identical to SEQ ID NO: 90466

SEQ ID NO: 180250 - DNA, 601 bp, Human; identical to SEQ ID NO: 90467

SEQ ID NO: 180251 - DNA, 601 bp, Human; identical to SEQ ID NO: 90468

SEQ ID NO: 180252 - DNA, 601 bp, Human; identical to SEQ ID NO: 90469

SEQ ID NO: 180253 - DNA, 601 bp, Human; identical to SEQ ID NO: 90470

SEQ ID NO: 180254 - DNA, 601 bp, Human; identical to SEQ ID NO: 90471

SEQ ID NO: 180255 - DNA, 601 bp, Human; identical to SEQ ID NO: 90472

SEQ ID NO: 180256 - DNA, 601 bp, Human; identical to SEQ ID NO: 90473

SEQ ID NO: 180257 - DNA, 601 bp, Human; identical to SEQ ID NO: 90474

SEQ ID NO: 180258 - DNA, 601 bp, Human; identical to SEQ ID NO: 90475

SEQ ID NO: 180259 - DNA, 601 bp, Human; identical to SEQ ID NO: 90476

SEQ ID NO: 180260 - DNA, 601 bp, Human; identical to SEQ ID NO: 90477

SEQ ID NO: 180261 - DNA, 601 bp, Human; identical to SEQ ID NO: 90390

SEQ ID NO: 180262 - DNA, 601 bp, Human; identical to SEQ ID NO: 90391

SEQ ID NO: 180263 - DNA, 601 bp, Human; identical to SEQ ID NO: 90392

SEQ ID NO: 180264 - DNA, 601 bp, Human; identical to SEQ ID NO: 90393

SEQ ID NO: 180265 - DNA, 601 bp, Human; identical to SEQ ID NO: 90394

SEQ ID NO: 180266 - DNA, 601 bp, Human; identical to SEQ ID NO: 90395

SEQ ID NO: 180267 - DNA, 601 bp, Human; identical to SEQ ID NO: 90396

SEQ ID NO: 180268 - DNA, 601 bp, Human; identical to SEQ ID NO: 90397

SEQ ID NO: 180269 - DNA, 601 bp, Human; identical to SEQ ID NO: 90398

SEQ ID NO: 180270 - DNA, 601 bp, Human; identical to SEQ ID NO: 90399

SEQ ID NO: 180271 - DNA, 601 bp, Human; identical to SEQ ID NO: 90400

SEQ ID NO: 180272 - DNA, 601 bp, Human; identical to SEQ ID NO: 90401

SEQ ID NO: 180273 - DNA, 601 bp, Human; identical to SEQ ID NO: 90402

SEQ ID NO: 180274 - DNA, 601 bp, Human; identical to SEQ ID NO: 90403

SEQ ID NO: 180275 - DNA, 601 bp, Human; identical to SEQ ID NO: 90404

SEQ ID NO: 180276 - DNA, 601 bp, Human; identical to SEQ ID NO: 90405

SEQ ID NO: 180277 - DNA, 601 bp, Human; identical to SEQ ID NO: 90406

SEQ ID NO: 180278 - DNA, 601 bp, Human; identical to SEQ ID NO: 90407

SEQ ID NO: 180279 - DNA, 601 bp, Human; identical to SEQ ID NO: 90408

SEQ ID NO: 180280 - DNA, 601 bp, Human; identical to SEQ ID NO: 90409

SEQ ID NO: 180281 - DNA, 601 bp, Human; identical to SEQ ID NO: 90410

SEQ ID NO: 180282 - DNA, 601 bp, Human; identical to SEQ ID NO: 90411

SEQ ID NO: 180283 - DNA, 601 bp, Human; identical to SEQ ID NO: 90412

SEQ ID NO: 180284 - DNA, 601 bp, Human; identical to SEQ ID NO: 90413

SEQ ID NO: 180285 - DNA, 601 bp, Human; identical to SEQ ID NO: 90414

SEQ ID NO: 180286 - DNA, 601 bp, Human; identical to SEQ ID NO: 90415

SEQ ID NO: 180287 - DNA, 601 bp, Human; identical to SEQ ID NO: 90416

SEQ ID NO: 180288 - DNA, 601 bp, Human; identical to SEQ ID NO: 90417

SEQ ID NO: 180289 - DNA, 601 bp, Human; identical to SEQ ID NO: 90418

SEQ ID NO: 180290 - DNA, 601 bp, Human; identical to SEQ ID NO: 90419

SEQ ID NO: 180291 - DNA, 601 bp, Human; identical to SEQ ID NO: 90420

SEQ ID NO: 180292 - DNA, 601 bp, Human; identical to SEQ ID NO: 90421

SEQ ID NO: 180293 - DNA, 601 bp, Human; identical to SEQ ID NO: 90422

SEQ ID NO: 180294 - DNA, 601 bp, Human; identical to SEQ ID NO: 90423

SEQ ID NO: 180295 - DNA, 601 bp, Human; identical to SEQ ID NO: 90424

SEQ ID NO: 180296 - DNA, 601 bp, Human; identical to SEQ ID NO: 90425

SEQ ID NO: 180297 - DNA, 601 bp, Human; identical to SEQ ID NO: 90426

SEQ ID NO: 180298 - DNA, 601 bp, Human; identical to SEQ ID NO: 90427

SEQ ID NO: 180299 - DNA, 601 bp, Human; identical to SEQ ID NO: 90428

SEQ ID NO: 180300 - DNA, 601 bp, Human; identical to SEQ ID NO: 90429

SEQ ID NO: 180301 - DNA, 601 bp, Human; identical to SEQ ID NO: 90430

SEQ ID NO: 180302 - DNA, 601 bp, Human; identical to SEQ ID NO: 90431

SEQ ID NO: 180303 - DNA, 601 bp, Human; identical to SEQ ID NO: 90432

SEQ ID NO: 180304 - DNA, 601 bp, Human; identical to SEQ ID NO: 90433

SEQ ID NO: 180305 - DNA, 601 bp, Human; identical to SEQ ID NO: 90434

SEQ ID NO: 180306 - DNA, 601 bp, Human; identical to SEQ ID NO: 90435

SEQ ID NO: 180307 - DNA, 601 bp, Human; identical to SEQ ID NO: 90436

SEQ ID NO: 180308 - DNA, 601 bp, Human; identical to SEQ ID NO: 90437

SEQ ID NO: 180309 - DNA, 601 bp, Human; identical to SEQ ID NO: 90438

SEQ ID NO: 180310 - DNA, 601 bp, Human; identical to SEQ ID NO: 90439

SEQ ID NO: 180311 - DNA, 601 bp, Human; identical to SEQ ID NO: 90440

SEQ ID NO: 180312 - DNA, 601 bp, Human; identical to SEQ ID NO: 90441

SEQ ID NO: 180313 - DNA, 601 bp, Human; identical to SEQ ID NO: 90442

SEQ ID NO: 180314 - DNA, 601 bp, Human; identical to SEQ ID NO: 90443

SEQ ID NO: 180315 - DNA, 601 bp, Human; identical to SEQ ID NO: 90444

SEQ ID NO: 180316 - DNA, 601 bp, Human; identical to SEQ ID NO: 90445

SEQ ID NO: 180317 - DNA, 601 bp, Human; identical to SEQ ID NO: 90446

SEQ ID NO: 180318 - DNA, 601 bp, Human; identical to SEQ ID NO: 90447

SEQ ID NO: 180319 - DNA, 601 bp, Human; identical to SEQ ID NO: 90448

SEQ ID NO: 180320 - DNA, 601 bp, Human; identical to SEQ ID NO: 90449

SEQ ID NO: 180321 - DNA, 601 bp, Human; identical to SEQ ID NO: 90450

SEQ ID NO: 180322 - DNA, 601 bp, Human; identical to SEQ ID NO: 90451

SEQ ID NO: 180323 - DNA, 601 bp, Human; identical to SEQ ID NO: 90452

SEQ ID NO: 180324 - DNA, 601 bp, Human; identical to SEQ ID NO: 90453

SEQ ID NO: 180325 - DNA, 601 bp, Human; identical to SEQ ID NO: 90454

SEQ ID NO: 180326 - DNA, 601 bp, Human; identical to SEQ ID NO: 90455

SEQ ID NO: 180327 - DNA, 601 bp, Human; identical to SEQ ID NO: 90456

SEQ ID NO: 180328 - DNA, 601 bp, Human; identical to SEQ ID NO: 90457

SEQ ID NO: 180329 - DNA, 601 bp, Human; identical to SEQ ID NO: 90458

SEQ ID NO: 180330 - DNA, 601 bp, Human; identical to SEQ ID NO: 90459

SEQ ID NO: 180331 - DNA, 601 bp, Human; identical to SEQ ID NO: 90460

SEQ ID NO: 180332 - DNA, 601 bp, Human; identical to SEQ ID NO: 90461

SEQ ID NO: 180333 - DNA, 601 bp, Human; identical to SEQ ID NO: 90462

SEQ ID NO: 180334 - DNA, 601 bp, Human; identical to SEQ ID NO: 90463

SEQ ID NO: 180335 - DNA, 601 bp, Human; identical to SEQ ID NO: 90464

SEQ ID NO: 180336 - DNA, 601 bp, Human; identical to SEQ ID NO: 90465

SEQ ID NO: 180337 - DNA, 601 bp, Human; identical to SEQ ID NO: 90466

SEQ ID NO: 180338 - DNA, 601 bp, Human; identical to SEQ ID NO: 90467

SEQ ID NO: 180339 - DNA, 601 bp, Human; identical to SEQ ID NO: 90468

SEQ ID NO: 180340 - DNA, 601 bp, Human; identical to SEQ ID NO: 90469

SEQ ID NO: 180341 - DNA, 601 bp, Human; identical to SEQ ID NO: 90470

SEQ ID NO: 180342 - DNA, 601 bp, Human; identical to SEQ ID NO: 90471

SEQ ID NO: 180343 - DNA, 601 bp, Human; identical to SEQ ID NO: 90472

SEQ ID NO: 180344 - DNA, 601 bp, Human; identical to SEQ ID NO: 90473

SEQ ID NO: 180345 - DNA, 601 bp, Human; identical to SEQ ID NO: 90474

SEQ ID NO: 180346 - DNA, 601 bp, Human; identical to SEQ ID NO: 90475

SEQ ID NO: 180347 - DNA, 601 bp, Human; identical to SEQ ID NO: 90476

SEQ ID NO: 180348 - DNA, 601 bp, Human; identical to SEQ ID NO: 90477

SEQ ID NO: 180349 - DNA, 601 bp, Human; identical to SEQ ID NO: 90390

SEQ ID NO: 180350 - DNA, 601 bp, Human; identical to SEQ ID NO: 90391

SEQ ID NO: 180351 - DNA, 601 bp, Human; identical to SEQ ID NO: 90392

SEQ ID NO: 180352 - DNA, 601 bp, Human; identical to SEQ ID NO: 90393

SEQ ID NO: 180353 - DNA, 601 bp, Human; identical to SEQ ID NO: 90394

SEQ ID NO: 180354 - DNA, 601 bp, Human; identical to SEQ ID NO: 90395

SEQ ID NO: 180355 - DNA, 601 bp, Human; identical to SEQ ID NO: 90396

SEQ ID NO: 180356 - DNA, 601 bp, Human; identical to SEQ ID NO: 90397

SEQ ID NO: 180357 - DNA, 601 bp, Human; identical to SEQ ID NO: 90398

SEQ ID NO: 180358 - DNA, 601 bp, Human; identical to SEQ ID NO: 90399

SEQ ID NO: 180359 - DNA, 601 bp, Human; identical to SEQ ID NO: 90400

SEQ ID NO: 180360 - DNA, 601 bp, Human; identical to SEQ ID NO: 90401

SEQ ID NO: 180361 - DNA, 601 bp, Human; identical to SEQ ID NO: 90402

SEQ ID NO: 180362 - DNA, 601 bp, Human; identical to SEQ ID NO: 90403

SEQ ID NO: 180363 - DNA, 601 bp, Human; identical to SEQ ID NO: 90404

SEQ ID NO: 180364 - DNA, 601 bp, Human; identical to SEQ ID NO: 90405

SEQ ID NO: 180365 - DNA, 601 bp, Human; identical to SEQ ID NO: 90406

SEQ ID NO: 180366 - DNA, 601 bp, Human; identical to SEQ ID NO: 90407

SEQ ID NO: 180367 - DNA, 601 bp, Human; identical to SEQ ID NO: 90408

SEQ ID NO: 180368 - DNA, 601 bp, Human; identical to SEQ ID NO: 90409

SEQ ID NO: 180369 - DNA, 601 bp, Human; identical to SEQ ID NO: 90410

SEQ ID NO: 180370 - DNA, 601 bp, Human; identical to SEQ ID NO: 90411

SEQ ID NO: 180371 - DNA, 601 bp, Human; identical to SEQ ID NO: 90412

SEQ ID NO: 180372 - DNA, 601 bp, Human; identical to SEQ ID NO: 90413

SEQ ID NO: 180373 - DNA, 601 bp, Human; identical to SEQ ID NO: 90414

SEQ ID NO: 180374 - DNA, 601 bp, Human; identical to SEQ ID NO: 90415

SEQ ID NO: 180375 - DNA, 601 bp, Human; identical to SEQ ID NO: 90416

SEQ ID NO: 180376 - DNA, 601 bp, Human; identical to SEQ ID NO: 90417

SEQ ID NO: 180377 - DNA, 601 bp, Human; identical to SEQ ID NO: 90418

SEQ ID NO: 180378 - DNA, 601 bp, Human; identical to SEQ ID NO: 90419

SEQ ID NO: 180379 - DNA, 601 bp, Human; identical to SEQ ID NO: 90420

SEQ ID NO: 180380 - DNA, 601 bp, Human; identical to SEQ ID NO: 90421

SEQ ID NO: 180381 - DNA, 601 bp, Human; identical to SEQ ID NO: 90422

SEQ ID NO: 180382 - DNA, 601 bp, Human; identical to SEQ ID NO: 90423

SEQ ID NO: 180383 - DNA, 601 bp, Human; identical to SEQ ID NO: 90424

SEQ ID NO: 180384 - DNA, 601 bp, Human; identical to SEQ ID NO: 90425

SEQ ID NO: 180385 - DNA, 601 bp, Human; identical to SEQ ID NO: 90426

SEQ ID NO: 180386 - DNA, 601 bp, Human; identical to SEQ ID NO: 90427

SEQ ID NO: 180387 - DNA, 601 bp, Human; identical to SEQ ID NO: 90428

SEQ ID NO: 180388 - DNA, 601 bp, Human; identical to SEQ ID NO: 90429

SEQ ID NO: 180389 - DNA, 601 bp, Human; identical to SEQ ID NO: 90430

SEQ ID NO: 180390 - DNA, 601 bp, Human; identical to SEQ ID NO: 90431

SEQ ID NO: 180391 - DNA, 601 bp, Human; identical to SEQ ID NO: 90432

SEQ ID NO: 180392 - DNA, 601 bp, Human; identical to SEQ ID NO: 90433

SEQ ID NO: 180393 - DNA, 601 bp, Human; identical to SEQ ID NO: 90434

SEQ ID NO: 180394 - DNA, 601 bp, Human; identical to SEQ ID NO: 90435

SEQ ID NO: 180395 - DNA, 601 bp, Human; identical to SEQ ID NO: 90436

SEQ ID NO: 180396 - DNA, 601 bp, Human; identical to SEQ ID NO: 90437

SEQ ID NO: 180397 - DNA, 601 bp, Human; identical to SEQ ID NO: 90438

SEQ ID NO: 180398 - DNA, 601 bp, Human; identical to SEQ ID NO: 90439

SEQ ID NO: 180399 - DNA, 601 bp, Human; identical to SEQ ID NO: 90440

SEQ ID NO: 180400 - DNA, 601 bp, Human; identical to SEQ ID NO: 90441

SEQ ID NO: 180401 - DNA, 601 bp, Human; identical to SEQ ID NO: 90442

SEQ ID NO: 180402 - DNA, 601 bp, Human; identical to SEQ ID NO: 90443

SEQ ID NO: 180403 - DNA, 601 bp, Human; identical to SEQ ID NO: 90444

SEQ ID NO: 180404 - DNA, 601 bp, Human; identical to SEQ ID NO: 90445

SEQ ID NO: 180405 - DNA, 601 bp, Human; identical to SEQ ID NO: 90446

SEQ ID NO: 180406 - DNA, 601 bp, Human; identical to SEQ ID NO: 90447

SEQ ID NO: 180407 - DNA, 601 bp, Human; identical to SEQ ID NO: 90448

SEQ ID NO: 180408 - DNA, 601 bp, Human; identical to SEQ ID NO: 90449

SEQ ID NO: 180409 - DNA, 601 bp, Human; identical to SEQ ID NO: 90450

SEQ ID NO: 180410 - DNA, 601 bp, Human; identical to SEQ ID NO: 90451

SEQ ID NO: 180411 - DNA, 601 bp, Human; identical to SEQ ID NO: 90452

SEQ ID NO: 180412 - DNA, 601 bp, Human; identical to SEQ ID NO: 90453

SEQ ID NO: 180413 - DNA, 601 bp, Human; identical to SEQ ID NO: 90454

SEQ ID NO: 180414 - DNA, 601 bp, Human; identical to SEQ ID NO: 90455

SEQ ID NO: 180415 - DNA, 601 bp, Human; identical to SEQ ID NO: 90456

SEQ ID NO: 180416 - DNA, 601 bp, Human; identical to SEQ ID NO: 90457

SEQ ID NO: 180417 - DNA, 601 bp, Human; identical to SEQ ID NO: 90458

SEQ ID NO: 180418 - DNA, 601 bp, Human; identical to SEQ ID NO: 90459

SEQ ID NO: 180419 - DNA, 601 bp, Human; identical to SEQ ID NO: 90460

SEQ ID NO: 180420 - DNA, 601 bp, Human; identical to SEQ ID NO: 90461

SEQ ID NO: 180421 - DNA, 601 bp, Human; identical to SEQ ID NO: 90462

SEQ ID NO: 180422 - DNA, 601 bp, Human; identical to SEQ ID NO: 90463

SEQ ID NO: 180423 - DNA, 601 bp, Human; identical to SEQ ID NO: 90464

SEQ ID NO: 180424 - DNA, 601 bp, Human; identical to SEQ ID NO: 90465

SEQ ID NO: 180425 - DNA, 601 bp, Human; identical to SEQ ID NO: 90466

SEQ ID NO: 180426 - DNA, 601 bp, Human; identical to SEQ ID NO: 90467

SEQ ID NO: 180427 - DNA, 601 bp, Human; identical to SEQ ID NO: 90468

SEQ ID NO: 180428 - DNA, 601 bp, Human; identical to SEQ ID NO: 90469

SEQ ID NO: 180429 - DNA, 601 bp, Human; identical to SEQ ID NO: 90470

SEQ ID NO: 180430 - DNA, 601 bp, Human; identical to SEQ ID NO: 90471

SEQ ID NO: 180431 - DNA, 601 bp, Human; identical to SEQ ID NO: 90472

SEQ ID NO: 180432 - DNA, 601 bp, Human; identical to SEQ ID NO: 90473

SEQ ID NO: 180433 - DNA, 601 bp, Human; identical to SEQ ID NO: 90474

SEQ ID NO: 180434 - DNA, 601 bp, Human; identical to SEQ ID NO: 90475

SEQ ID NO: 180435 - DNA, 601 bp, Human; identical to SEQ ID NO: 90476

SEQ ID NO: 180436 - DNA, 601 bp, Human; identical to SEQ ID NO: 90477

SEQ ID NO: 180437 - DNA, 601 bp, Human; identical to SEQ ID NO: 90390

SEQ ID NO: 180438 - DNA, 601 bp, Human; identical to SEQ ID NO: 90391

SEQ ID NO: 180439 - DNA, 601 bp, Human; identical to SEQ ID NO: 90392

SEQ ID NO: 180440 - DNA, 601 bp, Human; identical to SEQ ID NO: 90393

SEQ ID NO: 180441 - DNA, 601 bp, Human; identical to SEQ ID NO: 90394

SEQ ID NO: 180442 - DNA, 601 bp, Human; identical to SEQ ID NO: 90395

SEQ ID NO: 180443 - DNA, 601 bp, Human; identical to SEQ ID NO: 90396

SEQ ID NO: 180444 - DNA, 601 bp, Human; identical to SEQ ID NO: 90397

SEQ ID NO: 180445 - DNA, 601 bp, Human; identical to SEQ ID NO: 90398

SEQ ID NO: 180446 - DNA, 601 bp, Human; identical to SEQ ID NO: 90399

SEQ ID NO: 180447 - DNA, 601 bp, Human; identical to SEQ ID NO: 90400

SEQ ID NO: 180448 - DNA, 601 bp, Human; identical to SEQ ID NO: 90401

SEQ ID NO: 180449 - DNA, 601 bp, Human; identical to SEQ ID NO: 90402

SEQ ID NO: 180450 - DNA, 601 bp, Human; identical to SEQ ID NO: 90403

SEQ ID NO: 180451 - DNA, 601 bp, Human; identical to SEQ ID NO: 90404

SEQ ID NO: 180452 - DNA, 601 bp, Human; identical to SEQ ID NO: 90405

SEQ ID NO: 180453 - DNA, 601 bp, Human; identical to SEQ ID NO: 90406

SEQ ID NO: 180454 - DNA, 601 bp, Human; identical to SEQ ID NO: 90407

SEQ ID NO: 180455 - DNA, 601 bp, Human; identical to SEQ ID NO: 90408

SEQ ID NO: 180456 - DNA, 601 bp, Human; identical to SEQ ID NO: 90409

SEQ ID NO: 180457 - DNA, 601 bp, Human; identical to SEQ ID NO: 90410

SEQ ID NO: 180458 - DNA, 601 bp, Human; identical to SEQ ID NO: 90411

SEQ ID NO: 180459 - DNA, 601 bp, Human; identical to SEQ ID NO: 90412

SEQ ID NO: 180460 - DNA, 601 bp, Human; identical to SEQ ID NO: 90413

SEQ ID NO: 180461 - DNA, 601 bp, Human; identical to SEQ ID NO: 90414

SEQ ID NO: 180462 - DNA, 601 bp, Human; identical to SEQ ID NO: 90415

SEQ ID NO: 180463 - DNA, 601 bp, Human; identical to SEQ ID NO: 90416

SEQ ID NO: 180464 - DNA, 601 bp, Human; identical to SEQ ID NO: 90417

SEQ ID NO: 180465 - DNA, 601 bp, Human; identical to SEQ ID NO: 90418

SEQ ID NO: 180466 - DNA, 601 bp, Human; identical to SEQ ID NO: 90419

SEQ ID NO: 180467 - DNA, 601 bp, Human; identical to SEQ ID NO: 90420

SEQ ID NO: 180468 - DNA, 601 bp, Human; identical to SEQ ID NO: 90421

SEQ ID NO: 180469 - DNA, 601 bp, Human; identical to SEQ ID NO: 90422

SEQ ID NO: 180470 - DNA, 601 bp, Human; identical to SEQ ID NO: 90423

SEQ ID NO: 180471 - DNA, 601 bp, Human; identical to SEQ ID NO: 90424

SEQ ID NO: 180472 - DNA, 601 bp, Human; identical to SEQ ID NO: 90425

SEQ ID NO: 180473 - DNA, 601 bp, Human; identical to SEQ ID NO: 90426

SEQ ID NO: 180474 - DNA, 601 bp, Human; identical to SEQ ID NO: 90427

SEQ ID NO: 180475 - DNA, 601 bp, Human; identical to SEQ ID NO: 90428

SEQ ID NO: 180476 - DNA, 601 bp, Human; identical to SEQ ID NO: 90429

SEQ ID NO: 180477 - DNA, 601 bp, Human; identical to SEQ ID NO: 90430

SEQ ID NO: 180478 - DNA, 601 bp, Human; identical to SEQ ID NO: 90431

SEQ ID NO: 180479 - DNA, 601 bp, Human; identical to SEQ ID NO: 90432

SEQ ID NO: 180480 - DNA, 601 bp, Human; identical to SEQ ID NO: 90433

SEQ ID NO: 180481 - DNA, 601 bp, Human; identical to SEQ ID NO: 90434

SEQ ID NO: 180482 - DNA, 601 bp, Human; identical to SEQ ID NO: 90435

SEQ ID NO: 180483 - DNA, 601 bp, Human; identical to SEQ ID NO: 90436

SEQ ID NO: 180484 - DNA, 601 bp, Human; identical to SEQ ID NO: 90437

SEQ ID NO: 180485 - DNA, 601 bp, Human; identical to SEQ ID NO: 90438

SEQ ID NO: 180486 - DNA, 601 bp, Human; identical to SEQ ID NO: 90439

SEQ ID NO: 180487 - DNA, 601 bp, Human; identical to SEQ ID NO: 90440

SEQ ID NO: 180488 - DNA, 601 bp, Human; identical to SEQ ID NO: 90441

SEQ ID NO: 180489 - DNA, 601 bp, Human; identical to SEQ ID NO: 90442

SEQ ID NO: 180490 - DNA, 601 bp, Human; identical to SEQ ID NO: 90443

SEQ ID NO: 180491 - DNA, 601 bp, Human; identical to SEQ ID NO: 90444

SEQ ID NO: 180492 - DNA, 601 bp, Human; identical to SEQ ID NO: 90445

SEQ ID NO: 180493 - DNA, 601 bp, Human; identical to SEQ ID NO: 90446

SEQ ID NO: 180494 - DNA, 601 bp, Human; identical to SEQ ID NO: 90447

SEQ ID NO: 180495 - DNA, 601 bp, Human; identical to SEQ ID NO: 90448

SEQ ID NO: 180496 - DNA, 601 bp, Human; identical to SEQ ID NO: 90449

SEQ ID NO: 180497 - DNA, 601 bp, Human; identical to SEQ ID NO: 90450

SEQ ID NO: 180498 - DNA, 601 bp, Human; identical to SEQ ID NO: 90451

SEQ ID NO: 180499 - DNA, 601 bp, Human; identical to SEQ ID NO: 90452

SEQ ID NO: 180500 - DNA, 601 bp, Human; identical to SEQ ID NO: 90453

SEQ ID NO: 180501 - DNA, 601 bp, Human; identical to SEQ ID NO: 90454

SEQ ID NO: 180502 - DNA, 601 bp, Human; identical to SEQ ID NO: 90455

SEQ ID NO: 180503 - DNA, 601 bp, Human; identical to SEQ ID NO: 90456

SEQ ID NO: 180504 - DNA, 601 bp, Human; identical to SEQ ID NO: 90457

SEQ ID NO: 180505 - DNA, 601 bp, Human; identical to SEQ ID NO: 90458

SEQ ID NO: 180506 - DNA, 601 bp, Human; identical to SEQ ID NO: 90459

SEQ ID NO: 180507 - DNA, 601 bp, Human; identical to SEQ ID NO: 90460

SEQ ID NO: 180508 - DNA, 601 bp, Human; identical to SEQ ID NO: 90461

SEQ ID NO: 180509 - DNA, 601 bp, Human; identical to SEQ ID NO: 90462

SEQ ID NO: 180510 - DNA, 601 bp, Human; identical to SEQ ID NO: 90463

SEQ ID NO: 180511 - DNA, 601 bp, Human; identical to SEQ ID NO: 90464

SEQ ID NO: 180512 - DNA, 601 bp, Human; identical to SEQ ID NO: 90465

SEQ ID NO: 180513 - DNA, 601 bp, Human; identical to SEQ ID NO: 90466

SEQ ID NO: 180514 - DNA, 601 bp, Human; identical to SEQ ID NO: 90467

SEQ ID NO: 180515 - DNA, 601 bp, Human; identical to SEQ ID NO: 90468

SEQ ID NO: 180516 - DNA, 601 bp, Human; identical to SEQ ID NO: 90469

SEQ ID NO: 180517 - DNA, 601 bp, Human; identical to SEQ ID NO: 90470

SEQ ID NO: 180518 - DNA, 601 bp, Human; identical to SEQ ID NO: 90471

SEQ ID NO: 180519 - DNA, 601 bp, Human; identical to SEQ ID NO: 90472

SEQ ID NO: 180520 - DNA, 601 bp, Human; identical to SEQ ID NO: 90473

SEQ ID NO: 180521 - DNA, 601 bp, Human; identical to SEQ ID NO: 90474

SEQ ID NO: 180522 - DNA, 601 bp, Human; identical to SEQ ID NO: 90475

SEQ ID NO: 180523 - DNA, 601 bp, Human; identical to SEQ ID NO: 90476

SEQ ID NO: 180524 - DNA, 601 bp, Human; identical to SEQ ID NO: 90477

SEQ ID NO: 180525 - DNA, 601 bp, Human; identical to SEQ ID NO: 90458

SEQ ID NO: 180526 - DNA, 601 bp, Human
cggctggggggacggcaggcggggccgataaatacgaatggccacccgggaagagtcacgactcggggcaccgacccgactggggctcctcgggggtcccgggcagtcgactgcccgggaaagcggctccttctcggagagacggaagagccgagcagcccaaaccctccatttatgcgccagaagagataccccggcgcccaggcggattcggttcgttcccgcgggcgggctgacagccgctgtcaccacagcccccagcctgacgcggcaccccgcacaaccagtggtctgctcacaaccccgcccgtcctcccgcaccccggctgctcgcggtcgcccctcaccgctcccgctgacgctgcggaggcagagactggtcttggaggcgtccgcccgcccggctgcccgtgggtctggccgcagcagctccccgccccccgccggcttgctcacctcttcctccggctcctcctcctccttctcccgcagccgccgccacagccgccgggagcgtcacttccgctccagcaggcccatctcttccgcattgcgccgcggccgggggcggaagatccgccccgcgcgagggaaggggcgg

SEQ ID NO: 180527 - DNA, 601 bp, Human
ttttagcactgtaagtcaatcaacggtctggttgagtttcccgtttaatttatgcttactgaaaggaaaaattttgagcgtatttcgtccggagctgtttatcagcttcctgcttcaagatctgtcactacgttgaaagggaacctatttggaaacttcaagcagttccttcgaggtgaaaggagcggaggtgggagggaagggtgacaaggctggttcaaagctccttagggggcaggagaaggaaaaggattatcccacgcgacaggctctcccgggggtggcgatgaagggcaagggraaaggcacaggttaccgccgcctctcctgccccgggctaccgccggctggggggacggcaggcggggccgataaatacgaatggccacccgggaagagtcacgactcggggcaccgacccgactggggctcctcgggggtcccgggcagtcgactgcccgggaaagcggctccttctcggagagacggaagagccgagcagcccaaaccctccatttatgcgccagaagagataccccggcgcccaggcggattcggttcgttcccgcgggcgggctgacagccgctgtcaccacagccc

SEQ ID NO: 180528 - DNA, 601 bp, Human
tatgtaccaaatatatatttcttatatactgttctttgcttaagacttttcattatgtcactatctttttccccatcaagatgcaattatactatttagtcaagttaacactttaactgacattaatattctacatgcaaagagtgaggtcttatgctcttcatttattgaggctggagaaagcttagtagtttaagatatttaagggcttatatttgtaagtatgcctttcaaacactatttttaatttataaagatataatcagtaactaaactaatcccaacactaggattatttgcytaaatcatatatatgtgtatatataatcatatacttttttttctttttaatttttgaaacagggtctcactgtgttgcccaagctggagcgcagtggcgagatcaaggctcactgcagtctcgaccttccagactcaatcaatccgcccacctcagcctcccaagtagcggggactaaagggcacacgacggagccgaactactttttgtattttttgtacagaaagggtttcaccacgctgcccagactggtctcaaactccccgcctcaagcgatcagccccccttggcctcccaaag

SEQ ID NO: 180529 - DNA, 601 bp, Human
caaggcgtggtggcacacacctataattccagctacttgggaggccgaggcaggagaaccacttgaacccaggaggtggaggttgcagtgagccgagatcatgccactgcactccagcctgggcaacagagtgagaccctgtctcaaaaaacaaacaagcaaacaaacaaagaaaaaacatgattttagaagattcttcaggtagatgaatatgcagaatgcactgaaattcagggagctgggattattgaagatgaagagaacacattgatattttccaagcacagcttctgaatacaayaggcatttttaaagtgtgaagattttaagtgaacactgtacagcacaatacaaaccttggtatcactccaaaatgaaggccaaattaattttaaaagtcaaatgacttaagaaggtttgttagctgcttaaatattaatatgttaagtattactgtaaagcttatagtaggaaagataatgacattccaagagattagacatccatttatgttagctttacagaaagagtcaatattccaacattttttttctgaattgctcacatagtctaaatctaatgaaaatagaatagcttagac

SEQ ID NO: 180530 - DNA, 601 bp, Human
atagtattatgacttatattgagtattatatatagtattatgacttatgttgtaagaaaaaattaggtagacaaagaatctcataaggacaacttggaggaaaaccaggtgcagtgatatggccttgctatttataaaatgcatgatttgagtcctaatctgactcaaattatgctacttgaaaagcctgaaagtaatcttaccactagacagataaaagcaattcatccttactcccatgctagcatgtaatatggaaaagagcaaaagctttaattttaagagttaggaatccatggcrccacctcacctccccatcttttacgtagaggtccataacttctgtttttagagttatcctccatttcccatatgttgaccttttctttactccatcttctatttaggatataattatgaaatgaatcattcactttattgaagcctgagatgggctgtaaaatattgagattgtgaatttaatgcatgtatgtcagactgacagcttgtccttctcctgtgacagtctttgtgtatgtgtgtgtaaactggagaaagactaagaacaatgaattgtacacaaagctgagagacatctttt

SEQ ID NO: 180531 - DNA, 601 bp, Human
gatttcccatatatcaacatggatgatttcccatatgtcaacatggatgatttcccatatgtcaacatggatgatttcccatatgtcaacatggatgatttcccatatgtcaacatggatgatttcccatatgtcaacatggatgatttcccatatatcaacatggatgatttcccatatatcaacatagatgatttcccatatgtcaacatggatgatttcccatatgtcaacatggatgatttcccatatgtcaacatggatgatttcccatatgtcaacatggatgatttcccatatrtcaacatggatgatttcccatatatcaacatggatgatttcccatatatcaacatggatgatttcccatatatcaacatggatgatttcccatatatcaacatggatgatttcccatatgtcaacatggatgatttcccatatgtcaacatggatgatttcattgagtgaaaggagctagataccaaagaatacacagagaatgactccatttatgttaagctgaaaaacacttaaaactattccatgatgtaagaggtctgaatagtgattatctttgcagatcataataaagataact

SEQ ID NO: 180532 - DNA, 601 bp, Human
gatttctaaccataagtaggtaggaatgtcccagaagagaattgctttcggagtgattctgagcccatcaagatcgacagcagttcaggtgaggtaaggcggcctgcaccgcattagttcacatgctgaacacataagctaaagcaaattccaacttctaaagtttctgctataacacctcaggaataaatagtacctaactccctctatagcttattttaaaggaaaagactatttttcccatgtcatactcaacaccatctttcattcataccttttcttaggtaccttttttttttttcatttgataccagctctttattagaaaagaaaaacttctttgtgggcccaaaaagaatcattttgctgggtgtggtggctcacgcctgtaatcctaacactttaagaggccaagcaagtggattgcttgaacccaagagttcaacaccatcctaggcaagatagcaagaccccacctctaaaaaataaaaaataaaggtggaacaatatgtaacaggtgagggataaccaaaacttgccatataaagacaataagaagattttaacaattaacaagattcatttttcaatggcttgttaa

SEQ ID NO: 180533 - DNA, 601 bp, Human
catctaattcaaacatgcaaacaaatgccttgcagtttagttatttacatgtttgtattctattcggacactcaggaaacaggatacacacacacccacacacacaccttaaagtgcatactcttagagccaaaggtacttttaactccagacactccaaatttcttaagagaaaacagtatcttcttcataaatacatttgtatctgaaggacagtagatgtttccctactttacgatatatgcttcaaaggttttgagtagactggagggaggcccagtaatggccactaggagaaggatggcctgtgcaagaagctgaagctagaggcaggggaaaagggcgtccacttgtgggaggggccgcctggcatgagttcctgaagtctgactagggtgaggagaggactgtccacccatgggtgttaggggcaccccggcatggtaagttagagcttgagagggatgggaaaggcagggttttgaagtgccagtggggtaaggagggcacctatgcagtggaggaggctacactggcaataggagagtggttatctatggggtatgatcaaggataatgagagccaggtttctcactgtca

SEQ ID NO: 180534 - DNA, 601 bp, Human
agtaggaagcagggcctagagggacaagacagaaaactgtgagaatcttccaggctagaagaaattatgaaaaccttaactcagaggatagtagtgggaataaaaagaaagtcctactgcctagaacaatgctgagactaatggtaacagggctacttttcacttggtcaggactggctgcttcatagccattagagtaggatcttataaaatagaagttcttgactttgagtggtagagaacttggttaaaaatgaggattcctggccgggcacggtggctcatgcctgtaatcccagtsctttgggaggccaaggcaggtggatcacctgagatcaggagtgcaagaccagtctggtcaatatggtgaaaccccatttctactaaaaataaaaaaattagccaagtgtggtggcacgcgcctatagtcccagctctcgggaggctgaggtaggagaattgcttgaccctgggaggcggaggttgcagtaagctgagatcgcaccactgcactccagcctgggcgacagagcatcattccgtgccaaaaaaaaaatccataattttccacctatcaccacataacattagccaaccagac

SEQ ID NO: 180535 - DNA, 601 bp, Human
tgcaacggtgcataaggtgaaaaaaatccagttttcatgtcttccaggtaatgcctatggttgttttccaccactctgttccccaacacatatatacattcagctatgtatcacagctctcatagcaatatactggctagactagattagatttctgtttttgtgttattagagacagggtctcactctgtaaccatgctggaatgcagtggtgcaaccatagctcactgcagcctcgacctcctgggctcaagggatcctcccacctcagcctgctgagtagctgagactacaggcacaygtcaccatgcccgaatgatttttatttttttatttttttgtagaaatatgggtctatgttgcccaggatggtcttgaactcctggtctcaagtaatcctcccatcatggcctcctagactaggttttattactcaatgttgaaagaaaagttttacaataacagagctattgccaatcgtgataaaagtagcactccagaaagtgttaaggctttaaataaccataactttacccaattaaaaaaaagttgcggccaggtgtggtggctcatgcctgtaatcccagtacttggggaggcc

SEQ ID NO: 180536 - DNA, 601 bp, Human
ccataggtgaaaaacaatgactatggttctaggaagcaggcaaagcaatcaacagatgaagaaggaaactgctatttctctactagtgacagataaacatttttggcaaggagggtatttttctgtttctctacaaaataaaaaagcagattagaaaacagtgtcatttgcattgaaagctttttagaatcccaatttcagcaacattagcctaaattgtttcttaatagacccaaagagttcaagtttccaacaagtacccaacctttttcttggaagtaatttacttcctggaagaatytgattactgtattattttattttttaataccattctaggtgtccatgggccagaatgaaataagaaatgaccatacttacctggaaagctttacttagcatatgttcaccttccttagatccaagcaaatttactattatttgtttaccatataagttcttaagtgttctaaaatgcctatttaagaaagaaaggaaataaatacatgtcaaataagaagcccaattttttcaataaacaataatccattattaaatataacttacatggcagtattttaaacacagaattggaaaactg

SEQ ID NO: 180537 - DNA, 601 bp, Human
tgttttctaacaatcttgtttaagtttataatcttatgtaacaacataatttatattaattcattattaattcaataagtgttcattaaaatattttttctttagaagtcaggcaattttggggttctttttgacatgaaattctcaagttttctctcatcagtacaagaaggtatagcgttgcatgtatataaatgcatcattcacaattccataggtgaaaaacaatgactatggttctaggaagcaggcaaagcaatcaacagatgaagaaggaaactgctatttctctactagtgayagataaacatttttggcaaggagggtatttttctgtttctctacaaaataaaaaagcagattagaaaacagtgtcatttgcattgaaagctttttagaatcccaatttcagcaacattagcctaaattgtttcttaatagacccaaagagttcaagtttccaacaagtacccaacctttttcttggaagtaatttacttcctggaagaatctgattactgtattattttattttttaataccattctaggtgtccatgggccagaatgaaataagaaatgaccatacttacctggaaagc

SEQ ID NO: 180538 - DNA, 601 bp, Human
tctttactttccaatgaggccttctctgaccactttatttaaactgcactctgcccttaactttccattatcccctccctgctttatttttctctatagcatttatcacatttataaactatgtattttatttatttatcctgtaactgtctcccctcatgagaatggaaaatccatgagggcagacatgttagtctgttttctttatgggaatactcctagtaactaaaagactacctggtacgcagtaagtgctcaataaataattgttaaatgaatgaatgttcaatacattttgaawcctcaatctctcccgttttttttttttttggtctacaacccatcttttccctttctaaaccacattctatcctggttaaattctcagcatagaaccttaaaagcacctcaacctaaaaatctgtacttcattggtagctaaccggtaacaggaaaaggacatcaaaactactttcaccttttaccacatgatcttattttattatgatattctcttatgataccaagatatagcagtcttatgaggaaatgagagtgaaaaaggcgagtgatgtcttagtattcttgtaaagataatttt

SEQ ID NO: 180539 - DNA, 601 bp, Human
tcagtggaaggctgatctaggacttaaaagaatgcaaccttttgcgtcttatctacttctaacctggaagcccccacttcgagttgtcctgccttaccagaccaaaccagtgtacatcatacacatactgactgatgtctcaggtctccctaaaatgtataaaagcaaactgtacccccgaccaccttgggcacatgtcattctgaattctggaggctatatcatggccacatccttaaccttggcaaaataaactttctaaattgactgagccctgtctcagatattttgggttaatacwcatgaaatatctatttaggtgaatattcttaatgtttctaggaactatcttaaatttccaaaaacattgatgtagaatttggggcaaattaaaatatatttcaaagctttatcttcaagaacaagcagcaagagcttaccataggaaaactcaattttcgtgctatttctataaaatcttcatttctttctttgacttgtgactgccctgcagcaaagtggctacagacgaagcaaaggctggttgtatggaagagcattcggattgcaactgctcccttatttccagttgcacctccca

SEQ ID NO: 180540 - DNA, 601 bp, Human
gctataggaaattggaaagatgatgaatggccccctgagagaatcatacaatattacagacctgctacttgggcacaagatggctcgtggggatactggacccccatttacatgctcaaccgaatcatacggttacaagctgtcttagaaataatcactaataaaactggcagagccttgactatactgccctggcaagagtctcagatgagaaatgctatctatcaaaatagattggctctcgactacttgctagcagctgaaggtgggggtctgtgggaaatttaaccttactaattgytgtctatacacagatgatgaagggcaagtagttgaagacataattagagatatgacaaaactgacacatgtgcctgtgcaagtgtggcatggatttgatccgggggccatgtttgaaaaatggttcccagtgctaggaggatttaaaactcttataataggagttataatagtaataggaacctgcttactgctcccttgtttgctacttgtacttcttcaaatgataaaaagcttcatcactaccttagctcaccaaaatgcttcagcgcaagtgtaccatatgaatcactatcaatct

SEQ ID NO: 180541 - DNA, 601 bp, Human
atcgtgtagagcaaagaggcattctccttcctttcatgagcttcagtggtttgaggctggaatgccagaaacacttggtaataggcaggcagtctaaatacctttaaattcgaaaggttttggtaaagttatcattttatgctttatttagtaaaaattaagatctggctttatttccaagattacttaaaggactgggactaaatggtgtttcataaacaattcaagagacaagtggcagttcaaaacatatgcaaaccactaaagttagcttaaaaacctaaattagcttcaattaaaratttcacaaaaatatttccttgcttctctttacatgaaattatatgaaaataggctgaaaaattaaataagttattataaacagatctgatatttctaaaaatctgacatatttaaattttatttattctattccagttaatgtttcttgaaaaacaatattctcctcatttgatattatgtcattccctgcttcctcataagtttacattagttcatttaaataaagaagcccatttcccaacctgatctatcaaaaggccatttcctccttctccaaaggacacggtctgtccaggca

SEQ ID NO: 180542 - DNA, 601 bp, Human
tttctgtcctcatttcttctcatctttctgtgttacaagacaccactgactactccccttccatgctccactttctttccttgatttttaagccatgaatttctcttggctctttgacatttctagaaacaattgccattgtttcttctcattttcttttcacgggcagccttcttctgtctatatttaaactctgtgtttccacatactcaatcccaggtctgtatttctccatattcgattcattctcttctgtctcgtcataatcctattggccaaagttatattaacaaatgcccaygctttgcaggctattagagctgccttgactccagagctctttcctgagcaccagactcatgtttgactgactccatgaacatctcaaattcaacatatccgaaacaaaattcatcttccatcccacacctacttctctctctgcatttcttttcttcatttactccctcacaaacatccctccataatccatttggatcctctttatccccacttagactgtgcacatgctttcttcttggatcactcctctatagcattaattccattctccctgagtctttggattctcaacttaaat

SEQ ID NO: 180543 - DNA, 601 bp, Human
gtttaatctttctgtgataacacttggattgctgactgcctctgctaaagaaaaccacccagtcctgacaactgcagtcacatttgaaattatgcttttcagtctcttctggcctaaagtgcctggcaattccatgatttgctggtttgctcttcccctcaccctttgctcttcaggagctttactgcaaaactccttaaccctcctgaaactgtgagctgtcccactcctgcagatcacttcaacacttcacagagaagagggaagtcttaagatgggaacccctacttcaacagcctgyccccaagctggagtctcattacatggttgtcacttgggtatctgaggatggaacaaatgggccccacccagcctaattttctcagtgacactgctctactattctgccttgcccttcccccaaaccatcagccctttctcctctacttttccattagcactgtgcattctcaagcctgtcccatccaaaaccaccaccctaggacctccaatcttcctagagcaattgccctcttctctttccccccaaactttcttaaagagttgtctacagacacttttctccacttcttcaccttcc

SEQ ID NO: 180544 - DNA, 601 bp, Human
agtagctgttgacagaagggaacagtccttcatatatatgtgtaatgttctataaaatgtgcacaatggtgtaaagaaagggcatgtattttcagtatgaataacaaaagcagtctactattaaactgccctttggtaccatggcagcaataatgctacctctgtgctgacttcttacctaggcctcaggtgctgaaagctaatttactaagtggccctattgatatgcacaaagtattgtttgagttaagccattttgtagtctggccagtagagagaagaaaaagctcaaatagttaaygggttcataccatagaaaatcatcagttataagacatagacaaacctaaccacatagaaaaaagattaagaacaattgtcatctagtgacagttatagcaagtttcctttccattgagagcttatcatctacaagttttcctattctgtaccggagaaaacagggtgcactttatcacctaggtatgaaacttaaacgatgactctccaacatcaagcacattggccacaggaagccatacaaaactttcaaataaaatgcatactctgtgcactgggaggcccaggagttcttgacggt

SEQ ID NO: 180545 - DNA, 601 bp, Human
gttttattatacttttacagaaattagtacattttaattattttatgcttataaatcatccagaaatgaggattttgaaaaaaattaaacctaattttacctaagaacagtttacatgcctaactagatcaaattagcaaaaacaaaataaacctctctggctggctggtgagaaggcagctaaaggcagctgtgaaaacaccttagaggaatctactctgcaaacactctaccttgtctgttgcgcctaccatgttctttagagaaaagctaagaaatagcaataatgatagaaaaaacwgtaaaatccagaagctagagattggaaaacatgcaaaacattttaaaatagagtgaagaattttacatctagcagaaatggaaataaaaggttgtcacctgaaggcggaggaggtctctgtgggggagccgggcgtgtgggaggggcgaccgggcggggcggcggcggccgcttgggctccaagggctgggcggggtctttctgcggcagcggcgttgctggctgcgcgtcaataggagaacctaaaaagcgcacaggaggtaagaagatcagcttctaagtagctgttgacagaaggga

SEQ ID NO: 180546 - DNA, 601 bp, Human
ttaagtgtatcacttttatccaaataatgaagtttgttatttttgaagagtatgttaaaataatgttagagtcggaagatcatcaagtgcaattccctcattttagagatgaggaaattgaggccttgaagggtcacatgatttctccaaggtaacaaaactgactagtagtaaacaggacttagaaccgagaccccttggccccaggcgaggttttacctaccggtctggctgtactgtatccagcaggtcctgggcctgcaagtcctgcttgaggtgaaggctgactgcgtcctggaamaaagacatcatatcatatatttaagtttaaaaaaataaacaagaaaccatgtacttatattccaagtgtctatttcacggtccagttttaagggtgaatagctacattcaagtgtttttacctatattatctttccttgttgttccagggcttttgggtgctttgaagcaagaagggaaaaaaaaattagttgtaagttaacaattaagcaatattgcataacatcagcttgctgttctgcttcattaccagcagaaatgggggcatgagatggtaacaaaacaaagcactttgctttgt

SEQ ID NO: 180547 - DNA, 601 bp, Human
tactcaggtaaaatgataaaaagctgcccaaatccatcatttcctcatatactgagactcttaagatatttatttagtgaccataattgttttaagtgtatcacttttatccaaataatgaagtttgttatttttgaagagtatgttaaaataatgttagagtcggaagatcatcaagtgcaattccctcattttagagatgaggaaattgaggccttgaagggtcacatgatttctccaaggtaacaaaactgactagtagtaaacaggacttagaaccgagaccccttggccccaggcraggttttacctaccggtctggctgtactgtatccagcaggtcctgggcctgcaagtcctgcttgaggtgaaggctgactgcgtcctggaacaaagacatcatatcatatatttaagtttaaaaaaataaacaagaaaccatgtacttatattccaagtgtctatttcacggtccagttttaagggtgaatagctacattcaagtgtttttacctatattatctttccttgttgttccagggcttttgggtgctttgaagcaagaagggaaaaaaaaattagttgtaagttaacaattaag

SEQ ID NO: 180548 - DNA, 601 bp, Human
ctcctactggactagcctaagtcactgattactggtttctatttgctctttctctctgttcttgattacctgttatagtccagagaaagttttcaaataataaaaaacctatgtgtataagagaacatataaacatacagaaaagacacattcatcaggtagggaaaaatcctgtaacaacatctactctcctatttctaatacctttacggaatatgatgaacctgatcaagaaaaaaaccaaaaagagaaaaaaacctttagaaccagttttactatactgaatttatcatttttttttctgaaatgtaattaaaatcctttttaatgaaggattactttatatcttcattaattactcaggtaaaatgataaaaagctgcccaaatccatcatttcctcatatactgagactcttaagatatttatttagtgaccataattgttttaagtgtatcacttttatccaaataatgaagtttgttatttttgaagagtatgttaaaataatgttagagtcggaagatcatcaagtgcaattccctcattttagagatgaggaaattgaggccttgaagggtcacatgatttctccaaggta

SEQ ID NO: 180549 - DNA, 601 bp, Human
aaaaaggaggataaatatttgaagagtaatattacatataaaaaagaaccttcagattgttaagtggacagctacaacagaaaagacaaaaagcttctatcttcataggaagtggtttcctcagttctcacaatcttaataatcttaatttctaggtacagtaatagctctcagtttcctactcttcagatatgggcctctcagtagtcccagctcctactggactagcctaagtcactgattactggtttctatttgctctttctctctgttcttgattacctgttatagtccagagaamgttttcaaataataaaaaacctatgtgtataagagaacatataaacatacagaaaagacacattcatcaggtagggaaaaatcctgtaacaacatctactctcctatttctaatacctttacggaatatgatgaacctgatcaagaaaaaaaccaaaaagagaaaaaaacctttagaaccagttttactatactgaatttatcatttttttttctgaaatgtaattaaaatcctttttaatgaaggattactttatatcttcattaattactcaggtaaaatgataaaaagctgcccaaa

SEQ ID NO: 180550 - DNA, 601 bp, Human
tgaaaatcttgtaaattgttcaacttaacagctacttccaataatttaaaattttttttattatttttaaaataggcattattttacggttcaaaattcaaaaggtacaaaaagatagaaagactcctcctcacctgcctcctggcccccagcattgggcattccctggaggaaactgtaaccactttgtgatccctcacaatgacactctgcatgtaaacaagaccccaccctccaagaaagaaaagtgtgtctgtgtatctaatattaaggagtttgatatcaatgactgaggcaaaargatacttcaggatttgaaacaaatatctttgtctttttgatgaactgacaaccatgagattcaagaacacaatctaagggggcacacacaaagcatgtgcccgtcggccaccaaatcgctatactcacttcaatgaaaaacataaaacaatggaaagttttctgagaaaatgatatgtgtcttagaatgattttataatgataactacaatctcagctaacagtttgcacctccggaagtttttcagagtactttatctacttttgtattggtctaaggacacttaaaccatcagagttt

SEQ ID NO: 180551 - DNA, 601 bp, Human
ggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgccycagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatatt

SEQ ID NO: 180552 - DNA, 601 bp, Human
gcccgcgaggggcaggggccggcaggctgcaatccttgcatcccagcttattaacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctgsccaggactgggccactagcttaggtagaggcatttaaaagatatatatatatgtttatatatatatattttaaatgtatattatatatattatatataaaatatatatatgtatataaaatcaattcagttactcagtcccttggtttcttcttacatacagaaattgtgtgtatgtgtgtgtgtgtgtgtgtgtgtgtgtgtatatatccacacacatatatatatgtgtggatatatatacgcgcatatatatgcatatatatgtgcgcatatatatatatatgcatatatatatatg

SEQ ID NO: 180553 - DNA, 601 bp, Human
aacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatataagtttatatatatatattttaaatgtatattatatatattatatataaaatatatatatgtatataaaatcaattcagttactcagtcccttggtttcttcttacatacagaaattgtgtgtatgtgtgtgtgtgtgtgtgtgtgtgtgtgtatatatccacacacatatatatatgtgtggatatatatacgcgcatatatatgcatatatatgtgcgcatatatatatatatgcatatatatatatgcacacatatatatgcatatatatatgcatatatgtatatatgtcccttggtt

SEQ ID NO: 180554 - DNA, 601 bp, Human
gtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatattatatatattatatataaaatatatatatgtatataaaatcaattcagttactcagtcccttggtttcttcttacatacagaaattgtgtgtrtgtgtgtgtgtgtgtgtgtgtgtgtgtgtatatatccacacacatatatatatgtgtggatatatatacgcgcatatatatgcatatatatgtgcgcatatatatatatatgcatatatatatatgcacacatatatatgcatatatatatgcatatatgtatatatgtcccttggtttcttcttacctacagaattctgagtaattgaactgattttcccaaggtcacagaacaggtccttcctagagatgtgaaagaattcagactttctacttgagcttagtactgagcttgtcctg

SEQ ID NO: 180555 - DNA, 601 bp, Human
ataatacaaacatattaacagataatttggataatggataaaaagtaaaaaaaaaaaaaaaaaatctgccgggcgcagtggctcacgtctgtaatcccagcactttgggaggcggaggcaggcggatcaccaggtcaagagatcgagaccatcctggccaacatggtgaaacccggtctctaccaaaaatacaaaaattagctgggcgtggcagcgcatgcctgtagtcccagctactcgggaggctgagggaggagaatcgcttgaacctgggaggcagaggttgcagtgagctgatatygtgccactgcactccagcctggtgacagagcaagactctgtctcaaaaaaaccccaaaaaaccaaaaaacaaaaatcaccacccactgcagtaaatattgctaacattttgggtgtatccttacaggtatttccttttagtttcgtattttccatacttttagttttaatacaaatacaacttatttagtcggaagaattatcctacaattcactggagtttttataaccttcttgagaatttagaagaactgttccatggagtagagatgctacaagtcttttacaagttaaattcttg

SEQ ID NO: 180556 - DNA, 601 bp, Human
tgtcttactccaaagcctcccacactacttatatactaagattttgtctgttaaaaaatattgaagaacatactaactttctgcttttcacatgtcctgcaaatacttttcactcttttattttggttgttttgacatataaaaggtactgcttaaaaggaggtagtcagattagactctgagttggtgacacttatgctgctttatgctggcatgtttgctccctttattacactgtgttgttctctgagaacagttcatcctggcttctccatgcccctgattcttgggcattgtatgsatgtgagtttgtttattcagtcattctctgcatttttattttctcctggatgccatactctctgctagctgctaaggatgtgatcatggacctgtcggagggtaatctgaaccttcgttttggacacttggtatcccctatctgccaggaaattcaaactttttgtagttttttcatccaggatttggctatacacaaggaggtcatccatatactggagtatactcccatttcttaattaattgcagacccctcagattcctctctaaggcccaggcaaagcaatgggggctatcctga

SEQ ID NO: 180557 - DNA, 601 bp, Human
tggatgccatactctctgctagctgctaaggatgtgatcatggacctgtcggagggtaatctgaaccttcgttttggacacttggtatcccctatctgccaggaaattcaaactttttgtagttttttcatccaggatttggctatacacaaggaggtcatccatatactggagtatactcccatttcttaattaattgcagacccctcagattcctctctaaggcccaggcaaagcaatgggggctatcctgaaaaccctgagggagaactgtccaagtgtattattgtttttctctggyattaggattttcccattcaaaggcaaaaaggtattgggattctggggccagaggaatggaaaatgaagcatcttctaggtctaggactgagaaccatttagcatcccttggcacctgagccaggagggtatatggatctgccaccaatgggtggacctaccagtgggtcttaagagcccaggggtaagtaataccttagctgtggatgcttggcctttccttgcttccagcttaattgggtattgtttttgattgggaaaataaatagctaggggtctttaagctgtattttggctggca

SEQ ID NO: 180558 - DNA, 601 bp, Human
gtattgtttttgattgggaaaataaatagctaggggtctttaagctgtattttggctggcactgctgttttagccttccttggttttccagtataccatgccagtgtgttaacctgtttattaatgtggtctgggacagtgtctgtatttttgactattagcaatttcaccagatgatgcttaaattgtagtagtgcccctattttaaccataatatctctttttaacagggggcctgggcagcttgatactactagaaattactgttggaagatttgtttctcaatttgacaaatcaaakgaggaataaaggatcttacttgtggctttccttccattcccataatggtcgtggactgggaggaaagttttcctacataagtagtaaggaaagaaactgaatttgtattgaaaagaaactgaatttgggtgcccatgacgtccagagttacctgggggctcctcagtagtaattacgatgttcctgaacaggggcagtgaggaagaccctgggtcgcttcagtcttcatctaatttctcttttgcactgctagagttttgccttattgaaccccttggtgggagcagggccagtcaatct

SEQ ID NO: 180559 - DNA, 601 bp, Human
acaggaaaccatctctaaatttttcctacttagtctacccggggggctacagtgttacccagagccccccagaaaaccacataatgaatattttattcctgatacacaactcaatatccttaattccaccagtatcaccatacatactgtgcaatgaagaaattcactctaggcacatgaccagtaagtactccagtgccagcttgtttagtaaagttatacttaagtcatgtgaacttgaaaattgcttagacttatttacttaatttatgagcgctcctttaattataagccaatctgrtagacacaacatataacagtaagtgtacatacaaataaacacatctagacatgtatacacaaacacaaatgaagatccaatagctttttaccttggaactctagccatgagatagcaatataagtccactggttttactgtttgacccaatgggtaatccagtgaaggctgtgaaccaaaatttcaggtcaagcagtttccatggtagtttgatttttaaaggccaaacctccccagactccaaacactggggccaaacagcaccaaaggagaacaccacatgctaaccaggccaaccct

SEQ ID NO: 180560 - DNA, 601 bp, Human
tggccttcaggtaacactggaaagtggccctggccagttgcccacaattatcagggagctactaggaaatggccactgaaagactgaaaaagaaaaaaaggaaaggactcaggcctctcacccaaactgggcggtggtggtcaggtgcttccacatagaaaactcttggtttcactggagtgtggccccggccagaaacctgcagttgcctctgtgcttaggcattgtgcgctgaagggcccaagttggaaagggaaaagagaaaaaagcattcccctgtatggagcagagaggaaaacgwgaagaaaaataaatctccaattttgggcttacctcctggctggctttccaaaatacgttactggtggaggatgtccaggttcttggcattttgaacaaagaattggacaaaaggcacaaagaaaacaaggaaaaaatgaagcaacaaaagccgagatttattgaaaatgaaaaatgcactccacagggtgggagccggctggagcaagtggctgaagattgcaggttacagaattgtctggggttggtcactttccgcaaccaatcagaagctgaagttacaaatttacaccctatgcaa

SEQ ID NO: 180561 - DNA, 601 bp, Human
aagagaaaaaagcattcccctgtatggagcagagaggaaaacgagaagaaaaataaatctccaattttgggcttacctcctggctggctttccaaaatacgttactggtggaggatgtccaggttcttggcattttgaacaaagaattggacaaaaggcacaaagaaaacaaggaaaaaatgaagcaacaaaagccgagatttattgaaaatgaaaaatgcactccacagggtgggagccggctggagcaagtggctgaagattgcaggttacagaattgtctggggttggtcactttccrcaaccaatcagaagctgaagttacaaatttacaccctatgcaaatgtctaattggtcatagaaagcaaccattcagaggctgaagtgaagttacaaagttatactcctatgcaaatgaagacttggcccatgactagcctgattggttgtgggaggggatcaatcaaaggtacttcgaattttttcatctgccacgcagaaaaggggcaggagggttgcaaagggagtggcttctggtccttttgttacttgggcatgggaagttggggttggggttttccttttgatttagttctagga

SEQ ID NO: 180562 - DNA, 601 bp, Human
ttttttgtagtttttgtagagacagggtttcaccatgttgcccaggctggttttgaactcctgggctcaagcagtcctcttgctttggcctcccgaagtgctgggataaaaggcatgagccaccacgcctggctagtgatgctagatttaagctatattttggaagtaggatttgataggttggatgtgaaggatgaaaaaaaggaagacattgtgaagatacctcactggtttgtggcacgggaacctgggtggagggtagtgccgtttgctaagatggaaaagattagttttgggagcygacacaagaattcagtttgtgcttgttgaaaagctcaagaaactcaagtggagaactgatgactgttggatataaaagtcaggagttcagaggagaggcctggctgggttggagataaccatttgggagtcaccaacatataaagggggttttaaaaccacttagagattgagtagaggaactagcttaaaggaagggaagcaccattgtttcttgacagaagttaccaggtgccctgagatggggcaacccagggactctagacccagtctcttcaactttacagttttgttcctgtca

SEQ ID NO: 180563 - DNA, 601 bp, Human
tttacagttttgttcctgtcacttttgttgtctttagttgacccttcctcatcctctgccaataccatttacttcctttcttatcatggatatgtgatacacactggtaccttacaaaggcaattgcctttatggatctttcatttcattttttttaagagaaggggtcttgctatgttgcccaggctgaagtgcagtggctattcacagccacaatcatcatgtagtacaaccctgaactctcctgggctcaagtgatcctcctgcctcagcctcttgagtagttgggactatcgtcacrtactactgtgcctggcccatttacattttaatacaaaatgttctgtccctgacatttgggttctccctcagtcttattttatgaagtagatgctggctaactcttagtagagtttagaataagatagaggtacatacctggtcaatagaaagggattcctggagaatagggtatctggatggagggtagaggttttgttggggaaaacaggtagtttcttagtatcctgttatttcatgatgtgaattagtgccagattgtttcattgacatcattcatcatacttcaccaggcatatac

SEQ ID NO: 180564 - DNA, 601 bp, Human
ctgcagtttgtctttgaatgtgacattggtaggtcttttttcttagacatttctttctctttaagttgttggttaatatttttcttttagtttccttaaacgtttattgaaatagtgtttgcatgtgttcattcattcattcaacaaatatttatttagcacctattacatgtcaggccctgttgtgagcactgaagacacagctctgatcaaaagcatttaaggataccagtcctcttggagcttatgttccattatggtctttacattctgcctatatgtcacctcattttttcagcartgctgatgacctgcatattcatgattctttacttagtacaatttcaattaaacaactcaatgccagccacagagccctgttttaacaataggcaaccattaacttgcatccttgatatagaagaaagtgtgctgctgtattttgttgttgtttgttttgctatacctttttatcttgaaaaagaattaccagtctggttttaaaatgtagcagtcatttattagtactgtgtgattgcataattaggtaactgtgcttaataaatttttagtgatgtatatagattattttttaacagtc

SEQ ID NO: 180565 - DNA, 601 bp, Human
cagtacagctttggttagcacatgctataagtaggtttatcttactatggcagacataagcatagtctatgaatagtctttgatgtaacctctaggagaataaataactctaaggaaaatatatattaaaaaaaattacctgtgaataacttgtgatttcttcttgccttgtccacaaatcatgctgtaactttaaaaaagaaatgaaaagtaaatgctgctccattaaaatttgtaatttaaaacttagaaaagtatctggtagaatagcaattaatccaaaaccctaaaattttgaatstgtttgaaaaactattcaggagtgaaagtttaggtattcacatggaaataattacctttaaatacccttactggtaaattattttatacaagacgaatagattctttgtggttatcagacaataattgaaatgtttactttgtatgatttttattattaaagtctttgcttcctccctactaataacttgctgagcatcagtgcaataagatatcatgtcattcagtattaatctgaatgttcagcagacttgaaataaatagcaacttagatatttagacattttgttgggaataggcc

SEQ ID NO: 180566 - DNA, 601 bp, Human
gtggttgctgaaggttgtggtggctgtggcaacttcattaaaaaaaaaaaagacaacaatgaagtttgctgcattgatagaatcttcctttcatgacagatttctctgtagcatgagatgccgtttgatagcattttaccacagtagaacttttttcagaattgaaatcaattctcccaaaccctgccacttctttatcagctaagtttgtgtaatattgtaagtcctttgttgtcatttcacagtgttcatggcatcttcattagcaatggatttcatctcaaggatccactttttttttgaattcatagaaagtaatagattccatctcaaggctccactttctttgagttcttcaggttgcatacgtaaagagcaactcctcatccgttgaagttttatcatgagattgtagcaattcagtcacatcttcaggctgcacttctagttctcttgctatttctaccacgtctgcagttatgttcttctctgaagttttgaatccctcaaagtcatccatgaggctgggcatggtggctcacgcgtgtagtcctaccactttgggaggccaaggctggcggatcatctgagctaaggagtt

SEQ ID NO: 180567 - DNA, 601 bp, Human
ttcatgacagatttctctgtagcatgagatgccgtttgatagcattttaccacagtagaacttttttcagaattgaaatcaattctcccaaaccctgccacttctttatcagctaagtttgtgtaatattgtaagtcctttgttgtcatttcacagtgttcatggcatcttcattagcaatggatttcatctcaaggatccactttttttttgaattcatagaaagtaatagattccatctcaaggctccactttctttgagttcttcaggttgcatacgtaaagagcaactcctcatccrttgaagttttatcatgagattgtagcaattcagtcacatcttcaggctgcacttctagttctcttgctatttctaccacgtctgcagttatgttcttctctgaagttttgaatccctcaaagtcatccatgaggctgggcatggtggctcacgcgtgtagtcctaccactttgggaggccaaggctggcggatcatctgagctaaggagtttgagaccagcctgggcagcatgtgagacctgggctctactaaaaatacaaaaaaattagcaggcatgctagcgcatgcctgtaatccct

SEQ ID NO: 180568 - DNA, 601 bp, Human
ttaggcataagattatggtatgttccaaactccagcagttccgggtaccaaagtttatctttacccttccttattgttttatggtccatgaccatttgctgttgacgtatttagcacatgccactggtcatgcacattccttatggcttaggttcctaacacctgtctgtgcttcttcccagaccactcactttgacgggtctccctttctgactttccataggtcttattgtctacacgcatttagtcacttggttatattccttcttcctgttttatacttttacaaaaaattgtttartatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgc

SEQ ID NO: 180569 - DNA, 601 bp, Human
gaccactcactttgacgggtctccctttctgactttccataggtcttattgtctacacgcatttagtcacttggttatattccttcttcctgttttatacttttacaaaaaattgtttagtatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaartgattttttttttgattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaattgcaatattagtccacttattaccagttagttctcatgtatatttaacatcaag

SEQ ID NO: 180570 - DNA, 601 bp, Human
acgggtctccctttctgactttccataggtcttattgtctacacgcatttagtcacttggttatattccttcttcctgttttatacttttacaaaaaattgtttagtatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttkattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaattgcaatattagtccacttattaccagttagttctcatgtatatttaacatcaagtcagctttctctta

SEQ ID NO: 180571 - DNA, 601 bp, Human
taaatacctatatgaatagtattctgatagaacttttactaaaagatcttaaaaatacaaaatatgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgttttattgctagctgcctkagccaatttcaattccattgcctccagttggagattctgcctgttgggtctttattagcaaactttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacatta

SEQ ID NO: 180572 - DNA, 601 bp, Human
atgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgttttattgctagctgcctgagccaatttcaattccattgcctccagttggagattctgcctgttgggtctttattagcaaaytttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacattataaaaggtaatctgctttattcaaaatctactgatttaaacgctaatcacatctaaaaaatac

SEQ ID NO: 180573 - DNA, 601 bp, Human
aaggccttaaattgattgtatgaagcctacccacattataaaaggtaatctgctttattcaaaatctactgatttaaacgctaatcacatctaaaaaataccttcacaacaacttctacacctgtgtttgaccaaatattaataattgggtgccatagcctggtcaagttgacatataatgaaccatcacattatccttcttacatgttttatcccagctgatgtctttaattggcatgtgattgatttctgcccattgcttttattaatttcatttgactcagttaaaataatcagaatrcattttggtccatctttgaattcccactcttctgacttgcagtgtaaggaatgtgttttgacctcctattgttagggatacctttgaaatgcttttgacattttattttttgtcttagtcttacctgatttagaattcagcaaagcagttcacgtgagggctggcaggagctgatatctccctctcttctttcctttggcattgctctatattgcttgtgtattcatacggggcaagaggagtgagggtctttaaaatttttttttaaattgttgtctctttttctgttccactctttct

SEQ ID NO: 180574 - DNA, 601 bp, Human
cttcatttattcctcccaaaaaatctaggggtttgtgtaggctgttgagtcctctgctgcctgtctgcccaggttctcatccataacactctgcttaccccttctgtctggggcattttatcgatgccatctgctgctcatacactggtgactcctgaatttctgtctctagttcagacttccgttctgagcttcagatctgtgtattcagtttctactgcacatcttcacctcagtgttccacagtcacttcaaactcagcatttccacacctaaggctgctacatgcacccagcaaatrtatgcctcctagtgcatttcctattttggtgaatatatcaccatccatttagttacctaagccagacactggggaaattctaagtgtcttccttctttctagttccccacatccagtgaagttgtataattatatctaatctggcccctcctttccattcttactgccctgatacttaagatctttcatttttctctgcctgcagagttttatttcttttcttagcagtcaccactcctttagtcttaccctccctccaatccattccctatcttgttgccagtgtgatgattttaacat

SEQ ID NO: 180575 - DNA, 601 bp, Human
ggtaagctttatggttttatttgtttttaaaaagaggaacacagttttttcatgctttgattccctttacatttagaggtttttttgaatatagttgttatagcattttggaaccatggggtaccttaggcatttaatttaattttttcttaagatgtcccttttccagcgttttgttttattttatttatttatttatttatttatttgagttggagtctcactctgtcacccaggctggagtgcagtggcgagatctcagctcactgcaacttccattccccaggttcaagtgattctygtgcctcagcctctgagtagctgggataataggcatacaccactatgcctggctgatttttgtatttttagtagagatggggtttcatcatgttggccaggctggtctcgacctcctgacctcaagtgatccgccagccttggcttcccaaagtgctgggattataggtgtgagccaccacacttggctgcttttccagcataagttttaaatttaggggtgttagcaaaatctttgctctcttacatattttttgtgaattatgaaattaatgtctttaacagagaaagtgatcttcca

SEQ ID NO: 180576 - DNA, 601 bp, Human
gaaaattccttagggaaattgaatatgtagaggatttatttcccctattgaagtatacatatttatgacatacaagcagattgaataccagatatagattgtgagatgtctaacaggaatttggagtgaaaacaggtattaataagttggtgtaaatctggtttcctaatatatttattaaaaatatttttaaaggattgttagtagctttaaattgctcttgatattacaaagttcttttgttttccaaaggtgcacatgttggcagaactagatgaacatgtttaatatgccttttttwccccacagtgcttttttcacaaacattaatttatttctaaaaattatggtcaaatatatataacatttactgttttaaccatttttacagttcagtgttattaagtacattcacgttgtggtgcaattattaccaccatccatcaccagaacttttttcatcttacaaaactgaaacactataaccatctaacaataactccccattttctctccaacagtccctggcaagaacccattctactttctatctctatgaatttgactgttccttatgtgagtggaatcatttagtatttgt

SEQ ID NO: 180577 - DNA, 601 bp, Human
gaactagatgaacatgtttaatatgcctttttttccccacagtgcttttttcacaaacattaatttatttctaaaaattatggtcaaatatatataacatttactgttttaaccatttttacagttcagtgttattaagtacattcacgttgtggtgcaattattaccaccatccatcaccagaacttttttcatcttacaaaactgaaacactataaccatctaacaataactccccattttctctccaacagtccctggcaagaacccattctactttctatctctatgaatttgactrttccttatgtgagtggaatcatttagtatttgtccttttgtgactgccttattcatttataataatgtcctcaaggtttattgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttggtagtgtcactgcttttttaattcagaagaacaaagttggaggac

SEQ ID NO: 180578 - DNA, 601 bp, Human
cctggcaagaacccattctactttctatctctatgaatttgactgttccttatgtgagtggaatcatttagtatttgtccttttgtgactgccttattcatttataataatgtcctcaaggtttattgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttgrtagtgtcactgcttttttaattcagaagaacaaagttggaggactcacagttctttttttcaaaacttactgcaaagctgtagttatcaaaacggtgtgacagtggcaaaaagacaaacattgatgaatggaatagaatagagaacccagaaataaacccttgaatatctagtcattaatttttgacaatgatgccaataccattcaacaggggaaaggacagtcttttcaacaaatgatgctgggaaaactggatattcacatgcaaaagaatgaatttggacctttatttaacaccat

SEQ ID NO: 180579 - DNA, 601 bp, Human
ttgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttggtagtgtcactgcttttttaattcagaagaacaaagttggaggactcacagttctttttttcaaaacttactgcaaagctgtagttatcaaaacggtgtgacagtggcaaaaagacaaacattgaygaatggaatagaatagagaacccagaaataaacccttgaatatctagtcattaatttttgacaatgatgccaataccattcaacaggggaaaggacagtcttttcaacaaatgatgctgggaaaactggatattcacatgcaaaagaatgaatttggacctttatttaacaccatatacaaaaatgaactcaaaatagatcacagacttaaatgtaaaactataaaactcttagaagaaaatgtaggggaaaagcttcgtgaaattggatttgataatgactttttaaatatggctctaa

SEQ ID NO: 180580 - DNA, 601 bp, Human
ctggctgggcatgatggcttacagttgtaatcctagtgctttgggaggccaaggtgggaggattgcttgaggccaagagtttgagaccagcctgggcaacatagcaagatgaccccacccctacaaaaaattaaaaaaaaaaaatagctgagcagggtggcacacagctgtagtccacctgctttggaggctgaagcaggagagcccaggagtttgaggctgcagtgagctgtgatcataccactgcagtctagcctgggtgatagaaggagacccagactctaaaaaaaatagtgcagcraggctgagagactctgatctatttccatgtaatgtggacactgaaattctgagaggtggagttgctcagtggcaagtggtctagggctcacgcttcctaaaacccagttctaggatttttgtactatatatttttccctcatttataaatgaacagctaatttatgtaaaaacataaaaataaggaattctttttttttattattattatactttaagttttagggtacatatgcacaatgtgcaggttagttacatatgtatacatgtgcaatgctggtacactgcacccactaactcg

SEQ ID NO: 180581 - DNA, 601 bp, Human
gagagcccaggagtttgaggctgcagtgagctgtgatcataccactgcagtctagcctgggtgatagaaggagacccagactctaaaaaaaatagtgcagcgaggctgagagactctgatctatttccatgtaatgtggacactgaaattctgagaggtggagttgctcagtggcaagtggtctagggctcacgcttcctaaaacccagttctaggatttttgtactatatatttttccctcatttataaatgaacagctaatttatgtaaaaacataaaaataaggaattctttttttttattattattatactttaagttttagggtacatatgcacaatgtgcaggttagttacatatgtatacatgtgcaatgctggtacactgcacccactaactcgtcatctagcattaggtatatctcccaatgctattcctcccccgtcccccaaccccacaacagtccccagagtgtgatgttccccgtcctgtgtccatgtgttctcattgttcaattcccacctatgagtgagaatatgtggtgtttggttttttgttcttgcgatagtttactgagaatgatgatttccagtttcatcc

SEQ ID NO: 180582 - DNA, 601 bp, Human
ggattccctctttttctattgattggaatagtttcagaaggaatggtaccagttcctccttgtacctctggtagaattcggctgtgaatccatctggtcctggactctttttggttgataagctgttgattattgcccacaatttcagctcctgttattggtctattcagagattcaacttcttcctggtttagtcttgggagagtgtacgtgtccaggaatttatccatttcttctagattttctagtttatttgcgtagaggtgtttgtagtaatctctgacggtagtttgtatttctrtgggatcggtggtgatatcccctttatcatttttaatgcgtctattcgattcttctctcttttcttctttattagtcttgctagcggtctatcaattttgttgatcctttcaaaaaaccagctcctggattcattaattaaaaacccttcaaaaataaggaattctaatgaaacaaaggtcatgggttttgattagtcatgaaataagaggctagcgatcagaaacctatattaaaaagtttgaaaaaaatctatttttgtgattctcttgtgaacgagattttctgagtgcattaggtt

SEQ ID NO: 180583 - DNA, 601 bp, Human
tctattcgattcttctctcttttcttctttattagtcttgctagcggtctatcaattttgttgatcctttcaaaaaaccagctcctggattcattaattaaaaacccttcaaaaataaggaattctaatgaaacaaaggtcatgggttttgattagtcatgaaataagaggctagcgatcagaaacctatattaaaaagtttgaaaaaaatctatttttgtgattctcttgtgaacgagattttctgagtgcattaggttgttctggggttggagctacttctgtaaccattgttttcaayttaattgattacacaataaatgttagagctaccaacaggtgttctctttgacattttaagtatcagtcagaatgtaatgaccttaagccagtttttctcaatcttatttgacaatggcatgcttttaaaaatgttcaaatgtgagcaccaataggggcttggaagataggcttggattaaagtgaacaaggaaaaatgggattatagataattattgtcagaaagtataaaattgattcatgtatcttttaagcatcacaagaattagaaaatgagaccatgtgtattttattaagaaca

SEQ ID NO: 180584 - DNA, 601 bp, Human
aatactggctcttggaaactctagtatctttagtaataaggaatttcttctccgtttctgggcatgctgttcatttaacccatcttttctgttttctggtctttgccagcttggagtctagcagaaacaaagaaacttgtttctaagccaaaaggaaacacacaaacctagtagtatatccttaatcaatatcctatagacaatgaatttgagcatttctttctttaaaaaagtggatgttcctcaaaactcaaaaggaaactcaaaatcacttcaggaacatcttaattctgtattcaamggcagaaatacagcatattaaatggcataagcccactggatttattcagatctaaattaagcattgataggatggacctgaaaaggaaaacttatcgtgttcttaacaaattcataagtccagtaaggcaacttaggtatttgcatgaagaaggcactttttcttttgtcaaataaagattctgcaaagtttctgtccaagaactttttagcttttatagtatacaatatgtcagagaaagttacaactctgattacaatgcataactgtttatatgaaaagagaaagtttgatatcttg

SEQ ID NO: 180585 - DNA, 601 bp, Human
cttgacatacatttaatgcactagttgtgttctctgtaatgactgaattcatcctgcagtttgatgaaggtgaatcgggaggggaacctggatcttgggaacttccaacctacccagcctcttctgatatctcttagacacttgtaagcagaatttgagccaaatagtctcaatgaagcattcccttcattcatttctggccagattaacttaattcacgctcatttctagctcaccctctttctttcttaaagcatgaagtagaaggtagttcatggctcagcttaaactcccattacaytgaaagatttcagtaaagtaaaatttcagtaaaatttgttcccaattttaccagtctgagtgatcctaagctgcacagtattcattttactaagggagcaacagccaagttactgcacagtcttccactgtttaaattgtcttgtagcagtatagtgccactgctgttgttttttccatcccacgtttcattttccctagaatatctccatgttccagggaagtacaggatcagagaataggcagcgttctttctgagagttgtacgtagttacataacgtatcaggattttcttgttca

SEQ ID NO: 180586 - DNA, 601 bp, Human
ctgacatgccagtctcaccccagagattaggagttactggtatggaatgtggccagggtgttggaggtttaaaaggtccccaagtgattcaaatgtgcggccaagtttgagaactactgctctggaaggtactaaaattttaaagatgtggtccctgcctttaaggaaatcatagtatacataggccaaagcaaaattacatggaagtaaaataacagtgtaagaatgaaataacaatataaaatgataaaaataacgcctggtaacttcgtttcttttatttaggctagaatttaaatgrcagaattaaattgtgcattgagagttttgatagaaaatggcaactgagacttctggaaaaagaagcaattgaacataggcatctacttttgttcctcccaaaaccccactaaaatatcaagggatcttcttttgtcaaggcctaaatccgcagggatggggagaatgggactggagacaacctgaagaaaatgttggaagctggaaggtaaaggacttaggaggcttggaaaaacagaatctggagtgagcagtggggcagccaagaaccagcctggtttacattaaagaattgcccaaa

SEQ ID NO: 180587 - DNA, 601 bp, Human
attagcagttggcactatgcttacatacacacatacttgctacattaatataataatattgataatgatattgatggtgataatagtagcagcaaagtcttagagtgctttttacatgcccagcactgttcttagaactttacatatattaactcacttaattctcaacaatcctgtaaagttagttctattcttatcccactttgcagatacagaaactaatgtacaaagaggtaaaataacttccccaggtttcacaactgaaaccaggcctgagacctcatctttctgtgattaaacytgacattgtgattaagtttgaagaaactgattgctaattaatgttgttcattgtattggttttgtgttctctttgaagaaaatagtagtgatatatgtgctcaataaatataaggagttattgctatttttataaaattatatgtttgtacaaattcaagttgcattagattacaaataatttaacctttgatgtctattaactttttatgtttaaaaaaggttcatacattttgaagacaatcagagaaggtggtaagttgagtgattaaattgtaatttaaaacataactgtggtcac

SEQ ID NO: 180588 - DNA, 601 bp, Human
cacacagcatatagctcagggacccttgagggggctagtgtagagtgagggcttttaagtggaggcttgcttgaaaagaactgtgatctcttaggatcagttgcccctcatttccaagcagtgcttggagggctttgggcccccttggttgggttcaatccttgacctgtgtagtctgtaagttgctgtagatacacagctgcagcagtaacattgttctttaatccaggagttgcctttgatcttcagcccttcattctcactcttggggtctcttttttgcagaaggtgagccgtggccaggcttcctgtttatagcctccctctgttcagtggtaaacctcaggatttttggatgaagatctttggatgtgtgcctccttggtgcccattcatggtcttgctaatggaacaggatttgggttcatagttttgaattgcctgtcacagccccgctgtcatggctgaacttccttccccaccccacccttcatcccagatagagagataatgcttattgttgagtgattcaaggtactgtagacatcttccagctggagtggatagagtttgaggatagtggatagagtttgaggatgag

SEQ ID NO: 180589 - DNA, 601 bp, Human
tattttatactttaagatttcttttataatgtattaaaaagtaaaagtacttttaaaaatttgtgcccaacttcaagagcattttaatttttttgataactatgataattcagataatttgttgaactataagattgatatagtaagtttgaaatttcacttgaatctgaactgattcgagggcttctatctatttaattgtttcctttccccatacccatttctttaataagtggattatgtaaaaacagcttggcaccttgttaccagtaacatcttagttttacccacaagtttggakattttacactccctttttgagatagaaacatgtataaatttccacagagtaatagtggaacagtgttaacagtgctatcttgatatgcaatttattattaaatcaaagtttgaagtagccctttttaaaaggactttaaaaacatattcctgattaaggaagttttcctgatcatttttattcctgttttcttaacatgctttttattttatttcattgttggtagctaggtcatgcactgtgacagttttatagtagctatcttatttgcataggtttttggagaacatatgatggaat

SEQ ID NO: 180590 - DNA, 601 bp, Human
tttctctagtagaaagaaagggaagcaattgttgattcgggtatcaagctgccagttactggctattgactttgggctaaccacttaagtaacaattcgatttccttatttgaagactatggggttagtgggaaggttttcaatagcactaggattttgtcattttgtaattagtttttctatgtgctcttttcatacccaaccatagtttttacagatcattgaattatcacattgattctatcacattaattcttttgttcttaatttacttaaagaacacgtttttaccccttgtggrattactggtaaatataacattgaatttctttttttccccaatagatgcaatataggaatgtacttatattctccttaatttagaaattcattttaaaataaaagattaatttacctcataataatgcaaagttgtttttttttttttttttaggttttctttttttgagtgcttggttgtttggagcttagttgtttttttggtgggatgcgtgagagatttctaaaatagtgcttttaaacatttgccacagctccatggatagtttgttttaaaaaatactttcccccccaacttagt

SEQ ID NO: 180591 - DNA, 601 bp, Human
tttttgagtgcttggttgtttggagcttagttgtttttttggtgggatgcgtgagagatttctaaaatagtgcttttaaacatttgccacagctccatggatagtttgttttaaaaaatactttcccccccaacttagtcttaagtagaatttttcttctaaaattgaacagtggagtcaattattttatttgtccaccttctccctgcctggggtactgtttctttaactggtgttaaccaaccctctgtgtccatgaatgtattctgagagttctcacattttctatgagatttaaaayttggggttttactgtcaacgataatcttgagaaggtaatataagctttttctgggtcatctgaatcatttgccatgcaactagatactaccacatggtaaaattagtgttggtgtttattattgtgttcatggtaatgtgaaggccaactacttcatattatctgaagtgtatgaggctttcactgagattcaaataacaaacagtgctaggagcatccctgcttgccacacccaaaagaacctgcattatagagataacattcaagttgtaggcagaagaaagattacattttttaata

SEQ ID NO: 180592 - DNA, 601 bp, Human
tgacttttctccttttctgtcattaaaaaaattaatttctctaatacatggctacctaaaatcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccgcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaaga

SEQ ID NO: 180593 - DNA, 601 bp, Human
tcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccrcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaagaatctttatatttgggtgggcctatagtctctcttcactgtcagattttctaattgtttaaa

SEQ ID NO: 180594 - DNA, 601 bp, Human
taatatgtggtggattaggtgtgagtaaggggaacaccattttccctttactactttcaacttaggtgttaatatttggtaactctaataataaggtgactataacccttggtttacccaggttagtcctgtttgcctagaaatacccagtttaagcctgttgaaaatcagttagcttaggagaaatacctaatgtaaatgatgagttaatgggtgcagcacaccagcatggcacatgtatacatatgtaacaaacctgcacattgtgcacatgtaccctagaacttaaagtataaaaaaacccaaaaaaacaacaaaaaaactatcttctcaactagtacagagactagattaaaaaaaaatcagttagcatctaacatctgttaattatttttagtaactcctcacagtctcagaagtatcccagtttgtatcccaatacaagataaactgtattgtcattctacttagtaattttttaaatttgcgtgcatattcattatttaagcatttttctggcctgtctaatgaatagaatgttctgttttccattttttaagaggcagaaatggtcttctggattagctttgtatttttgctt

SEQ ID NO: 180595 - DNA, 601 bp, Human
cctgaggaaacacaacttgcttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgsaatgcagtggtgtgatcttggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtcta

SEQ ID NO: 180596 - DNA, 601 bp, Human
cttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgcaatgcagtggtgtgatctyggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtctatagttgtggctgaatgtta

SEQ ID NO: 180597 - DNA, 601 bp, Human
gatcctcccaccttagcctcctgagtagctgggactacaggcacgtgccaccacacccggctaatgtttttattgtattttttgtagagatggggttttgctgtagggtcttgaactcctgggctcaagtgattctccgaaagtggtgggattacaggtgtgagccatagcgcctggcttcttctctcttttatagcaccgtttctccatataattgtcactactcattgtcttcaatttctctgcttctattctctattctcacttgaagtcactgcaattaagctttttttttttttttctcttctctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatccca

SEQ ID NO: 180598 - DNA, 601 bp, Human
agtccttttgcaggacaaggcttatgaacgtcatggtcatccactgggcttaatttctttcaagagtcaagactccagtttatgcctacttttggcccttcaatgcctttaaatagttgtttgttttattttgcccagagtttataatcattaaatgtggaaaggatagtctgaaaaacgcaactctgacattacgttcagaacctcaataagatattttgtatagttttttcattattattcaatttaaaataccactttctaattttcattatagtttcttctttgagctgtgagttayttagctatttattaaaaaaaatttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaa

SEQ ID NO: 180599 - DNA, 601 bp, Human
ttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaactccatctcaaaaaaaaaaaaaattctaacataagaattttttgaatgatctttttattgatttctaacttaattacactatggtcagagaatatatgtaattttcatcttttaaaatttgttgagattggatttgtagtccagtatatggtcaattgatgtcagtgttttctgtttaattgaaaaggatttgtattctttgcttctgggtgcagtgtcctttgtatgtcagttaggccatgtttgttgaacatgtttaaatcatctctatttttcacactccctccttttttttggtatgccttttttgtcagttattaaga

SEQ ID NO: 180600 - DNA, 601 bp, Human; identical to SEQ ID NO: 17718

SEQ ID NO: 180601 - DNA, 601 bp, Human; identical to SEQ ID NO: 17719

SEQ ID NO: 180602 - DNA, 601 bp, Human
gtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatstagccattttatattttgattgtggaaacaaagaggaaatctgaagtggtagcaacaataaagggactatgtttaaccacatagtaggtgcttagtaaatatggattgaacagaaaagtaaatgagctcattttactaaatagtatatgtttccttttaactaaagtgaccataaaggtcttccttcatttaaatcaggatacctttgactgtgaaggaggtgctgttaacaattatgctgtgctgtcaggtctatgctgggatgactgtgtaaagcaaactaaggtgtttggtcatcct

SEQ ID NO: 180603 - DNA, 601 bp, Human
caaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcaytgttcatttctattacaataatatcttacaactgtacaatattagaacattactactaaataatgaacattgtcattacatcatatgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacaccca

SEQ ID NO: 180604 - DNA, 601 bp, Human
tttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcattgttcatttctattacaataatatcttacaactgtacaatattagaacattactactaaataatgaacattgtcattacatcataygaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaatctgaggcgtgtacagtattgtttaataagtagcatttcattgtatgaatagatcacaattaattcatggcccatgcaactg

SEQ ID NO: 180605 - DNA, 601 bp, Human
taattcatggcccatgcaactgggcttctgtttcaatgtatccattcctctgtgatgagtttttcaaagtggatgtgtcattttacactttcattggagatttttcagagttcctgttgctcttaagtttaaaaacagattttaaattgactctagatttatatggactctattatagtctgtatcccattatgtaataaaaatgaatgtaagaatttaaaattttgaagtgaataggaaaatatcaatgatatattgtgaatagctttttgatgaaaaggatttctaatactttggatawcctgtggctattatagttataatgccagccagctgttatagccaatcagtaaagaaattttgcagtatttaataaatggcaactgagtaagaaagatttgaaaaagtaatatttactttgctgcaaattttgaaaccagaattggtcaggcaaatacatttacaggattctagctaagagaatgcacttgaaaaatttgtcctaggcttggccctgggagagattatgaaagaccctgatgaggttcagtattcaaaaggtttccagaaatttccccatgcttgatcatgtatcatttca

SEQ ID NO: 180606 - DNA, 601 bp, Human
ggatactgagaaggtctaaatacatctaaggaaacaaacatgagtgtttttcctaataatatttatcagcaaaattttgctgataaaaaagtgattccctggcatatttttgccattttgcctcatcagaactaaaccagtgcagtaggaaatatttcagggaagcatcaactactgcctgcttttccctcctgtagtactatcaaggtagagatgttattttctcaagtctggagtagtagtccatatataatctctaaaataaagtaggtaaaggatactaggtaaagggttccttagsaagctaaaggtaggcatcaacaagttaacttgtcaactttaaaaacaatttacctgtagtgtataattttaatctgtatccatatcatttatattactaaatcctgtttaagaatgattcacttacagaggtaaatgcaaggcttttgcttatggttgctgggcagagctctcactcactggttaacctgggcacctctgggtttcttcttttccttgtagaacatactctttccatgcttactgcccttatcttacccaatgtggttctgaaggggctgacagtcatctcatctgacct

SEQ ID NO: 180607 - DNA, 601 bp, Human
acattagcattgagatgtgaggtactgttttattcatcatgttgttgcctgaataccttttttttaaagttgtctttttttaataggccttgtgagatttatactttatagggaggttctattttggtatatttcaaggttttgtttcaagatttagaactccttttagaagttcttgtagtgctagcttggtagtggagaattctttcagcatttgtttatctgaaaaagactttatctctcctctatttatgaaggttagttttgcggcatacaaaattcttggctgataattattttrtttaaggaggctaaagataggaccctaatccctcttggcttgtagggtttctgctgagaaatctgctgttaatctgagaggttttcctttataggttacctgatgcttttgcctcacaactctgaagattctttcctttgtcttgactttagataacttgatgaccacgtgcctaggagatgatctttttgcaataaatttcccaggtgttctttgagctttttgtatttgaatgtctagatctctagcaaggacagggaagtttttctctattatcccctctaataagttttctgaact

SEQ ID NO: 180608 - DNA, 601 bp, Human
taatttgtaagccttgtctttgagctctgaagttctttcttctacttgttatagtctattgttgaaactttgcagtgtattttttatttctcttagtgtgtctttcatttccagaacttgtgactgttttttctttatgatatttatttctctgtataccttttcatccatatcctgcactgtttttttttaaattttctttaagttgtttttctaccttttctggtacctccttgagtaccttaataatcaaccttctgaattccttatctggcaatcagggatttttttcttcgtttgratctattgttggagagcgagtgtgatcttttgggggtgttacagaaccttgttttgccatattaccataattgcttttctggttccttctcattttggtagtgtttcagtggaaagaactggaactcaagggctgctgttcagattcttttgtcctgtgggctgatcccttgatgtgatgttctccccttcacctggagatgggacttcctgagagagctggactgcagttcttgttattgtctttcttgctttagccactcagcggggctgctgggctctgggctgatgctggggaatg

SEQ ID NO: 180609 - DNA, 601 bp, Human
aaattttagtagtataaaattttctttgcagtatcatttgattaaatgtgttaatacatgtatttggaatcatgcctgacacatagtaaatgcttaatacattttaatggtgttattaaaagttgttgctattattatcatataaaaatctcctatgatttattttaatattaacacttaaacctaagcttttatttagaatgttgggggcatgagaactaattagaagaagtattctaactcagtagagagggtaggggtaagggtctgtaaaacattagcaagtggggtcagctgatayttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcatacgagaaaatgctcaacatcacccatcattagagaaatgcaaatcaaaaccacagtgagataccatctcacaccag

SEQ ID NO: 180610 - DNA, 601 bp, Human
aagaagtattctaactcagtagagagggtaggggtaagggtctgtaaaacattagcaagtggggtcagctgatatttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcataygagaaaatgctcaacatcacccatcattagagaaatgcaaatcaaaaccacagtgagataccatctcacaccagtcagaatagctattattaaaaagtcagaaattaagagatgctggtgaagttgtggagaaaagggaacatttatacactgctggtggaaatgtcaactggtttagccattgtggaaagcagttttgtgttttctcaaagaacttaaaaaagaattaccattcaacccagcaatcccattattgaatatatgcccaaaggaatatgagtcattctaccataaagacac

SEQ ID NO: 180611 - DNA, 601 bp, Human
ttttctcattattgttaatatattggagttttatttcataaaaggtgaccttttcatctaagtgctatttataatttaaatctctgttaggtctttgttagttgtctgtcatcctcacacttgcccttctgtgttttcttctgtaattcatgggttggaagcaagtaaactgtattttcctcacccctttgctagctgagtttcattagagggtgggaggaaggtagaaaggacgccactgaggtttttgaggcacctttggtagtggcagttgaggagacttcgctgtgttgcagtgacsgttgttccacagtgtagatggcagcgatgttggtggcagggcatttaatagggatgggtctgctcagcagcagccaatggtggttccagcactgatagtggctcctgtgggctgttgggtccagctcagagatggtagcagcttcctgatccctggtttgcattgtttaaccatttgttactctagcccttccaaagtctttgtaacagattccctgaattaaattaaatttttctggagaggttgccctcgagaagagggtgctcatcaataaaatcaacagttgtcatttaatgttag

SEQ ID NO: 180612 - DNA, 601 bp, Human
atatagcatgtattccccgtatatctttcttacctgaaaataattgtgttttgtcagtgtgtcccagtgactttttctgtctcctctgcatttaggaagtcagtggacacagctagtgcttggtgtctagggggaattgttgctcctcatgggtaatattggatttatgaaaactgagggacttacattaccaaaagcatgatgtgaaaaatatattaaatatatactaatatttcaatgatttaaagtcatctacccaatagaagccactatatttcattgattctaagctaccccttcsccccctcatgttttaatatctctggtattggattgtgacttaaaaacagtagcatgttgcagtcatctcatccagtggccagtagttgctgttatctgcttatgtgccaatataaaaatcataatacagcttagaataaaattccagagacaccagagaaggtgtctcttttgacaagttgaagactcttttgacaaggagatgctaaatggttgtggtgaggtagaagggtggggaagtgggaaatcacagtagtttaacaacccttggaagcaggagtctaaagtaggctgtgcctaa

SEQ ID NO: 180613 - DNA, 601 bp, Human
agtgataataagaaaacattatcctctgaaacaataacagtataaaacatttacgaccttaaaatcatgttttatatgtacaagtatctcagtttaagaagtctcctggccaggcgtgatggctcacgcctgtaatcccagcactttgggaggccgaggctgacgaatcacctgaggtcaggagttcaaggccagcctggccaacatggcaaaaccctgtatctactaaaaaataaaaaaactagctgggtgtggtggcgggcacctgtaatcccagctactcaggaggctgagacaggakaattgcatgaacccaggaggtggagattgcagtgagccgggactgtgccactgcactctagcctgggcaacagagcgagactctgtctcaaaaaaaaaaaaaaaaaaagtctcctggttacatgaaagatattagctgattatgacttgatatatttagactgttgattggtcattggttttcatttagtggtcaagagtgtctagcaaaatgctgactggcatatgcagacactgaatttacatcttcacatattcatgtctctcaatattcagaactcagttaaatttatccaggaag

SEQ ID NO: 180614 - DNA, 601 bp, Human
tgaaagtctatattgtgttgtgggagcctcacccactgttgctcccaggagtcctctctggtttattcccttgggacactgagacttattataccaatttattttgtccaaacatgctctcaataatcactgtgggttaagtactaccaaaggttggcacttaattattattttatttattgaaagttaattttatcttctaattagatggtatcttcttgccagcgtggacaattctacagattttttttttgattacttggagacagaaacaaatatttttaatagtatcttgatttastctttctaatatagactgttaatctttagatttttcgataatttaaggtgaagggggaggaaaagattgggtacaactgtgtttagggaataatttaaaagtgattactagaagaaagtgcacttagttttcttgttcatatattctttcttatctctagcatcagtgctaaaagtaacagttggtatagaagtgaaaattgtcaaaaaaagactgattaataacctcaaagctgaaaggagattactaattcagaaaatgacagttgtaatatagaaatccaatattagtttatagttg

SEQ ID NO: 180615 - DNA, 601 bp, Human
cgtgtgcttctcaatggcaattcagtttttcaattcatattccagcatcttgcatgatgcctgcatatattgagtatgcagcaactattcaatgaaaaatgtatattaaacttggtatatatatatattatttacacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcktttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattc

SEQ ID NO: 180616 - DNA, 601 bp, Human
acacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtyactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagta

SEQ ID NO: 180617 - DNA, 601 bp, Human
tctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactstgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagtatctatgaattctagcttctctcaggtgacttgtttgccaaatttaaataaatggacatattaaaattaattcttattctcctgttctcaggataatgtttaagcaaatctaagaggaggtttttttttcttattgta

SEQ ID NO: 180618 - DNA, 601 bp, Human
tacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatctgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagac

SEQ ID NO: 180619 - DNA, 601 bp, Human; identical to SEQ ID NO: 17720

SEQ ID NO: 180620 - DNA, 601 bp, Human
tcaagagatgggaaagctccgggataggataggaatgacaggaccgagaactcctgggtgtggctctggctatatggagactggagtatctcaacagtgtctgactcctaggtgtgcgaagtgcaattacctgctaaagaacttgtctgatgttcagctctatacaattgtgtaatgggaagccctgatgcaacgtttaaagaaccgaaatcacagacgtgaagggaagggcacatctttcccagtttttgcaggtacagtgtaacatcagtgtaatagcgcatagaaacaaaaaaaaaaactgaagaaacactccattgaaaactgccttttaaccattttcagctgtaatggcttattaaatagcttatttcccagtgtcaaagttgagatcttctgaaaaagaacatacttttctaaagaagtgaatgcagtattaatgccaaataatcattttgtctctcacaaaaataattccagcatacgtttttcccaaaacataagccctatgtatcggactacattcatgctgtaaccactgtctaatttcctctaacaacaatgaacacaaaaactacaggagtacattttcatttcgaag

SEQ ID NO: 180621 - DNA, 601 bp, Human
caaggaaaggggaatgacagtgaccccctagactttgcaagatgcatgagggcagtgaccaagtgtcctcctttcctttccagagcctagaactgtgcctgtacatggcaagtaaatacggaaagaaatggtatcataagcctggcttccacatttcgtcatcctacagctctcctccctcttcctgtaccactcatcccttctttctgacccctccaaagttaattcaaggacccagcaagttatgttctaactgcaactaccaagtagacaatttttttcaccaaaatgcggggtactrtatctgcgaaaagagggccaatgccaatcattaccacccccaaccaacagacagcacccataccctgtgaacaacagctatttagaaacaaatggtcagaagatacatggcctcacaggagacacctggctttaccgtaagcatcctactaactctctagggtgtttatatgctaaatgtcaggtatgcaaaaaagctattaaacatttattaaaagcatgaataaatgaataatgtagataagttgggtattcatagattggggaatatttagattcatcagtttaaaaaatgtatata

SEQ ID NO: 180622 - DNA, 601 bp, Human
catgatatcaaggaaaggggaatgacagtgaccccctagactttgcaagatgcatgagggcagtgaccaagtgtcctcctttcctttccagagcctagaactgtgcctgtacatggcaagtaaatacggaaagaaatggtatcataagcctggcttccacatttcgtcatcctacagctctcctccctcttcctgtaccactcatcccttctttctgacccctccaaagttaattcaaggacccagcaagttatgttctaactgcaactaccaagtagacaatttttttcaccaaaatgcrgggtactgtatctgcgaaaagagggccaatgccaatcattaccacccccaaccaacagacagcacccataccctgtgaacaacagctatttagaaacaaatggtcagaagatacatggcctcacaggagacacctggctttaccgtaagcatcctactaactctctagggtgtttatatgctaaatgtcaggtatgcaaaaaagctattaaacatttattaaaagcatgaataaatgaataatgtagataagttgggtattcatagattggggaatatttagattcatcagtttaaaaaa

SEQ ID NO: 180623 - DNA, 601 bp, Human
agctgttccccttgcctttgacaccttttgccctagtatgcctctccaaatactctgacagtactcacatcaactcctcattcaagggtagagggaagtaaactgtggtgaaacagctaaaatattctaaaaacaactgtatattcctttcacttaggagaagtagagatgagaagagcagggaaggacttttctgatcttccctaggccccagctagtcctgagtctgacagatcacactgcctccagaccatgatatcaaggaaaggggaatgacagtgaccccctagactttgcaagmtgcatgagggcagtgaccaagtgtcctcctttcctttccagagcctagaactgtgcctgtacatggcaagtaaatacggaaagaaatggtatcataagcctggcttccacatttcgtcatcctacagctctcctccctcttcctgtaccactcatcccttctttctgacccctccaaagttaattcaaggacccagcaagttatgttctaactgcaactaccaagtagacaatttttttcaccaaaatgcggggtactgtatctgcgaaaagagggccaatgccaatcattaccaccccc

SEQ ID NO: 180624 - DNA, 601 bp, Human
aaaaactaaacattaactgtgacgaataataaaattaatgtaagcatactgtacaatacttaaaatacatgctcctctgggacctagcaatccctaagacaaacctgcttttacttcagcttatttgagctgagttaaacatcccctcccactagcccccagcttcatcaaacctggatgactcactggcctgacccttaagcaccttcccagtttccatggttttcagtcaagctgttccccttgcctttgacaccttttgccctagtatgcctctccaaatactctgacagtactcacrtcaactcctcattcaagggtagagggaagtaaactgtggtgaaacagctaaaatattctaaaaacaactgtatattcctttcacttaggagaagtagagatgagaagagcagggaaggacttttctgatcttccctaggccccagctagtcctgagtctgacagatcacactgcctccagaccatgatatcaaggaaaggggaatgacagtgaccccctagactttgcaagatgcatgagggcagtgaccaagtgtcctcctttcctttccagagcctagaactgtgcctgtacatggca

SEQ ID NO: 180625 - DNA, 601 bp, Human
cagaataataagtggcttaacaaatgaaaatacttacgttaataatgttaaatcatttacaggtgacattatccacaggacttgagcaaaaaaataagaaaacaaattgaatttttaaaggatgaccaagtgctctgtggctcttaagtttacaaaagtgccatctgatataattatctgcataattcttaaaactttgtcttcctaagccaaagaatctaagttaaaatagttaaaactgtgtcctgacacccgttttagaacctgcattgtttaccctcctggaattccatctgcaatwggatgttttactttatgctatcattggggaatggataagagcattagctattaaagtctagcagtctaccaccaaaaatcaaactgtggtgaaggaaaagacaataaaaaccaaaccaaaacaaaaaaccataaaatggcatggacatcccagaggcttcaaggagcttatgagtaaaggataattaggacgtcactgaaaacagtgaccaagggagatcccatgttaggagctggtgatgtttctttctttcttttttttttttaattagctgcctacaacttggaatcagaatgtctt

SEQ ID NO: 180626 - DNA, 601 bp, Human
actgaaggatcaagcgagaaagttaatgtggaccttggctttaaaaggccatgtgtttcctcccatctcctttctgaaatccaaacccacatgattttaaaatatatattctaatagaaaataaaacaatagtaccttcgtttgttaacaggcaaaatgtcctgataatgaagacgaaaaaaacatctaaagtgaaaaaagatagactgttacactactcatttcggtgtgctaatatatgcctaattcagaataataagtggcttaacaaatgaaaatacttacgttaataatgttaaakcatttacaggtgacattatccacaggacttgagcaaaaaaataagaaaacaaattgaatttttaaaggatgaccaagtgctctgtggctcttaagtttacaaaagtgccatctgatataattatctgcataattcttaaaactttgtcttcctaagccaaagaatctaagttaaaatagttaaaactgtgtcctgacacccgttttagaacctgcattgtttaccctcctggaattccatctgcaataggatgttttactttatgctatcattggggaatggataagagcattagctatt

SEQ ID NO: 180627 - DNA, 601 bp, Human
aactctatacctattaaacaagtcatcagttctccttctccccaggccctagcaaacatctttctactttctgtttctattaatttgactactttatttatttatttatttatttatttatttatttattgggccaggatcttactctgtcacccaggctggagtgcagtggcacaattatggttcactgaagccttcacctcccaggttcaagtgatccttctccctcagccttctcaatagctgagactagaggcatatggcaccaggcctggctaatttttaatatttttttgttgcycatgttggtcttgaactcctgggctcaagtgatccttgagcctccacctcccaaagtgctagcattataggcatgagccactgggcccagcccgaatttgactacagtagagggtccatataagtggaaccataatgccacatacataattatctttttgtgactagactatttcacttagtaacaaggttcatctatgttgtagcacatgtcagaatttctttcctttttaagactgaataatattccattgtatgtatataccacgttgcgtttatccatttatccaacattggacat

SEQ ID NO: 180628 - DNA, 601 bp, Human
ctctctggaacttttctatcttgaaaaactgaaactctatacctattaaacaagtcatcagttctccttctccccaggccctagcaaacatctttctactttctgtttctattaatttgactactttatttatttatttatttatttatttatttatttattgggccaggatcttactctgtcacccaggctggagtgcagtggcacaattatggttcactgaagccttcacctcccaggttcaagtgatccttctccctcagccttctcaatagctgagactagaggcatatggcaccargcctggctaatttttaatatttttttgttgcccatgttggtcttgaactcctgggctcaagtgatccttgagcctccacctcccaaagtgctagcattataggcatgagccactgggcccagcccgaatttgactacagtagagggtccatataagtggaaccataatgccacatacataattatctttttgtgactagactatttcacttagtaacaaggttcatctatgttgtagcacatgtcagaatttctttcctttttaagactgaataatattccattgtatgtatataccacg

SEQ ID NO: 180629 - DNA, 601 bp, Human
aaatatcactttgtagtttaatctcatacaccagcctttatagcacctttgaatatttagatgtctttctttagatgatctttggtaatattatgactttgttcagatttagtattctaaacagtgatactctgtagataacaataaaagaaaaggtaaaataaaagagaaacacagattacaggcctgattatttctttcttgcttggctagtgtgacgggaagacaagagcactgggctagggacaaaacaacccatgcacattcatttgcactatagtgaccacctacaaaagttacrtaacttctgtaaatctcaaagacttctaaatatatggaaaaaatgccttcaaggcctatctcccagagttattgtgaagttgtttgtaaaaccataaagcaaaatacaaagctaaagttttctttcttgttatttgctactttctagccactcggattttttttaagccaacagctatatagtctctttataaagtcattttactttaaattgaaaaaataaagaagaattgactgttttaccattgagcactaaagagatcatttctacaggtgctaatgtattaattttataatatat

SEQ ID NO: 180630 - DNA, 601 bp, Human
cgtttcctggaagccaagatcagaatacaagtagtttccttctctccttgtttccaattttgctgggcttctcagaaaaagtagtcataaaacttaatctgggagttccaagttcaaccatccacccaatgctgccaatgaactcaaagctttaagaaaattgaaatggtgtttccctttagcaaaaaagatggaagataccattagagtgtgtgagtgtgtgagttaatgggaactttagccaaaatcttcccttgactctaacagttctataagttgaatagccactgggtaaaatackgttagtcctgaatgaatttcattatcctttcactaacaagtttctagctcttgtattatgcaatttggcaaatactttcataattcactttgaatacactttttttaaacaatcctacaccgtcatatggaagttaaccatcttctcaggctaaatatcgcattttgtattctacatatattcacatatttgtgtatgtatatagtatatgaataaatatcactttgtagtttaatctcatacaccagcctttatagcacctttgaatatttagatgtctttctttagatgatctttggt

SEQ ID NO: 180631 - DNA, 601 bp, Human
cagagggaaaaagaattttcattgcaagtttgcctgaatagagatcataataatggtagaaagtgagagaaattataaaatttcctagagcaagcaaaaaataagaacagattcagaagctgtaaaggagaaaagacagttaacacagatgagagaatcaatgtgtgattcgagctgaaggctggttaccctgggatttaatttgacagggttagtattagatgaatcaggttcagggaaagtcagtttactcacctggaaaatggggataataacggtaccgagcccaatggaatatgargactaaatgtgataatacatataaaacactggacacagtgcctgacacttagtaagcatccaataaatgttcactattattactgggcaataaaatggtatttattgaataaataagtaggctatgttgcattataaaaaggtcactgttgggaaggagaaagatcttgatcctattccaactctgttactttctagctatgtagctttgagtctatttcttcatctatagatggttaaataatatctaacttatagagatgatctgaaaattaaatataaggtgtatcaaatacagtac

SEQ ID NO: 180632 - DNA, 601 bp, Human
gaagaatagcatgatcagtttcctgtatagtcagcatgattagcagggaaaatttctgttctaacccctatgtactcaaaaaagaggatggaaggtttgagtttggaagagcacctggatgaatgggaggaaagggtagcttttgcagaatgcaggggtagataaggcagaggctgggctaaaaaatggcaaagaagtcagaatgtgatgggcagacaggagggaacagagaccttcaccagtgaaagaggggaaagctgcaatgtctcaaggtatgagggagcaggtgccctgagagtcrttcagcacagggttaaaacaagatgtctcctctaactcagttctataacagttacccaagagcctgaaagaatggaggacagagttaaaaagcagagggaaaaagaattttcattgcaagtttgcctgaatagagatcataataatggtagaaagtgagagaaattataaaatttcctagagcaagcaaaaaataagaacagattcagaagctgtaaaggagaaaagacagttaacacagatgagagaatcaatgtgtgattcgagctgaaggctggttaccctgggatttaatttgaca

SEQ ID NO: 180633 - DNA, 601 bp, Human
gaggtgaaaaaggcagaactagaagagaagggcccttcaaatacaactggacaaatgaggcaggtaatgaacaatctgagacacactctagaaacaaacagatcctgaaggtggtgggtgaagaatagcatgatcagtttcctgtatagtcagcatgattagcagggaaaatttctgttctaacccctatgtactcaaaaaagaggatggaaggtttgagtttggaagagcacctggatgaatgggaggaaagggtagcttttgcagaatgcaggggtagataaggcagaggctgggctamaaaatggcaaagaagtcagaatgtgatgggcagacaggagggaacagagaccttcaccagtgaaagaggggaaagctgcaatgtctcaaggtatgagggagcaggtgccctgagagtcattcagcacagggttaaaacaagatgtctcctctaactcagttctataacagttacccaagagcctgaaagaatggaggacagagttaaaaagcagagggaaaaagaattttcattgcaagtttgcctgaatagagatcataataatggtagaaagtgagagaaattataaaatttcctaga

SEQ ID NO: 180634 - DNA, 601 bp, Human
taggttcaaatctaaaatgtgatgcttaatatattcctcaagccatgtctatcagtgaggtgaaaaaggcagaactagaagagaagggcccttcaaatacaactggacaaatgaggcaggtaatgaacaatctgagacacactctagaaacaaacagatcctgaaggtggtgggtgaagaatagcatgatcagtttcctgtatagtcagcatgattagcagggaaaatttctgttctaacccctatgtactcaaaaaagaggatggaaggtttgagtttggaagagcacctggatgaatgsgaggaaagggtagcttttgcagaatgcaggggtagataaggcagaggctgggctaaaaaatggcaaagaagtcagaatgtgatgggcagacaggagggaacagagaccttcaccagtgaaagaggggaaagctgcaatgtctcaaggtatgagggagcaggtgccctgagagtcattcagcacagggttaaaacaagatgtctcctctaactcagttctataacagttacccaagagcctgaaagaatggaggacagagttaaaaagcagagggaaaaagaattttcattgcaagtttgc

SEQ ID NO: 180635 - DNA, 601 bp, Human
accactaatatactaagtgatattaaaaatccatttgcctttactgattacacaaaaaggttacctattagtatgtcacactgtacactgcaagtaccccaaagggtaactgtagtctttttcttaaggaaatagtcaatgtcttcctccatttcttataaatgtcacgagggccaatgctacagcccttgttccttgctgtatctctgttaacaatgtcaggtatgtaagagtcttcaaaacatttgttaaaagaaattttcaatgaaaactgtagacaacggttgtcaagaagagtctkggaaagagcttatttctaacaaacggagtaaactctatacatcttaaaggcctctcctaggttcaaatctaaaatgtgatgcttaatatattcctcaagccatgtctatcagtgaggtgaaaaaggcagaactagaagagaagggcccttcaaatacaactggacaaatgaggcaggtaatgaacaatctgagacacactctagaaacaaacagatcctgaaggtggtgggtgaagaatagcatgatcagtttcctgtatagtcagcatgattagcagggaaaatttctgttctaacccc

SEQ ID NO: 180636 - DNA, 601 bp, Human
aaacatctggctactgatcaccactaatatactaagtgatattaaaaatccatttgcctttactgattacacaaaaaggttacctattagtatgtcacactgtacactgcaagtaccccaaagggtaactgtagtctttttcttaaggaaatagtcaatgtcttcctccatttcttataaatgtcacgagggccaatgctacagcccttgttccttgctgtatctctgttaacaatgtcaggtatgtaagagtcttcaaaacatttgttaaaagaaattttcaatgaaaactgtagacaayggttgtcaagaagagtctgggaaagagcttatttctaacaaacggagtaaactctatacatcttaaaggcctctcctaggttcaaatctaaaatgtgatgcttaatatattcctcaagccatgtctatcagtgaggtgaaaaaggcagaactagaagagaagggcccttcaaatacaactggacaaatgaggcaggtaatgaacaatctgagacacactctagaaacaaacagatcctgaaggtggtgggtgaagaatagcatgatcagtttcctgtatagtcagcatgattagcaggga

SEQ ID NO: 180637 - DNA, 601 bp, Human
ggaaatcatcttagatgatggcaaggggagtcacatggagtagaggcagcttgatacagggagagggacaagacttgaattaaaaacctaaattctagctctgtcatttattttctagccccatgatgatgaacctgaaactcagagccactattttcgcatgtgtaaagtgaaggtgataataagattaaccaaatcattggcccttttgattcaggtaaaatgagcaacagttactgatcaatataatacggttccagaagacacacaaaattcctgttaggataaaaaataattaaawctaaatacatctagcatttgatttttacattaataacttaagcatgtttaaaacttcttctttttccataacagtacacagcagtagattgcaaaacaaattaggaatactccattcccttgttattcaaagtagagtccatgcaccagcagaaaagcatcacctggaaccttacaagaaatgcagaatctcaggcctcaccccagaactactaaatcagaatctgcattttaataagattccacagtgactttacacattaaagtctaaggagcactgctctggtctactcagaaatgt

SEQ ID NO: 180638 - DNA, 601 bp, Human
ttcaaagagaaaagttaaaccaaattaaataaaaattaccatgaataattaaacttagaagagtttacactgagaataaaaaaacattttatgacatagactgagaagacattttataattctgtatttatttattcaggagataaaatacataaaaattctcactctgatttttaaaattatttagagaggctatttttaaaaactccttttcatgacaatataaaccagattttaataaataataaaatgcctgtaatctaatagttttcaactaacccaggtaacttctacttaatayacaaacaactataattaatacttacaacaaattatcagtatgtttattaaagcaacttccttaaaaacctctaatagaccaattttttttctgatttcttttaaagctttttgcaaatcaggatctccaccagtcagaatgaactatcttccccaagtaagctaagctaataaagttttactataatctcccaaaagaaaaaacagtaattaaaaaaattttagaacacccaaacccctagaagaactaaagaaaaggtatacaagaatacagtaggaaatcatcttagatgatggcaag

SEQ ID NO: 180639 - DNA, 601 bp, Human
ttttggctttcaaaagatcatggtagaggcagtggggtgtggactgaggggaaggggatatgtcaagaggcaggaaaaccaactgcatcagtggttctcaatacttgtctaccactagactacccatgtaagaatcatgtgcttgctaaaattatagattcccaggtcctactgaatcaaaatctctgcgggtgggactggacactatgatctgagctcccccaggtgattctgacaggcaggcagacttggagaccactaggacataagagatgatggaaacctgggttagggagctgcrctggcaatgaacaggataggtagatacgaaggtttcgtgggtaaaatctacagactccacgactgttgtggatgtgagagaagagagtcaaagaaaagttcaggattactcccagatttctggtctatctggcaacacagacagtgaagtcatgatccataacagagtaaaggaagaggagcagatctgggagaaactgatcaggtgaatgttgaacatctcgcatctgagctacttttgggacagctaggtggaggcgtccagtagcctctggagctgcagaggaactgccagggctgt

SEQ ID NO: 180640 - DNA, 601 bp, Human
tgagagaactgaatgtataagcagcccagaagcaagaaataaaacaatctggaaactaagcagacatgatgaagaggatatatacaaaggaagagggcaggaaatgactgtgatgatcccctaggaggtcttacaaactacactgaggatgctggaatttatcatgtagataatgaagagatatttgattgtttttgtttgtttgtttgtttgtttgttttgggactgggtctggctctgttgcccagactagaatgcagtggcatgatctcagctcactgcagcctccacctccagggcktaagcgattttcgtgcctcagccacccaagtagcttggactacaggtgcatgccacaacacccagctaatttttgtgttttttgtagagacgaggattcgccatgttgctcaggctggccctgaacccctgagctcaagcaacccacctacctcagcctcccaaagtgctgggattacagtcatgagccaccacacccagccagttttggctttcaaaagatcatggtagaggcagtggggtgtggactgaggggaaggggatatgtcaagaggcaggaaaaccaactgcatcagtggtt

SEQ ID NO: 180641 - DNA, 601 bp, Human
catagcatggtggaatagatggtaagtcatatactccaaagtcatatactactcctttgcagcaaagtgattttggccagatcacttggtccctgatctctcaatgctcaactagcagaggaagagacagacatgagaattcaactgctatgcagtgtgatgagtgttatgtcagaggagtgtcttatgaacagtggtaggacagaaaaggggagaaggcagggtataaacacagacatttgaactttttttcaaagaagaggaatttgacaagcagacagggagaaaagtcttttttcasggggcagaattagaaagacctacaaaagttcccttagtacaatgacaagatataagcaaatgagaatatctgaataccctgagagaactgaatgtataagcagcccagaagcaagaaataaaacaatctggaaactaagcagacatgatgaagaggatatatacaaaggaagagggcaggaaatgactgtgatgatcccctaggaggtcttacaaactacactgaggatgctggaatttatcatgtagataatgaagagatatttgattgtttttgtttgtttgtttgtttgtttgtttt

SEQ ID NO: 180642 - DNA, 601 bp, Human
tgaccagagcacctgcacatgttactattccattacagcactcattacactgtccagtgaccttcttttaaactgttttctccctgaaaagaggggctgggtgtttcattcttgtattgcaaggcctatcaaagtacctaaaaatatatttgatgaataaataaagagtagataattttttcacactattcctctattctctatcctttctgccaaatccaaaagcacatttgttgatattcaaggtttcctcagtgtccaagaacccttcctagagcttttcccagatcctcctctatgytggcataataactttatcctcaagtcaacaactcatcaacctagtatttagtgaatatatgtgctctacaaagctcaatgaccttttacttcattccttactccaggggaaaaaagcaatgccctcacttctttgcccaacaatgcaaggcatgcattcattcaacaaccacttaacaaatccctgttttcagcctataaaaggccacattttacaccatacccttctcaaattagcccttctagttcagcagggtcagagagctttcaaaaattcagcctcccaggattatcatggaag

SEQ ID NO: 180643 - DNA, 601 bp, Human
ctgtaaaactggatgggaagtaggtgaaccagattagtgcttctccagtttcaatgagaaaacgaatcaccaggttggggaggggggcgggtgggcatggtaaaaatgcagattttgagacagtgggtcagatatgcagcccatttcttttcttttcttttttcttttttgagacagagtctcgttgtgtcacctaggctggagtaaagtagcacgatctccgtccactgcaggctcagcctcctgagctcaagccatcctcccacctcagactcccaagtagctggtcctacaggcacaygccaacacaccctattactttttgtattttttgtagagacaggattttgtcatgctgcctaggctggtctcaaactcctaaactcaagcaatccatccaccttggcctcccaaagtgttaggattacaggcgtgagccaccatgcccagcccatgcagcccatttctaagaagaccacattttccaggaagctctaactgatgctatgccattattccatggaccatccccttttgagcagtaacaaactacatgatcatttaggtttattttaacttctgaaaattgttacttttaaaa

SEQ ID NO: 180644 - DNA, 601 bp, Human
tgccacaaattataagtaaataaaaatgttcattcttttttatatatagtgtggtgcactgttgttctctcattcaacagagaatttccaaaagagagaaggaaagaggcactagtaagaagccaccatgaccagctgactggctgagttctaacactggctctgctactgtgcataggaccttaggagcacaatctatcttcatttcctccatctgtaaaactggatgggaagtaggtgaaccagattagtgcttctccagtttcaatgagaaaacgaatcaccaggttggggaggggggcgggtgggcatggtaaaaatgcagattttgagacagtgggtcagatatgcagcccatttcttttcttttcttttttcttttttgagacagagtctcgttgtgtcacctaggctggagtaaagtagcacgatctccgtccactgcaggctcagcctcctgagctcaagccatcctcccacctcagactcccaagtagctggtcctacaggcacacgccaacacaccctattactttttgtattttttgtagagacaggattttgtcatgctgcctaggctggtctcaaactcctaaactca

SEQ ID NO: 180645 - DNA, 601 bp, Human
accaaagaaacaatactgactcctgcaagtggcttttgaaaattatgcttcattacttatgtcacacattatgttttacagagaccctacagaacaaaaacaagaaataaagcgcactaaaaacagaggtggttatcttgggatgaaaagttaatgaaaaacttcatacacagaaaataaatatgttaaggaaacatttgtcttccatattatacacgtgaaatttatcagggcagcttggaggctgctctgtgtgtccactcctaaagcaggcaagaatgtaactggagaggtacgtacrgggcgatggtagccatttgctgaaatatctcgagacactgaagacaagagtacaggggcactgagagattaagttagggttaattacaattctataatgtaaacagtcaccatattcaagacatttttctaactttttcattgagaacatgcacctattttattcccatgaataactaacttgaatgtttttctctagagctgtaaatcgcataacttacatatgtgtaactatatatataaaatgcaacacattattttacttaaaatgaattgattgtccagcatattcaaatacaca

SEQ ID NO: 180646 - DNA, 601 bp, Human
taaaaaccaaagaaacaatactgactcctgcaagtggcttttgaaaattatgcttcattacttatgtcacacattatgttttacagagaccctacagaacaaaaacaagaaataaagcgcactaaaaacagaggtggttatcttgggatgaaaagttaatgaaaaacttcatacacagaaaataaatatgttaaggaaacatttgtcttccatattatacacgtgaaatttatcagggcagcttggaggctgctctgtgtgtccactcctaaagcaggcaagaatgtaactggagaggtatgtacggggcgatggtagccatttgctgaaatatctcgagacactgaagacaagagtacaggggcactgagagattaagttagggttaattacaattctataatgtaaacagtcaccatattcaagacatttttctaactttttcattgagaacatgcacctattttattcccatgaataactaacttgaatgtttttctctagagctgtaaatcgcataacttacatatgtgtaactatatatataaaatgcaacacattattttacttaaaatgaattgattgtccagcatattcaaat

SEQ ID NO: 180647 - DNA, 601 bp, Human
atagagagaacaaaataccataaaattcattaatcagtaaatgttttataaaatacactttttaggaatcaagatgtttcaacttaatttcctaatttgactaaatacggatcactgtcctttgagtcccaacaaaaaatacatggtataaaaaccaaagaaacaatactgactcctgcaagtggcttttgaaaattatgcttcattacttatgtcacacattatgttttacagagaccctacagaacaaaaacaagaaataaagcgcactaaaaacagaggtggttatcttgggatgaawagttaatgaaaaacttcatacacagaaaataaatatgttaaggaaacatttgtcttccatattatacacgtgaaatttatcagggcagcttggaggctgctctgtgtgtccactcctaaagcaggcaagaatgtaactggagaggtacgtacggggcgatggtagccatttgctgaaatatctcgagacactgaagacaagagtacaggggcactgagagattaagttagggttaattacaattctataatgtaaacagtcaccatattcaagacatttttctaactttttcattgagaa

SEQ ID NO: 180648 - DNA, 601 bp, Human
aattccagcccaaaatacaacattatgtaataggatttacttgaaattggcatattttgatcagttaccaaaccagaaactactgaataagaattataaataaatagctgctactgtttactgagtgcttaatacgtgccaaacactatgcaaaaattatcttactttactccgataataacctgagatggtaggtatttaagtggggaaaacgaggctaagaaaagttaaataactttcaatgccagaacagctaataagggttactttagaatccagttggtcttattcaaaattccaytttaaacaactttcctatacctcatgtttaatatttttgttattcaaaagtgaaaaatgtcaaaaatgtacttttagagtagctaacagttatgtctgggtaaaatattacaatgatggttttacacattctcatttttaaatttccaataaccttggaaaattattaaagtgatcttaaaaacatacctctctgaagataaagaggttaagcaaaaccatcccaaaattatagataatgagcactagacgcatctgaaaaggttctcggtccttcatccattttggacccagccacaca

SEQ ID NO: 180649 - DNA, 601 bp, Human
cctttgaaaatgttgtggagaatttgctagtgcccagaaaagtatataatgattagtaacaacagctatatggcagttaattcattttaattccagcccaaaatacaacattatgtaataggatttacttgaaattggcatattttgatcagttaccaaaccagaaactactgaataagaattataaataaatagctgctactgtttactgagtgcttaatacgtgccaaacactatgcaaaaattatcttactttactccgataataacctgagatggtaggtatttaagtggggaaaaygaggctaagaaaagttaaataactttcaatgccagaacagctaataagggttactttagaatccagttggtcttattcaaaattccactttaaacaactttcctatacctcatgtttaatatttttgttattcaaaagtgaaaaatgtcaaaaatgtacttttagagtagctaacagttatgtctgggtaaaatattacaatgatggttttacacattctcatttttaaatttccaataaccttggaaaattattaaagtgatcttaaaaacatacctctctgaagataaagaggttaag

SEQ ID NO: 180650 - DNA, 601 bp, Human
aatctaaattaaaaatcacatgtaaattttatactgaacattgactctatctattaaatacttcacagtattaagagaaatttttattgctaggactcagatttcaaagttgtcctaccttaactggtttctatgtttgatccagagtggtttgcatctaacaaattaggtacaggtatccaaataaattaaagtgttcatgaagttgagactcgaggctaagttttcaagtaaagaaatatttctttttctaagaagagttattgtttattttcctagcattactagtcagttctctggsttcatacagaattttaatgagtctcttaggaaacaaattctttatacatatgcaatttaaaaaatggctgtgtcaatctagcctttaggatttcctttgaaaatgttgtggagaatttgctagtgcccagaaaagtatataatgattagtaacaacagctatatggcagttaattcattttaattccagcccaaaatacaacattatgtaataggatttacttgaaattggcatattttgatcagttaccaaaccagaaactactgaataagaattataaataaatagctgctactgttt

SEQ ID NO: 180651 - DNA, 601 bp, Human
tctctaaatgaatgttaaagaaactgtctcttaaaaaaaagtacattctatattttcacagactggggcctataaaaatcaaaccacttttactgattaagagtatttttaatgtacttaccctgacttcatgaacattattagaataatccacactctggcaaatatagctatatcccgcattatatgatcccatgaataactggaaaaagagtaataatatttgtagtaaagttttagtaaacacagcattaaaaacacaattatatacaaaatgtagcctttcaaattattttaaacrcaatattttctttaaaaatttcaaatgcattaaaaatttcatgcattccgattgctagaagttactgtgcattaatttgttctataattaaaatctaaattaaaaatcacatgtaaattttatactgaacattgactctatctattaaatacttcacagtattaagagaaatttttattgctaggactcagatttcaaagttgtcctaccttaactggtttctatgtttgatccagagtggtttgcatctaacaaattaggtacaggtatccaaataaattaaagtgttcatgaagttga

SEQ ID NO: 180652 - DNA, 601 bp, Human
agatacaaaaacaaattttaaattaagtactttttaaaaaagcatagttttactgactcataacaatctagtataatttcactatcatattaaagtacattttgccaggtgtggtggctcacacctgtaatctcagcactttgggaggctgaggcaagaggatcccttgcggctgggagttcaagaccagactgggcaacatagcaagaccctgtctctacaaaaagtaaaaaaatatctaggcatggtggggtacacccgtagtcccagctacttgggaggctgaggcagaaggatcaaytgagcccaggagtttgaggctgcagtgagctatgatcataccactgcacttcagtctgggggacagagcaagaaactgtctctaaatgaatgttaaagaaactgtctcttaaaaaaaagtacattctatattttcacagactggggcctataaaaatcaaaccacttttactgattaagagtatttttaatgtacttaccctgacttcatgaacattattagaataatccacactctggcaaatatagctatatcccgcattatatgatcccatgaataactggaaaaagagtaataata

SEQ ID NO: 180653 - DNA, 601 bp, Human
tacttttcctcactttcttaacacataacttggactctaagagtttctactcttgagcaaaaacaaacaaacaaaaatctaaaataatgtctttaaaataaacatgagacttctttgctttaacaagtactgcattctagtaattcaatgcatattcactcatgctgcaaaataaaaaacatttttgagatacaaaaacaaattttaaattaagtactttttaaaaaagcatagttttactgactcataacaatctagtataatttcactatcatattaaagtacattttgccaggtgtgrtggctcacacctgtaatctcagcactttgggaggctgaggcaagaggatcccttgcggctgggagttcaagaccagactgggcaacatagcaagaccctgtctctacaaaaagtaaaaaaatatctaggcatggtggggtacacccgtagtcccagctacttgggaggctgaggcagaaggatcaattgagcccaggagtttgaggctgcagtgagctatgatcataccactgcacttcagtctgggggacagagcaagaaactgtctctaaatgaatgttaaagaaactgtctcttaaa

SEQ ID NO: 180654 - DNA, 601 bp, Human
tatcctcctagattacagttctcataatagctcattttttaaagacttgaaaatttacatctgtaagtgagagtggtatttttaaacctttatcctaaaaatagtaatatgttgccccacccaagggtttttctatgcatactcccagaagtcagtcagtcaaacacttatccctgttcccttccctacggcaagcaagaagtcagccctccaactgaagagattctttggcaatagttatcagaagaaaatttttcatagccaatacatctgagtagtctctcattttctctcagtcacmttctaggttttatttcctccttagtcatttgtttacatggctgctgtctgccttctcaccctcactaaaatgccagccccacaaaggcagggcttttcacccctgtccccagtaccaacatatagtagatgctcaatacatatttaatgaataaataaaaccaacatgacaaccaagacaggtgatttttcatcagtccataagtcttctaatagggaaatgaagatacgtacataaaattgttaagtacattaaaccaattttgtctccagtcttgatgaatactgatatttatatatt

SEQ ID NO: 180655 - DNA, 601 bp, Human
taagcatcctatgtgcaaataacaattaaggcagtacataactaaaatctatttataagctttcatgtgttagggccctgtcagattcattcacagacaggcttaggtgttttagagttgaaggatccctttgcattttatacctgcacctggtatatgtcatgagatttttgtttgttttggcttttgcatttgaaaaacaaaattataattttaaagtatggggaaagaagaaacagaaagcatataagaaacaaagtatttacaaactgagaattatttactgaatttacttgaaaawtatcattaaaaatgatatgaattggttgaaaataagcttgaaatagttaactactcccagcaacactatagttaatattcactattatattagttctttaaaataaagtaactgtcaccattttggcatcgtaacctttaactagaaggaaagatacaatctcttatttctcctctatctggacctctacatttgccacaattcacataaaataacaacaaataagtctgcttagtttgcaaactgcactagatatctttaaataaactacaccaaaaagtgatacttcttggctacgta

SEQ ID NO: 180656 - DNA, 601 bp, Human
ttggagcatttggatttcagatgtttagattagggatgttcaatctgtattagggcaggagtgagctatgggctaagatggaaatcttcagatttgaggggctgtgtcttggtattctttggatcagaactactagacccgttccccatcaaaatattgttttctacctttagtcttggtttatgctcatctctggggcaaatctttaggtattaaagtagtcacagataaaaagcaaaagttatacttgcctcaaattttttaaaaaatgaaatgatggctgggtgtggtggctcatgcytgtaatcccaacactttggaaggccgaggcaggcggatcacaaggtcaagagatcgagaccatcctggccaacatggtgaaaccctgtctctactaaaaatacaaaaaattagctaggcgtggtggtgtgtgcctgtagtcccagctactcaggaggctgaggcaggagaatcgctggaacccgggaggtggaggttgcagtgagccgagatcgcgccactgcactccagcctggtgacagagcgagactccatctcaaaaaaaaaaaaaaaaaaaaaaaaaaaaagaaatgaacatgga

SEQ ID NO: 180657 - DNA, 601 bp, Human
taaagtgtgttctgcacttgtgttttgactgtgacccatcacatgaggtcaggtgtgtaattttccacctgtggtatcatgctggtgctcaaaaagttttgaattttggagcatttggatttcagatgtttagattagggatgttcaatctgtattagggcaggagtgagctatgggctaagatggaaatcttcagatttgaggggctgtgtcttggtattctttggatcagaactactagacccgttccccatcaaaatattgttttctacctttagtcttggtttatgctcatctctgrggcaaatctttaggtattaaagtagtcacagataaaaagcaaaagttatacttgcctcaaattttttaaaaaatgaaatgatggctgggtgtggtggctcatgcctgtaatcccaacactttggaaggccgaggcaggcggatcacaaggtcaagagatcgagaccatcctggccaacatggtgaaaccctgtctctactaaaaatacaaaaaattagctaggcgtggtggtgtgtgcctgtagtcccagctactcaggaggctgaggcaggagaatcgctggaacccgggaggtggagg

SEQ ID NO: 180658 - DNA, 601 bp, Human
tatatgagatatgttaaagactgaaaaatgaaataaaaaacaaaatttttaagcaaggacaagatgaagagaggtaataaaattttaagttaagaaaatcacctgtagggaaaaaatacatattatttttctattcatacataaatctacgtactttgtagcgtgcttagatctttaatcatcctttccacaaacatctttagagaatgttttccttagaggagtaagggctatgtctagtcttttaagcatattataaaaacaaagatttgctgggaccaataagtctatgaataggtcwtctagagtcaagtgggcataactgcgatatagctggaggataaagttaatttcataatagaaaattgtctaaaatgacattgcactttaaaattaatcaaatttaaacaatttcagtattttaccagaagaaactttggaagcatttaactcaccagttgcaacatagtcaggtatcgtttccaccaaagatatttctgaatccatgggccaaatgcagttaacccatagtatgagtacataatcacatggataaaggaattcaactgggctccaaaaaatgctttagaaaaacaacagg

SEQ ID NO: 180659 - DNA, 601 bp, Human
tagcatctgaaaggtacactaatgcacacactcagattgccacaaacagtcttactagcgggatgtgctgaaaactgtctggactaaagaccaccatttgaaaatatctgtctctgctctcttaaggacagtgttttagagaattacaaggagttctcttgcccttattcccttcctttgccccaccccttccttggctatgtgctttcttttcagctgtttagtctaaatatatgagatatgttaaagactgaaaaatgaaataaaaaacaaaatttttaagcaaggacaagatgaagaraggtaataaaattttaagttaagaaaatcacctgtagggaaaaaatacatattatttttctattcatacataaatctacgtactttgtagcgtgcttagatctttaatcatcctttccacaaacatctttagagaatgttttccttagaggagtaagggctatgtctagtcttttaagcatattataaaaacaaagatttgctgggaccaataagtctatgaataggtcatctagagtcaagtgggcataactgcgatatagctggaggataaagttaatttcataatagaaaattgtct

SEQ ID NO: 180660 - DNA, 601 bp, Human
cttaatgattgctttggtctggagaatatcaaggctaatttttaaaaaaaatgtttaaaataaaaacttcataaataaaacatctgggtatggtattaacactttactcagtctaagagttactaggacatagagcacatttgtcttttctccccacccccaagctctcctttgcttctgttttccctgaaattttatatgatatgggagtttttcctcactgtcaacaacagttaaggcccagttcaatttaatctccttttgcttttccatttttctgcttttttccattttctatcaygagttgtttttctgatttgctcacaccatttgctgaaataccattcatggctgtttttccagcttttggtttcttaggctctttgtatgtccgaatgtagaagttaagaaagagaaatatgaagctgattgcataggcaattagagcccagtgcatccatttggggaaggggcagtcagtgtaaagagacagtgccgtgtgcccaatggtcacatggaattgaatctgaaaaacagaaatgacagcacaaaacatttaatctgaatagtaaacaacttttaacaacatcggcatcttcta

SEQ ID NO: 180661 - DNA, 601 bp, Human
ttggacaagaaaatgtaacaccactgatttcagtcagtagataagataattagtaatttatcaaaataattcataaagaccgtttctgtgatcgtctaaaattcagaccgaagaatgagtgactataagatacatgaaaaatctcatcctttagacaactggatgtgaacagggggagaatccccaaagtcacttaatgattgctttggtctggagaatatcaaggctaatttttaaaaaaaatgtttaaaataaaaacttcataaataaaacatctgggtatggtattaacactttactsagtctaagagttactaggacatagagcacatttgtcttttctccccacccccaagctctcctttgcttctgttttccctgaaattttatatgatatgggagtttttcctcactgtcaacaacagttaaggcccagttcaatttaatctccttttgcttttccatttttctgcttttttccattttctatcatgagttgtttttctgatttgctcacaccatttgctgaaataccattcatggctgtttttccagcttttggtttcttaggctctttgtatgtccgaatgtagaagttaag

SEQ ID NO: 180662 - DNA, 601 bp, Human
ttaattaaaatttatttaattttaaatgttctttccaacggaagaggtaggtatatttccacatatgaaaaatcaggaacagccataaatcaaaacaaggaaagcctgataaaaatcaacatattctaacagcacataaatgtaactatcttatgatgttactaataaagacatgagttgtttcatgtttcaatcagacaataatcttaattttcataatatatttctgctactaacaggagtattcaaatgctgccttttcatcacaaaaaattgtttccccacagtgatttgtgcctcragtcatggtgatctctgggtcaccagacaagactttactgcaattctttcttattttcaccaacaccatcatcatcaagcctctaagattctacagagatcagcagattttaaaaatttaattacaaccaaaattatactctgactagaggtggagagatttgaccattccggtcagcaaatgaattcaaatgtgcaagtttaagtgtatacacattttcagctttggacaagaaaatgtaacaccactgatttcagtcagtagataagataattagtaatttatcaaaataattcataa

SEQ ID NO: 180663 - DNA, 601 bp, Human
cagtatctcattgaaatttattttgcatttcattaatgactaatgatactgaaccatcttttcacgtgcttatttaccatctgtgatggttaatactgagtgccaacttgattggattgaaggatgcaagtattgatcctgggtgtgtctgtgagggtgttgccaaaggacattaacacttgagtcagtgggctggggaaggcagacccacccttaattgggtgggcaccatctaatcagctgccagcgaatataagcaggcagaaaaacatgaaaaggcaagactggcttagcctccccrtctacatctttctcccatgctggatgcttcctgccctcgaacatcggactccaagttcttcagttttgagagtcggactggctctccctgctagcttgcagacggcctattgtgggactttgtgattgtgtaagttaatacttaataaactcctctctctctatatatatatatcctattagttctgtcgctctagagaaccctaagtaatacatcatccacacctcttctttggtaaagttttcaaatcttttatgcattttggtgaaaggcttgttttcttattaatgagttttgaga

SEQ ID NO: 180664 - DNA, 601 bp, Human
gattctgaatgcactttgccaagggcaagcacagaagatgattcccatttgcagggataaatcctttgtcattactcagccccaattttctcatgtatattgagaaatatacagtgttattttaaggagtaaaggagagaatacatgttaagtcccaggcacaggacctggcatgtaatattcagtaactgctatttattttattattattgcctgatggcacatattaacaataagtaccagaatcagaatttgaactcaggatgactcaaaacccacaaacacgaactacattctacartgccatccgtaaccagaaattgtgcagttcatcactgccaagagcctttctgattatactggaaaaaaaattctgaacgtgtttgagcagacggatcttctggttattctaaatgttctcttgctgctcaaaaaaatccaaagaatgctttctacaatgttctaagcatcttaatctctttttacccctctgagtcatgcctctgtaatattcatcgtatttcagttattaagataaacaaaacccatcactctttataaagagtaaatgactcacagttgaacttttaatatgttatag

SEQ ID NO: 180665 - DNA, 601 bp, Human
gctgtttcagttgtgaatgagaaatgttgacattgtacatattttctgtgatagtaaaatgactcacttcttcagaatgtgataaagattagaaaatgtgaaataatgagttattgtgaattaagtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcasctattcagagtaattaaagcattattcatccgtgcaattagtataatgttccataatgaattgctttgaactaaagtgtttggtataatactcgatatacggcttgaaacatagaaactctaggcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaata

SEQ ID NO: 180666 - DNA, 601 bp, Human
gaaaatgtgaaataatgagttattgtgaattaagtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcacctattcagagtaattaaagcattattcatccgtgcaattagtataatgttccataatgaattgctttgaactaaagtgtttggtataatastcgatatacggcttgaaacatagaaactctaggcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaataatttggatttctcctcctgtgtgttgtttttcataattcttcgcgaaaggccaggcaagctgcacacatcaagcgaaacgcctgaggggcg

SEQ ID NO: 180667 - DNA, 601 bp, Human
gtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcacctattcagagtaattaaagcattattcatccgtgcaattagtataatgttccataatgaattgctttgaactaaagtgtttggtataatactcgatatacggcttgaaacatagaaactctagrcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaataatttggatttctcctcctgtgtgttgtttttcataattcttcgcgaaaggccaggcaagctgcacacatcaagcgaaacgcctgaggggcggccagcgcgagggtttctggccatcgaccctca

SEQ ID NO: 180668 - DNA, 601 bp, Human
gagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcaytattttgcaaggttccagcatttacagggcatacgtcagaaacgtatttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggg

SEQ ID NO: 180669 - DNA, 601 bp, Human
tttttttttttttttttgagacagagtctcggtctgtcacccagggtgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccrcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaata

SEQ ID NO: 180670 - DNA, 601 bp, Human
atgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtrtaattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctat

SEQ ID NO: 180671 - DNA, 601 bp, Human
aggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcc

SEQ ID NO: 180672 - DNA, 601 bp, Human
taaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcrgtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctg

SEQ ID NO: 180673 - DNA, 601 bp, Human
gagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctrtttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccaccc

SEQ ID NO: 180674 - DNA, 601 bp, Human
cccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaarggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgta

SEQ ID NO: 180675 - DNA, 601 bp, Human
ttcttgagagagcttaaagggatttttaaggcagtttccctctcaagctgtcacctcctccacttggataaaaacagtgaaggatttgtcttgttgggctgttaagaaaccgtcagcttgtggtgattttagcctctgttatgggtccagagtccactccctcaggctccattgattctgtgtcgaatgcctgtggctggatatcaggaggacacctgtttttgtcagcccaactcttttcatgagtgaaaagtaacaagggagacaagatgaattcagaaaaacaaacaaacaaacaaamaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcg

SEQ ID NO: 180676 - DNA, 601 bp, Human
tacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcrtgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagct

SEQ ID NO: 180677 - DNA, 601 bp, Human
cacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacatargcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagcct

SEQ ID NO: 180678 - DNA, 601 bp, Human
ggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactwgctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacg

SEQ ID NO: 180679 - DNA, 601 bp, Human
aacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccycctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgagggaggcacaaatggctattttggaccactctagcagccctttacggacccaagtcctccgctgacccttcacccaataacaagctcatttagcaaatatctgttatgtggcaacgaacagctgggccctgttcca

SEQ ID NO: 180680 - DNA, 601 bp, Human
cctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacrtgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttg

SEQ ID NO: 180681 - DNA, 601 bp, Human
ttaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgaggktgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactg

SEQ ID NO: 180682 - DNA, 601 bp, Human
gcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatrcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagat

SEQ ID NO: 180683 - DNA, 601 bp, Human
cgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcrtcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgt

SEQ ID NO: 180684 - DNA, 601 bp, Human
ataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccrtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacag

SEQ ID NO: 180685 - DNA, 601 bp, Human
gaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggygtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagt

SEQ ID NO: 180686 - DNA, 601 bp, Human
tcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagacygggcttgagcaatctgcctgcctcagcctcctgagtagctgggactataggcgcgtgccaccatatctggttaattttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtc

SEQ ID NO: 180687 - DNA, 601 bp, Human
ggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccktagctgcatgggaatctcctggtagattgaggggatggactgggccaagggaaggaaagagattggatggtgactagagggaaagtggaaacagggagggtttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgag

SEQ ID NO: 180688 - DNA, 601 bp, Human
tttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggtttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgc

SEQ ID NO: 180689 - DNA, 601 bp, Human
ttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatayactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccat

SEQ ID NO: 180690 - DNA, 601 bp, Human
gctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatcttkcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctactt

SEQ ID NO: 180691 - DNA, 601 bp, Human
gtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagwgtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatca

SEQ ID NO: 180692 - DNA, 601 bp, Human
gaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgyacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctg

SEQ ID NO: 180693 - DNA, 601 bp, Human
cagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaartatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgaccca

SEQ ID NO: 180694 - DNA, 601 bp, Human
cccctcctgctgtctgacttgcaggtttgcacgtttgttttcatggaaggccttgaagcttatgtagaactatttgttttgtaggtgctttcagctgcagcggctgctggagtctctgttgcctttggtgcaccaattggaggcgtgcttttcagtctagaagaggtgagaatgggcagctgagggaattcgtgattttgagcagcaaggcccgttgagggttagaatcaaagaagtattggataagattccggcagttaattaaggagccacaatttccactgttttttttttgttttgtttttgtttttgtttttgtttttgttttttttgagactgagtctcactctgtcacccaggctgcagtgcaatggcgcaatcttggctcactacaacctccgcttcccgggttgaagcaattctcctgtcccagcctcctgagtagctgggactataggtgcacgccaccacgcctggctcatttttgtgtttttagtagagatgggggtttcaccatattggtcaggctggtcttgaactcctgacctcaggtgatccacctgcctcggcctcccaaagtactgggattacaggcgtgagc

SEQ ID NO: 180695 - DNA, 601 bp, Human
ggagcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgaagacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggca

SEQ ID NO: 180696 - DNA, 601 bp, Human
agcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgcasacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatg

SEQ ID NO: 180697 - DNA, 601 bp, Human
aaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggasaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtac

SEQ ID NO: 180698 - DNA, 601 bp, Human
acgaacccaaggcagctcctgaattcatatttccctagtgctgttataatcaacttaacttttagacattacagtcacagagctttaaaaggaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacrttggtttaatcaacattatattgagcatctattttagctgggaactgtagggggcacaaaaagtgtttaaaaaaaaaaaagccaaggagcttgttatctactaaagaacatggacataatccagtttaagtggtgctacccaaggcaggcgctccggggggactgttctgttttttcttttttaatttaatttaatttaaagttccgggatacatgtgcaggaagtgcagtcttgctacataggtaaacgtgtgccatggtggtttcctgcacctaccaacccatcacctaggtaggtag

SEQ ID NO: 180699 - DNA, 601 bp, Human
tgtacccattaaccatcctccatcccctcctcccccctcccccattccccttagttttcaaatgaggaggtgagactctaagaagcaaaacactgctcagggttaaagggaattggttgcagagccagtcccatctggattcttccaggtctcctatctcctgaggcacaatcagctgccaggtaccgggaggacctttgatggagaaccctgccagccgaccctgacccttgaggacatcaatcccctccgtacagcaccctctgggaccaacgacagtggggagtagacctgggcgtgmtgggaagatatgtggcagcatccttaagtatccagattcctggaatggctgcattttgggatacctgttcagtaaaatacagaggatatggggccaggtaacgggattcctgtgtcccatgctgacggtgtattatagattcacccacagaggtctatttgtgtctgaaagcttctggctgggagtaatagtcaaagtgtttaagagctggtgccagataatgaactgatttgttatgaattgtggggagttcactgcagttctataaggtatgaggttggcagggtacatcccagggtg

SEQ ID NO: 180700 - DNA, 601 bp, Human
gtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatayagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcat

SEQ ID NO: 180701 - DNA, 601 bp, Human
atgctttagaaggcagcgtttcccttagaggagcacagtgggctgggcagcaacagtggatgacgtgcgtattacggcactgctgggtatcatcataaccaacatgaacttgtggcttgttcttacaatgcgccagacgtctcatgaaacattcaacgtttcttaattcaccctcacaaccagaatgaggtaagtgttgttcttattcttattatttgatattttatagataaagagaagcttacagcatgaaataactttctcaaaatgataagatcagtaagcggaatattcttttttktttttttttttgagacggtgtctcgctctgttgcccaggctggggtgcagtggcccgatctcggctcactgcaagatctgcctcccgggttcacgccattctcctgcctcagcctccccagtagctggaactacaggcacctgccaccactcccggctaattttttgtatttttagtagagatgggatttcaccgtgttagccaggatgatctggatttcctgacctcgtgatccgcccgcctcggcctcccaaagtgctgagattacaggtgtgagccaccctgcccggccagtaagcg

SEQ ID NO: 180702 - DNA, 601 bp, Human
tatcagaggcgaggagaagcaggcagcataaccaagaacataagtattatttctcaatatgagacagaatctctatattaaattaatagccaaagccatacccaggaatgaaatatttacatgttctcactgaaaccaagaaccaaataaccagaggattgctaccatcattatcattgaatgttctagaaattttagccaacatattaagatatgcaacattaggaaagagaaaaagtttaccttttttggttaacatttacaaaatatgatggttctctgccaagaaaatcactccccmatttaaaaattaagtggctaaacacaaaatgaatgtataaaatttaacggttgttctgaaaactaggataaaactattcataatatttaatgaagataattttccacttacaatagcaacacaaactattaagtgcctacatagctttatatataattttgcaaacaatataaaggctagtaaaaaataaaaacaaaaaacttataactacattaagaaaactgggcacagtggctcatgctggtaatctcagaactttgggaggctgaggcaggaggatcgtttgaggccaggagttgg

SEQ ID NO: 180703 - DNA, 601 bp, Human
actactactactatcattactattaccaccaccattactactatcattactactactaccaccaccattactactactgctgtcattactactactgctactatttactcctaccgttactactactaccaccaccaccattactactactatcattgctactattactactgccatcattactattactactattagtttagtcattattatcagaggcgaggagaagcaggcagcataaccaagaacataagtattatttctcaatatgagacagaatctctatattaaattaatagcyaaagccatacccaggaatgaaatatttacatgttctcactgaaaccaagaaccaaataaccagaggattgctaccatcattatcattgaatgttctagaaattttagccaacatattaagatatgcaacattaggaaagagaaaaagtttaccttttttggttaacatttacaaaatatgatggttctctgccaagaaaatcactccccaatttaaaaattaagtggctaaacacaaaatgaatgtataaaatttaacggttgttctgaaaactaggataaaactattcataatatttaa

SEQ ID NO: 180704 - DNA, 601 bp, Human
tttgtgaagtattaatgagtgcttagtaaatgctagctgctatcactactgctgccactactatcaaaactactaccattactactactaataacataactactattgtcactactattaccactaccattagtactaccaccactatcatcactaccatcactactaatactatcattaccactactattaccattaccacgactatcattactactactaccacctccaccattactactactaatgctatcattactactactgcttctataattactactcctactcctaccattactactactagtagtatcaccattactactactactatcattactattaccaccaccattactactatcattactactactaccaccaccattactactactgctgtcattactactactgctactatttactcctaccgttactactactaccaccaccaccattactactactatcattgctactattactactgccatcattactattactactattagtttagtcattattatcagaggcgaggagaagcaggcagcataaccaagaacataagtattatttctcaatatgagacaga

SEQ ID NO: 180705 - DNA, 601 bp, Human
ttccttcctttactaggacagctgcatttatacttctacttctcctcttcagtcctttgtctctttaatttactggttaaatttgtttcttccagaatgtagcaattccacagcaaactcctaatgatgcaaggatatcagccaatcaccctcagaaaaccccatgaatctcctctagactcactagatatcaattccatattaacacgctctttcttcctgagttctatcctccagcagcatttaatagactaagtcccataactcaggacaataacccacagggtcccctaacagaccrataatcacaggtagggcccacactgtgcccacagtcagcaggaagcagttggaagataagacctccataccaatgccaaagatttgtcattgttgttctgtcagcggggaacatggagtcctggtaagttaatagatacaagaaaagggctctagctggcaggaacaggaatgaggattggggagagccactgttctaagagatggctgacaagccatttttctgagaaacacctaaccacaaacaacctacttgcacaacatcctgttcccaaataccttgttccacaggtagccccag

SEQ ID NO: 180706 - DNA, 601 bp, Human
tggagacctctcccctgttcactgttttttctcttctccaactccaacctcttagtggacagcatccaagcctggagacatctgatggccccccactgcagctactccctggtggatcagaaggtcccagtggaaagaagtttgaccgtcactgcccgatcgagtgagagtttagagtttactttcctttcccgtcttctggtggacaaactctagtatccctctagcagctgatggccactggccagggccattccctggtgtggcctaaaggccaaggagtgaaccaggtttggctgcyttgcttggaagggaggatggctctctcctaacccttctggtcaaaagtccccagtccctacatgcagcacaataggcagcggcagcttgaccagggcaaacgcacacacattttggggaactcagaccccgtccttctcactctaaatttctcctgtgaagaaagccagccatccttttctggacattttaagcaacatgatcccaaatagcaccagaacagtgagccttccctcaacctttgccccttatacctggattcagcacccagtataattcatacgtggactgacctggggct

SEQ ID NO: 180707 - DNA, 601 bp, Human
cacaacaccctgttcccaaataccttgttttgcacatagacccagcagcatgaccttatcagcacgtaccctctccagcacaagcctataaaacttccctccagcccctgactcttcgagacaacctcctctctgctgtgcacctcattgttctcttgcagtgtatcttcgtactttctacaataaatctgcctttctttatccatgactgtcttggtaaattctttcactgcctgcaatgctggacccagccagtcacaccagcagcattttggtggtccatatggagacctctcccctrttcactgttttttctcttctccaactccaacctcttagtggacagcatccaagcctggagacatctgatggccccccactgcagctactccctggtggatcagaaggtcccagtggaaagaagtttgaccgtcactgcccgatcgagtgagagtttagagtttactttcctttcccgtcttctggtggacaaactctagtatccctctagcagctgatggccactggccagggccattccctggtgtggcctaaaggccaaggagtgaaccaggtttggctgccttgcttggaagggagg

SEQ ID NO: 180708 - DNA, 601 bp, Human
tttgcattcccactagcaatgagtaagaggatctgctgcacaacattctcatcagcatttggtggtgtttatgtttgggattttggtcattctaatgggtgtgtagtaatatctcgttttaatttgaaagtctctaatgatgttgagcatctttccacaagcttattttccatctgtatatcttctttggtaaggtatctgttgagatcttttgcctattttttaattggactgtttgtttcttactattgagttttaagagttctttgtatatcttaaatactagcctgcatctgacatrtgtttcacaaaatcctcccagtctatggcttattttttcattctctgaacagtgtcatttacagaacagaagtttgaaattttaacaaagtccaacttatcaatttttttatggattgtgcttttggatttaagaagtcattgccaaattcaaggtcattgaaatattctcctattttaccttctcagcattttacaagatatatttttaattaaaaacaaatagatgctctgaatcagtcatggtccccacaaggatttttaatagaaactgtaaggaaaagacaacttacaatgggct

SEQ ID NO: 180709 - DNA, 601 bp, Human
cattaataattaagatacatttaaaaattaataagctttatgttttagagtagttttagctttacagatatattgagtagaaaatacaaagttcccatatactccctctccctaccacagtttcctctattatcaatatcttgcattgatgtggcacatttattataattgatgagccaatattgatacactattattaactaaaatcaataggttactttaggtttcactcttggtattgtacattctagggattttgacaagtgtatagtgatgagtacccaccactaaagtatcttaygtaataatagtttcactgccttaaaaatcccccttgtactacctattcatctctccctgtcctccagtccccagcaaccactcatctttttactgtctccaaagttttgccttttccaaaacgtcatagagtaggaatcatacaatatgtagccttttcagattggcttctttcacttaacaacatgtgtttaaggctcctccatgtctttttgtggcttgacaactcatttcttttcattactaaatagtattccattgtatggatgtggatgtaccatagtttatttgtccagtcacc

SEQ ID NO: 180710 - DNA, 601 bp, Human
tttatgagaccccaatgtttgatgatctgaggtgcaacggtttcatccctaaaccgtgcccctccccctgcgcttcccaccccctgttccaattttgtgaaaaatatctttcatgaaactggtctctggtgtcaaaaatgttggcgaccactgttacaagggactcgtacctagaatatgtaaagaattattacaactcaataatagaagggtaaataactcacttttaaaaattagcaaaggatttgaatagacagttcttttaaggagatatacaaatggccaataagcacatcaaggrttgcttgacatcatcagccatctgcaaaatcgaaatcaaatccacaatgagataccacttcacacctgtgacgatgcctataacaaaaaagatggataaaaacaggtgttggcaagaatacggatggagaaactggaatcctcatacactgctgctatgaatgtaaaatggtgcagccactttggaaaacagggtggcaattccactcccaggtatataccaagagaaatgaaaacatacatccacacgaaaccttgtatacaaatggccatagtagcattgttcataatagccaaaaag

SEQ ID NO: 180711 - DNA, 601 bp, Human
agtaaagaggtttaattgactcacagttcggcatggctggggaggtctcaggaaacttacaatcaatggctggggaggtctcaggaaacttacaatcatggtggaaggcaaaggagaagcaggcaccttcttcacagggcagcaggatggagtgagtgcaagcaggggaaatgccagacacttataaaaccatcagatctcatgagaactcacttactatcacaagaacagcttgggggaaaccacccccatgatccaattacctccaccgggtcttacccttgacacatggggattacaragattatgtgaattataattccagatgagattttgggtgggggcacagccaaaccatatcatgaggaatcaaggttgcacactctttatgagaccccaatgtttgatgatctgaggtgcaacggtttcatccctaaaccgtgcccctccccctgcgcttcccaccccctgttccaattttgtgaaaaatatctttcatgaaactggtctctggtgtcaaaaatgttggcgaccactgttacaagggactcgtacctagaatatgtaaagaattattacaactcaataatagaagggtaaa

SEQ ID NO: 180712 - DNA, 601 bp, Human
gtaacagtgtagaattccaagtaaaaaagcattagatgatgcaaagatggtcattttatatggatacatttttaaaaatcacagtgatgataaaattgtcataaaatttaattaattaaacatttatctttacaataaataaaagtatttggaaatacaagggataagaaataatttttaatgctttgctctcagtatttataaatcaagaagaccaaaaatagggcaaccctcttttgggccccctgtccgtggtggagagctttcttcaattgttcattaaactcttgctccaacctcaaaaaaaaaaaaaaaaaaaaagaagaagaagaagaaataatataaatcaagatgaccaaaaatatacctaagatggtagaggactttaataatgtaattaattagatttaattagtgtatattaaacaatatacctttccaaggttttggaaaaccttaacaaaaactatatcttatgtagtctacaggatttaaaaaaattttatttgtatatgacacactctatcatgactatgtaataaaaataaaaactaatgggaataaaacatttcaaaaaatccagtaattttagaataaaaag

SEQ ID NO: 180713 - DNA, 601 bp, Human
tctagttattagaagtacaaagacattaaaaataatcaacttacaaaaagcggaaacaagaaaataaaagcacacaagcaggaaaataaaggtatgaaatgctaactccctaaagtctattattttctcatctataaaatgtgggttataacaaacctaaccataggttaattttgaagattaataagataatgttcaaaaagtatttctcagtgtctggctcacaatcgaagctcaaataatgtttattattactatttataataaaatatgacagttatcaattatgaaagtaaatttwcatagttaaaatttaaataaaatattaaacctttcttattaaagggaaaaattaatacaataaataaaataacaaagagaattaaaaatttaggcttgtgaaaaggtatctcaaacaacacaaatcaaaagaaagtaacagtgtagaattccaagtaaaaaagcattagatgatgcaaagatggtcattttatatggatacatttttaaaaatcacagtgatgataaaattgtcataaaatttaattaattaaacatttatctttacaataaataaaagtatttggaaatacaagggata

SEQ ID NO: 180714 - DNA, 601 bp, Human
aatacttaaaataaatgttgtggccaggtgcggtggctcatgcctgtaatcctagcactttgggaggccaaggtgggcggatcacgaagtcaggagattgagaccagcctagccaatatggtgacatcctgtctctactaataataaaaatattagtcaggcatggtggtgcaagcttgtaatcccagctaatcgggaggctgaggcagaagaatcgcttgaccccaagaggtgaagttccggtgagccgagatcgcgccagtgtgctcagtctgggcgacagagcaagactctgtctttaaaaaaaaaaaaagttgcaagaaatgtggaaaaaaaactcatgaataagccttgaaaactctcctggaagacccatgatcaacttgaaccataaggaaaatgccccttgttcatggacagaacaagtcaacattataaacttgccaattttcccaaaaagaatgaataaacaatacaatcacaatgaaaatagcaagaagtttgttttttccccctcgagctagacattcgattctaaaattcacatgaaatataaagatgggataatagctaagaaactcctgaaaaggaagataaactg

SEQ ID NO: 180715 - DNA, 601 bp, Human
gagttctctgcatattttatcttattgtatatatatatacatctatcactttgtttctttgtcaacctcatagccagaattactgactgatgatcatttgatgtaccacactaatttcagtgagagttgtactgagtgttttatctcataaatatgtttataatctctaataaactaggtatgcaatttcttagtgaattttcaatggtaatgcaaagctaaatatcaattaattaaagagttctgggggtggaaaaggggacaagggaaaggaaccactcttggttcttacaagatggartttgcaagagaacttaaattacaaaggaaaaatggcattaaattaatatctaatttctaagctagttgaccaaattatttgaggcttattggcgttctcttgcttagtattgatatagtacttacttaacttgctatcaccataaacaaaaacaaacaatgatgacatgctcttcaaactgaaaagctgcaggtagcattccccaccttcaatagtagctgcctgaatctgtgtctctccatataacctttgaaatcaaaccgttcaatgaggatattaagaaatatcacccctaaccct

SEQ ID NO: 180716 - DNA, 601 bp, Human
ttttaacaaatgaggaaactaagtcccagagagtctggttcaaagccatacagttagctcttgacagattgtggggtgggtggcgggggagtgggggcagtctacacttttatcaatgccttttgctttcactctaaattacttttattttcattttattctaccctttggagcataagatttctatgtacttgtatatatacttttctcattagtatgttggctccctaaggagggtataaactggccctttatgttattactaaattcccctaggcatttataacgatgaaaaatgtcaaaaaaaaagaaaaagaaaaagaaaaatatagcagtgctgaagatggggaaaaaaaggtaggctacacttatttatttcccttccaccttgtcatctaggcattttgcaagcatatcacaacagtatacatctgatatatctgctgtcacctccatcacccttccattccacctgagatcgtgttaggaaaagaaatgaggaagacgtttgtgttcttcttgctcattgtttcaaatgatgagaaagactttgatgagacagacagaaagaagaatgaggcaaagcaagaataataaaccc

SEQ ID NO: 180717 - DNA, 601 bp, Human
taaagtagacagaaagtttggggggtgctttccactggaatatgactctggcaaagtattttctcttggagcataggcctttgttgcagacacatttcacaaagattactctcccccttctcttgccaaaaccttgaagagatcttgcagatcttcatcttgagaacctgtgaatttcctaaaggtaaagccaatgatggtatggggtccctgaggactggggacccctggaagtttctgactctcatgctagtctacactcctggtttatcaaaatttccatttgagtgttcctatgagwttatgcctcatgtggcttctgctccaggtgagcagatcttggctatatttccccagatttgggggtggcagtttgccctaaagccacaattctctcgtggttccaagaaatataattgattttccaagaaaaagtccagcttttttgttgtaagaataaaattatgatttccaaagtatttacatgtcagaacaggagccagatgtcccaagtcatttcctttacctgagagccttcaccagcttctaagcaagaaaaagaaaaatctataaataagccaccatctacttgttgctatta

SEQ ID NO: 180718 - DNA, 601 bp, Human
gtataagaattaatggtcgtctggcagagaagttcgtttgtctttagtgtttgctatagttgtatgttacaaatataaatatagccagaggtttcagatttctctagtgtctttttctttgtctcatctcttacctttgggcttccctaagtactccttcttagagagagtttgtgtcacctctttcagctgtgctgtattcccgctgatgtgatggtaaggtgcaggggaggagaagcattctctaattttattaataaatctcagtcttttaatggggctgtgtcttggggctataacygttacaagctttctcctttggtaccgtcccttccccctgcctcctactccctttcctgtctgcagcctccccaacccatttcctggaagccatggtccttgttgactatggggatcttttgccccctataaagtagacagaaagtttggggggtgctttccactggaatatgactctggcaaagtattttctcttggagcataggcctttgttgcagacacatttcacaaagattactctcccccttctcttgccaaaaccttgaagagatcttgcagatcttcatcttgagaacctgtg

SEQ ID NO: 180719 - DNA, 601 bp, Human
aagagggaggttatcttggcagaagaaagacattattcatcttggttggttggaaatgtgggtctggagctcataagacagatcatggatagggatatagctcagggtctggggtcctgactccccctaagggtcttacctcagagagtgatgactgagcttctggaggtcttgaatttcctgaaatttatgtaaaatggaaggtgcatgtgtatacatttcctagggaataagtcaatagccttcatcagtttctcaaatggttggaaaatggaatatagaacagcaccaaaaaacactrtcttaaatgaggatctatctacagggtgttaaacggaagtgagagtaacccagtgagcaatggagaggagagaaggtcccggcagccttgaggccccttcccccttaagctgagcactcagtgtcactcttctcagctccatctgactgtccccatctctaatctctccccatatgtacttcatatgaatcaaaggaaataacatagagagcttgtaaactctgaaatgctctgcaagtgtttagttatcatttaaaagatgaaatgaaatatggcaactccatttaagcttttattagt

SEQ ID NO: 180720 - DNA, 601 bp, Human
ttggttggcgggggtgatggttagggcagcgtttaaataacatgtttcttggtccacattaagagccgtacattacacttagcaggtgagactataagatcagagtctgtgggctaatttcgtacattagctgctatcattgtcttccacatctatttatttatttatttttgtcttctattctcttcccatgtacttgcttgtcaacaaaccccaaataaatgccacatattaagttaataaaagacatggtagttagggattgaaagtgtcagggtgaaaacactggtatgacaatccrccttcttaataaggttgttcttttgtaaacaatgttttaaaatctaactttatatgaatggttgattcaaagcctggtggccagtgttacagtgaatctccattcaccgtaatggagattcactgtaatggactcagttaatccagtcgttgaataatccatgttaagccttcactttttttctttttgggtgagcctccactcattgaaaacaaggtaaacttagactgaggttgacatgattgggtatctttcctcaggatctcccccttaagaaaggaaaactgaaccatcctttag

SEQ ID NO: 180721 - DNA, 601 bp, Human
cagagtgagtcttacaaattttgtgtatcttattgcttcacagtcagtcccttctttatagcatggctgagtgctgaacttagccccaactttttaaaaattaaaattggtcaatattgcaaccctttcctagcccttctgtcttctgtccctccctcccttctatccttcttgcagatgtaattcaggcagaattctgacattcatgtatcaaacttgctgttgccggcatcattttgcttagtgttcattatcatttctgaacggttctatcaggcaaaggcgtcctcgttctccaagmaaggaagccccagccagacagttgtcaaggcaacggaaaatgcacactgtgaactaccaagaaaaggccgtttctggctgctaagagtttttgcactcttgaggctcaaacttaatttctgggcttggcaaaaagaagtattttatggctaattataaaatgtacccaatgttattagactaggggatagatgattgcctgctaaatgtgttgtgaaaaattaaagcagttttcagagcggagggagctaaactcagtgtgcccaaaggatcgatcgcttatttttgtcattctttatag

SEQ ID NO: 180722 - DNA, 601 bp, Human
tgcagcacaccagcatggcacatgtatacatatgtaactaacctgcacattgtgcacatgtaccctaaaacttaaagcataataaaataaaataaaataaaaagtcatgaagatattaaaaattttttttaataaaagcacgatccatataaggaaaaaaaaaaaaaaaagaaaagtgaaactgcgatcatccctgtctatcaggaacagccaggggctgatgaattgcaacaggatagggttgtcccaaccccaaatgacaaagactcactgccctgaaggataaaagtgggaaaaaacytaaacaaaaatcacgagttgagccagagatgtttgtgacccaacagaacatggatttttcacgttctcttgtgcttttctggtctttactggatgaaacatcagagcatctatgctgattgtattctgacaaaactatcagaggccagagtgagtcttacaaattttgtgtatcttattgcttcacagtcagtcccttctttatagcatggctgagtgctgaacttagccccaactttttaaaaattaaaattggtcaatattgcaaccctttcctagcccttctgtcttctgtccctcc

SEQ ID NO: 180723 - DNA, 601 bp, Human
caaacaaaacatggaggtattccgtatatgtgccgtaaaagcaaagcttatcttggttgcaaagaataaaaagcaattctggctaactttaaataacaaaagaaaaaaaaagagagactatgtgcttttaattttgagagcaaagatactggaagattctagtttgaatcttctagtttgaaggaaacttcaaacatgtcagatttggggaaaggacgaccagtacattcccaggaaccttagtcatagaagtttgtagactttctgctggttctttaactctgaacccacagttcttggycttaatttatcctttccaaatttaaaattataagagggaaaaagacaaggcttagattggtcctcttcaaggacggcatcaatctattcatgaaggatccaaccctccccagcccaaacacctcccattaggccccaccttaaagactagtaatcaaatttcgacatgaggtttagaggggataaatatccaaactatagcaagggtaacctgttttacttagagtccattaaaaaaacatcttcacagcaacatgcagcctggtgtttgatcaaatttctgggtaatgtggactaggca

SEQ ID NO: 180724 - DNA, 601 bp, Human
atgctttggcttagcaaacatatacggaagaccttctatgtgtcagggactgccaggtgctgaagataaggagactgggaagaaaaacgacctctttatctaaggggcgcaccaaccagagggagactataacaccaaacaaaacatggaggtattccgtatatgtgccgtaaaagcaaagcttatcttggttgcaaagaataaaaagcaattctggctaactttaaataacaaaagaaaaaaaaagagagactatgtgcttttaattttgagagcaaagatactggaagattctagtttgaatcttctagtttgaaggaaacttcaaacatgtcagatttggggaaaggacgaccagtacattcccaggaaccttagtcatagaagtttgtagactttctgctggttctttaactctgaacccacagttcttggccttaatttatcctttccaaatttaaaattataagagggaaaaagacaaggcttagattggtcctcttcaaggacggcatcaatctattcatgaaggatccaaccctccccagcccaaacacctcccattaggccccaccttaaagactagtaatcaaatttcgac

SEQ ID NO: 180725 - DNA, 601 bp, Human
atgcagattctacacactaaacaaaaaaaaagatttatacctaagtatttcactttaggagccactgtaaatttattttaaaaaaattggtttccagtggttcgtttctagtgtatataaattaatatttgtatgttgaccttgtgtcctgtgacttggatcaacttgcttaccaaatctagaagctttcttttattccctagtttcttttttagatttttgtatgtagagaataatatctgtagagaataatatctataactagagacagttttatttcttcttttctagtctgtatgcttttttttttttttctgccatattgcacagactaggaacccagaacaatgctggataccaggagtgagagaacctccttgacttgttgaagatcttaggggaaaagatggaaagtctttcactaataggtataattataattaattatttcaatatcctttattggttaaaggcaggttcctaggtgatcacaagttttttttttcacgaatagatcttgacttttgtcaaatgctttttctgttatctattgaatatatacatttttttttcctttttagtctgttaatatgttaattac

SEQ ID NO: 180726 - DNA, 601 bp, Human
tttttgagttttgagagttctttattgtattctggacacatgtcctttgttagaaatgtgatttgcaaatatcttctcccagtttgtggattgtctttctaattttttaagcgtgtccttttcagagaaaacatttttaacttttataaagtccaactctttctttcttccttttctttccttttttttctttttcttttccttgagatagagtctcactctgtcacccaggctggagtgcaatggtatgatcttggctcactacaatctctacctcctgggttcaagcaattctcctacsttagtctcctgagtagctgggattacaggcacccaccaccatgcccagctaatttttgtacttttagtagacacggggtttcaccatgttggccagtccggtcttgaactcctgaccttaagtggtctgcctgcctcagcctcccaaagtgctgggattacaggcatgagccactgtgcctggccattattttttcttttataaattgtgctttggtattatatttaaatactttttgtctaaccaaaggtcattacaatttgcttccatgttctcttctataagttttatagttctaca

SEQ ID NO: 180727 - DNA, 601 bp, Human
tggggcttagccattctaataggcaggcagtggtattaccttgtggtgttatttacatttcccaaatgactgatgatgttaatcatttttcatatgcttatgcaccatctttatttacatgcctgtttagattacttgcctatttaaaaaatattgggttgttcattttcttatttttgagttttgagagttctttattgtattctggacacatgtcctttgttagaaatgtgatttgcaaatatcttctcccagtttgtggattgtctttctaattttttaagcgtgtccttttcagagmaaacatttttaacttttataaagtccaactctttctttcttccttttctttccttttttttctttttcttttccttgagatagagtctcactctgtcacccaggctggagtgcaatggtatgatcttggctcactacaatctctacctcctgggttcaagcaattctcctaccttagtctcctgagtagctgggattacaggcacccaccaccatgcccagctaatttttgtacttttagtagacacggggtttcaccatgttggccagtccggtcttgaactcctgaccttaagtggtc

SEQ ID NO: 180728 - DNA, 601 bp, Human
ttattactggttgtattttctgcacttttttgttctttgagacagagttttgccccttttgcccaggctggagtgcaacggtgcgatctcagctcactgcaagctctgcctcccaggttcaagcgattctcctgcctcagcctcccaagtagctgggattacaggtgtgcaccaccacgcccaggtaattctgtatttttagtagatatggggttttgccatgtgggccaggctggtcttgaactcctgacctcaggtgatccgcccttctcggcctcccaaactcctgggattacaggcrtgagccatcctgcctggccattttctgcattctttctacacttattaattgctgtttctctagaaggaagtgttattccttctcccccatttatttattggttttttccaaggagacatgacaattaaaaacagggtgatatcctggattggatctgtgacagctccttggtgttccctttactttcatgaccttcttacttttaaagagcattggtcggttatttcatagaacgtccttcagttttggtgtgtcttatgttttctcacgatgagattgagcttgtacattttggggttg

SEQ ID NO: 180729 - DNA, 601 bp, Human
tgtggtaatggacatgaatagtatgggcactgagctggtgaacaacagaatctcaaaaagggaagaacacatttgcccaaaacattaatcagtatcaggctggcaggagagaatcaaagtagcttctgtggagagaagacacctcacccagagataaatagcttgcaagtattagaacattcacagtgaaaattaacccatttcctttaaaaaaaaaaaaaacttttaattttgagatacttttagacttacagtaaagttgcaaaaatagtacagagttccgtatccccctaatccagcwtatcctaatgttagcatctaacaaaaccatacaaccaagatgacgactaagaaattaacattgatacaatgctactaactaaactgcagactttattcagttttctccagtgtttctgccacggtcctttttctgatccagagccaatccaggatatcaccctgtatttaattgtcacatctacttggtttggtccacatttttattactggttgtattttctgcacttttttgttctttgagacagagttttgccccttttgcccaggctggagtgcaacggtgcgatctcagctcact

SEQ ID NO: 180730 - DNA, 601 bp, Human
cagcatctattggatcaacagttccattgtttgaaacatgaggactataaataggaggcagaaactgacagcacatttagtgtgtttgcctatgtggtaatggacatgaatagtatgggcactgagctggtgaacaacagaatctcaaaaagggaagaacacatttgcccaaaacattaatcagtatcaggctggcaggagagaatcaaagtagcttctgtggagagaagacacctcacccagagataaatagcttgcaagtattagaacattcacagtgaaaattaacccatttcctttaaaaaaaaaaaaaacttttaattttgagatacttttagacttacagtaaagttgcaaaaatagtacagagttccgtatccccctaatccagcttatcctaatgttagcatctaacaaaaccatacaaccaagatgacgactaagaaattaacattgatacaatgctactaactaaactgcagactttattcagttttctccagtgtttctgccacggtcctttttctgatccagagccaatccaggatatcaccctgtatttaattgtcacatctacttggtttggtccacatttttatta

SEQ ID NO: 180731 - DNA, 601 bp, Human
ggcactgctcattgactcagatcacaaatcctgggtaatctgggtggagcatgttgcccaacctcagtgacatttgctatttctatttttggaatagagcgaaaggatccaggagatcaattcggcttgatcctgttttttcctttctagtcaacctcctacagtgtgagcaatgaccctcactccacccccaggcatacacacccccctctacatcccacaacttaggcagtttctaagactttgggaaaatccctgggagttcctcataacacaaaatgccttgggctgtacaagcctwggagaagatgccaagctgtggtctaggctcagggaatagtttcgctgccccttcctccccacctccctacagacaccccccaccagccaagcagcctgttcccactgatgcctgactggggaaggagactgagtttgttagggccaaggccataagcacttatcactcagcaaccacaaaagcaactgggttttgtgttgatccctctaagattaggccttgaacctcctttgtgcaccccttcccaacagacaattgtacttctgtctgaaagttttaattaaatgactcctgcacaag

SEQ ID NO: 180732 - DNA, 601 bp, Human
tgaatcagcaaaggaggtggtgctgaccaggttctgacccagcagcatgtcttgggaagaaactaagcccttcctcaatacctccccgccaagctggcactgctcattgactcagatcacaaatcctgggtaatctgggtggagcatgttgcccaacctcagtgacatttgctatttctatttttggaatagagcgaaaggatccaggagatcaattcggcttgatcctgttttttcctttctagtcaacctcctacagtgtgagcaatgaccctcactccacccccaggcatacacaccyccctctacatcccacaacttaggcagtttctaagactttgggaaaatccctgggagttcctcataacacaaaatgccttgggctgtacaagcctaggagaagatgccaagctgtggtctaggctcagggaatagtttcgctgccccttcctccccacctccctacagacaccccccaccagccaagcagcctgttcccactgatgcctgactggggaaggagactgagtttgttagggccaaggccataagcacttatcactcagcaaccacaaaagcaactgggttttgtgttgatccc

SEQ ID NO: 180733 - DNA, 601 bp, Human
gttcatgctgctttttctggctgtgctgctaggctgaatgcatcgctaacacccgcacaggggacacagcagattttagcagatgcctctgtggtttgcaatgggagggagcacttcccatgtgtcccaaatgaaaacaagcagaacttcaggtatgaatatatatgcaagtacatacaattagaagaatatgcagatgtacacatgcctcctgggcacctgttttcaggacagaaaaggaaagagtcagatcgtgtgtctctgcatgagctcaattgagaaaggggttccctcaccaaayattcaactcattgattgttgcaaattctgagctggatgctaatgaggaaatcaaacactggctccttcatcccagatttgtaaagcttattactgatagttttcagtctttccgtcttctaatttataacccaacttctaatgttcaagtcactctgctctgtgcaagaatctacccctccatggttgggagactttggcaaacccaatcagagatgaggacaaactgaatcagcaaaggaggtggtgctgaccaggttctgacccagcagcatgtcttgggaagaaactaagcccttcc

SEQ ID NO: 180734 - DNA, 601 bp, Human
gccagccaaacattgataaaagcaatgtatctgagcttcccatatttactcggcacccagtgacatttggctcttatctactgagaatatgagagtgataacagtaggaaacttaagtcagagcctgcaggttcttatttaatatctatagacactaaaggatttgcatctggatttaaaaggaattactctgagaatatttaattccaatagttggaggaaattgctcctgtgatcagtacaatttgccacagttttaaacatgtgggtgacaatgactgactttcatatttctgtcctyggcagcgtgactgtacacaactgagtcgcagccactctcagaggggattgcagcctgcagctcacgtcttagagcttctgaatgcagcagagaaccaacttgctgagccactatcattattaacaaaacgttggggattttaaaagaatcctcagagagtcccagcaacatattcaatatggaatgataagggccaggcctttggagagttgaagaaaccattttcccagtaaacccttacatcaaatgtaccagtgacatctgattgcgctgtttcctctcttggaaatgctcttcccc

SEQ ID NO: 180735 - DNA, 601 bp, Human
ggccctgcctggtacccctgacagccttcggaagaagaaaacaggccttctctgtgggtcatgtctccagggtgtgcaggaccaaatactgctttattcataaaacaggtagctggaaagctgccccactgagactaaagggaatggggtaaatcatcctcccttcatttggctgtggcttctgacaatctagatagttgtttgcatacctgtgtgcacacctgttgtcattctgtttggacagatgactagcgtacaatacaggttcttcagaggatacgtaattaatcaaatcataacracctcaataatataatctgaagaattaaaagcagggctctggtatttgttctacatagcattcatataaatgtccgattgctctttgcagcttacgcttggtagtcccaatcactctctagaaagggcttatgagcagctacctggaaggcctggattagggagtggtagcagatgtcatggttgagaggatctaggggaccaggcagataccccatcggacagtgggcatcctctaaactgtctctcactgacttcactatgaaccacagtaccataattttggtctttaccattttca

SEQ ID NO: 180736 - DNA, 601 bp, Human
agttaagatatatgtttcatctcttgtttcacattgttgcactcaatatttgcaattgagttagcttaaagtaaagtgcatttattcgactagatggtttgctccagttgccccactgtgtttttttcttctatttgattgctgtcttggtactaagccagtacaaagacaggaatgaagatttacaaagttttcaaagattataatgggcccttgggtgtgatattttaaataggagctgactttaagtcaaaagctttcaaatcaaccagtaagtacttaacagaagtcctttcttcaygacaaggatgaaacacagagtggattacgcaaggtgaatctggtcagcccgggcctgaggtcacgtctgactcccagcaatggtgttttgcttggagacttctactgccctcttggcccctctgtttgacctggcatggtccatctgtagtcactctcataacatgtcatacattcctacacattctcattttctgtgctccttcaactttttttttttttttgagacagagtcttgctctgtcgcccaggctggaatgcagtggtatgatctcggctcactgcaatctccgcctcccgg

SEQ ID NO: 180737 - DNA, 601 bp, Human
tcactgtagtaggaagggaagctggggagatggatctgtagatttgtcagtgggaggcggatggaaaagaataaaaattcctggcagcacgccagctcggccttcccacattagtacggccgtaataacgacttgggagtaataatccaaaaattcggatgtggagagggagatgacactgcatcactttgatccaaatggcatttttatgatggctttaaatatgtttatgatgtttacaaggagaaagtctagaatgctgagcaaaaggatgcctttgggaaaggacattaacattttkctgacaacaataacccccatgcttgcctctctcctcccccaggccttgcactccttctagttcttttgttgttccacacctgcaaggttgaccagctgccccacatcaggggactcagctcttgaaggtgttatcccaggaatggtagtaggtctttctgagtcaaatcaatgtcctccaatttgacttccaagtgaacttgtaagcagagatactcattattcagctgatagtgttaacagagatggctcagattctagaattattcctgagacaggctaactggaccatctgcaatga

SEQ ID NO: 180738 - DNA, 601 bp, Human
tgggcatgggaggagtacaaaggggtaaagtgggaaaaaatcattaaatgtctttaaactgtacacttaaaaatggtaaagatgggctgggcttggtggctcatgcctgtaatcccagcatattgggaggccaaggtcaggagttcgagaccagcctggccaatatgttgagaccccattctctactaaaaatacaaaaaattagctggacatggtggtcacgtgcctgtagtcccagctactcaggaggctgaggcaggggaatcacttgaacctgggaggcggaggttgcagtgagccragatcgcaccactgcactcctgcctgggcgacagagtgatgagactctgtctcaaaaaaaaaaaaaaagaaaagaaaatgtaaagatggtaaattatatatgtatattttacctaaatttttaaaaaagatgagtcaagtttgtatactgatgtgaacgatctggtcggggaggataagtggacctggagagagagagagagagagagagaggaacagagagatagagagaaggggagagagagagaggagaaatgagaaagacagagagagatagaaagagagagagaaggaagagaga

SEQ ID NO: 180739 - DNA, 601 bp, Human
taaatagcaaagaaacaaataatttcatttttaaaaatgggcaaaaaattgggacaaacatttttcaaaaagaagacatacaaatggcctacagttatattttttaaatgtttgacattgctaatcatcagataaatgcaaatcaaaaccataatgtagtatcatctcactcaagttgaaatggtttgtataaaaaagacaggcaacagcattaaggaaaaatagctaatgcatgctgggcttaatacctaggtgataggctgatagatgcagcataccaccatggcacacatttacctaygtaacaaacctgcataccctgcacatgtaccctggaactaaaaataaaaactgaaagaaaaaaaaatgaagataaaaaacaatatgcactattcaaaaaaaaaaaaaaggcaacgatggatgctggtgggaatgaagaaaggggaattctcatacgttgctggtgggaatgtaaattagtacagccactatgaagaagagtatggaggttccttaaaaaatagaaaatagaactttcttatgaccctgcaattccagtactggatatatatctataagacaggaaatcaatatattgaat

SEQ ID NO: 180740 - DNA, 601 bp, Human
tgccttggctttaacccagtgagactcatgccagacttataacacatttctgttgtttaagctgcaagtttatgccaatttgttacagcagcaacaggaaactaatacactgggcttggtggctgagtggatatggaggagggggaggaccacagggtggactcctagatcagccagagggcaatgagtccacataccaaggtgagaaaactcagggagaaatggactatggagggtggaaaccagactgacgttttggtcatattaaatttgaaatgtctataagacatttaagtggagrtactagcaggcaattgactatgtaagtctagggttcagaagaggagactgagctagtgatgactttctggactagaagaatacagatccaaggcaggaggatcacttgagcccaggaattcaataccagcctgggcaacatggtgagaccccatctctaccaaaataataataataataatgagaagaagaagaagaagaagaggaagaggaagaagaaggaagaagaagaaggaagaagaagaagccgtgtatagtggtgtgcacttgtagtcctcgtaattaaataccagcctgggca

SEQ ID NO: 180741 - DNA, 601 bp, Human
aatagcaatagtattgagccgatgtggctgtcgtaaatgagtacctgtaaacaacagcaacaacaacaaaaaaaacccagaagcagcctgacctagaatgagtgcttggcagtgtcagcccactcaccaagaccctctgatggtgcttgctcaagccctggtgctctgctgccgaaaggaatccatatgtttgggtttccaccaagctgaaatcttaattagcataatatgtaaaatcgtgtcagtgttcagtttttgctcccttcccccgccccccgtttatatttccttaacttttggyacttggtcattgcttctctgttagggaaactactaataggagggaaaaaatgctaaaaatctttcagggaagggggaatgatcatgcttagttcaacaacttgcatttttaaagatttatgcatacatctggttttgttttctttaaaattatccttggctttataaatgcctatactcaatccaattgaatatatcaatgtttcctggtcttccataattgcatcatgaccccaaacacttagtccactcactaatttaattgtttatgtctggccatccaggcagacccatgcccttg

SEQ ID NO: 180742 - DNA, 601 bp, Human
gtttgacctcattttgattatatctgcaaaagccatgtcttttacctgagggtaacagatagtaagaacttgtgggcatcacctaagagcagggagtgaaaaaaccaactgaggaaagaaaaatgcagggcccaaaaacctttttaaaatgtatttatttatttgagacagtcttactctgttgcccaggctggagtacaatggcatgatctcagctcactgcaacctctgcctcctgggttcaagtgattctcctgcctcagcctcccaagtagctgggattacaggtgcacaccaccamgcctggctaatttttgtattttcagtagagacagggttccatcatgttggccaggctggtcttgaactcctgacctcatgatccacccacctcagcctctcaaagtgttgggtttacaggcatgagccaccacacccagcccaggaaaccttttaattaaacaatgtagtcgaggtctgtgggaagaggcagaagggataggattgtccccaccctctgtcaatgttcaacagcctgaaacccccatcttgttgtaaccctgatgttgctgtgtcactgctcaagcagaaatacagaatg

SEQ ID NO: 180743 - DNA, 601 bp, Human
gggagcacctggtaattgcagaagatattttcctctaagtgcttaaatgctggcagtccttaggggaatctgaggcttccataaaactggacttcagatgacaaagccatgctacattaatagctctagagatctgcagttgggatggcttatctttcagatgccatcattttggcttttaatttgtttgcgaacaatatcctttggggagctgcatccttcaacgtctgcctgcattatcacatgggcttcttccctgtgtgtctccagatctccctctcataattcatcggatttaggrctcaccctaatttagtttgacctcattttgattatatctgcaaaagccatgtcttttacctgagggtaacagatagtaagaacttgtgggcatcacctaagagcagggagtgaaaaaaccaactgaggaaagaaaaatgcagggcccaaaaacctttttaaaatgtatttatttatttgagacagtcttactctgttgcccaggctggagtacaatggcatgatctcagctcactgcaacctctgcctcctgggttcaagtgattctcctgcctcagcctcccaagtagctgggattaca

SEQ ID NO: 180744 - DNA, 601 bp, Human
ggaggctgaggcaggagaatcgcttgaaccagggagtcagaggttgcagtgcaccgagatagtgccactgcactccagcctggtgacagagtgagactccatctcaaaaacaaaacaaaacaaaacaagcaaacaaataaaaccaatagaaatgtactctctcacacttctggaggccagaagtaaaaaattcaaggggtcatcagggccatactccctctgaatgctctagggagagtcctttcttgcctcttcagctgctggtgttgccagccatcctgggcattcatcagcttgttgytgcatcactccagcctctgcctgcgttactatttggacttcttccctgtgcatttccaaatctctctcttgtaagtcattggatttaggactcattctcatttagtctgacatcatcatactgtatctgcaaaggccatatttccaaataagttcacatttataggtactccatggagattagaacttggacatatctttctgggtgacaccattccacccacagcagtcagtagccaggatgtatgaggcactttacttccccacaccacagaagtccttttgtccctgtcaatcacgc

SEQ ID NO: 180745 - DNA, 601 bp, Human
ctttgttgtgccttgttccatctcacggcctcacccgcacaccgccattttggttgggctgtctgctttgtccctgaacgctaccttctaatcttcccttgactcctctcctgctcagagcccaggctgcctaaatcccagaccagggatcggactctgaggagcccccatttattcagtaagggagtgtctctgtccccttaataaactgttatcctgcttcttgactcatggaggaacagcaagtcctgaagaaagatgcaggaacaagggacccagaaacccagccaggtgggcttayggcatctgggaaactgtgttttggaacaagatttggggcctatttgtgagcacattgtcctaaaggcatttttgagcccaggataggtaaggaaatggaattctctgctgagatcactattaatatcttacaccacctagaaaaaaatggtgtctaaaatatccaacctgtcagacaaggagctttgattgaagatgcaatcacacagccaagccaatgccagctgacaaaaggagtttctggggtgggaaatgggtgggatgtgtccagggatttaaaacccaatccttgcaggtttaa

SEQ ID NO: 180746 - DNA, 601 bp, Human
atggcctcttccctgtatgttcgtctgggcccaaatgtcccattttcataaggacaccagtcacactggattaagggcctatcctactccagtagaacctcatcttacctaagttacatcttcagtgaccctcttttcaaataaggttattttctgggcattgggactttaacaaatgaattttgggggaatctgatataaccgatcctaccccccacagtgatgcttgggcacctcagggagcacccccctctcagccctgcatcccagtccctcatcccacctcctgctcctggctttrttgtgccttgttccatctcacggcctcacccgcacaccgccattttggttgggctgtctgctttgtccctgaacgctaccttctaatcttcccttgactcctctcctgctcagagcccaggctgcctaaatcccagaccagggatcggactctgaggagcccccatttattcagtaagggagtgtctctgtccccttaataaactgttatcctgcttcttgactcatggaggaacagcaagtcctgaagaaagatgcaggaacaagggacccagaaacccagccaggtgggcttacggca

SEQ ID NO: 180747 - DNA, 601 bp, Human
ccacaataagatatccataagtgtcagtttcttaaggcaattttccaaagtaccccacatcggatagttgaaatatctgagatgtattgtcccacagctcggaaggctggaagtcctagatgaaggtgttggcagggttggttccttttgaggctgtgagtggggatctgctccagggtcccctccagcttctgggggttccttggcttgtagcaacatcactccaatctctgccttgtcatcacatggcctcttccctgtatgttcgtctgggcccaaatgtcccattttcataaggacaccagtcacactggattaagggcctatcctactccagtagaacctcatcttacctaagttacatcttcagtgaccctcttttcaaataaggttattttctgggcattgggactttaacaaatgaattttgggggaatctgatataaccgatcctaccccccacagtgatgcttgggcacctcagggagcacccccctctcagccctgcatcccagtccctcatcccacctcctgctcctggctttgttgtgccttgttccatctcacggcctcacccgcacaccgccattttggttgggct

SEQ ID NO: 180748 - DNA, 601 bp, Human
ggaagttttaataagtgatgcaccttgtcagagtaaaagctttcagtgggggaaaatgtgctttaatttagttcatctaaatttctccacactctcagcacagcgattatcttgccttctatatcaccctgacacatactattaacctatcaaacagcagaaggctgagcaccaccaggctccaatctatacagatagttgggccaattcaggtcaaaattttattggttttggcctaaaagctgctggaaaaacttgtaaaatgaagagaagttacaatgtgattttaaagcggatttcraagatgagaacaggataatatcagtttctggctgcaaagttttcttctgttaaaaacctataagttaaataggcacacaaatatatttctatgctctttaaactactgggtataaagtgatcacaattttaagttgcataaaaggactgcaaatattaaaacacttgactacaataaggttccttttgggccttaggtaagtaatgttttctggtgttgttccagaaagcataataaataaaataaaattatcctttgatcataccaaggggtttgtgacagtgtgtattagcctgtttt

SEQ ID NO: 180749 - DNA, 601 bp, Human
gactggggcagttaactccattgcaagaactgtcccttcaccaaaccaataatggccctacttaacctgtacatattgtctccttccccagagaggtatttgttgagaaatatttgagacattgctatcttctttcaaagtatagaaatatacagaggtggcacactttcttttgcaccttgggtgtcatttcccctctagcccagtgtgtggagtcccctcaggctgctctgagagttggtcctctatagtgtcatggctgccactgaatcttacaggcatgtgtgcagtgctgtgacakagtgaactgtttctattgcctcttgttttgaaattgctaagacccgggaagcctggttccaggggacaatttccctctagtcctcatgttggttttcaatcaagaaccatccttagaacatttccaaaccaaagctgctgttattgcttcgagagtctttgctcccggagcaccactcctcacctttggctgcagcttggaatcccttgggggactttaagaatcctgagggccatactgtacccaaccaattgagtctttgggggtgtgtgatgactaattgtatgtgtcaacttggct

SEQ ID NO: 180750 - DNA, 601 bp, Human
agaatagatgctagaaactctatgatgtaatctttttacattaaaaattttacgtagtaatgccaagaactttatatctttaatagtgtagaaaattgatgacacccatttccttgagaagagggtcaccctctggatacaaactaataccacacagagtttctggatttcattctcctcaaaatctctctgccccagtccacagtgggtgcgagtttcttgcctctctctcagctgccactcttctgctgaggcagagaagttttctcatcctctgggtctccactataaccccaacttscatgccccaaagacacgcacacccttcccaaaaacccagcagttctctgtgagtctggtagaaagtccccattatttgtggacctactcagccttggtgagtggctggtcccaacaggatccacaagaaacttgcatgaccgcaaggcctgggcacaagacaaacccttccactgccatgctgccattatggctgttgtttttccatatggtctcacatggcctctcagcaggggacgacactgatgggatttttatgggtctgtaaataaagctctttctttcccactggagttgtaaa

SEQ ID NO: 180751 - DNA, 601 bp, Human
actctgcgaaatcttttgtggctattgatgactgctgaaactttcagttgatctagaaggagtaaattttttggctattggataaaaaaatttttttgggggggaaaatggttttggtgggctctaaatacgttgttgatgctcattgctaaaaactttacctcttaccagccagtcctctatatattctgtagacctggtctacatattcttcagaagacaatcaataagttaatggatttttaaggtttatttgatgtcctgtgttcttgaagtttgggcccataatttagttagcttyggatgacctggagaggcaatgttcatcccagggtcttggaaaagccattagttttggttccctaagcaaatgtttcagtgccacttgtaactgtatgaccttgggaaagttatttcaccttgttaagcctcaatttccttgtctgtaaaatgaggataagaatagtgcctacatcatagtgttgtcatgaggactgatgaaatgatgtgcgtgggtgccccgcatggtgtcaagtgtttatcagcactcaagaaatattctaatgattagtgaatgttatttatacttactagctgctat

SEQ ID NO: 180752 - DNA, 601 bp, Human
acttaacacaatgccatgcgtccaacagtcccgcaatggacctggatgcaattgcctgtcttgtgaagcttaatcgcaagcatggtcttcccctcccattgtctccatctctttttgcctttctaatagaagaaacataagtcaagacttttggaaatatttttcatctattccaaaattatggaataaaatatagcttttttcccatcccacatcaagccctgaggcatggttgatagaaataatgttggtgaggtggcttggacctgggccagctgcctcccaggccaattcgtgctcscaagagggtatcttagaaggctttggagaaagagcagacaggggtttggaccgaataaaggagttgccttctgaatagttaattaaaagtaaaactgcctaaaatgaaggcatctctactctttgaaacagcaaagtcgtctctgaaaagatgtaagggaataagtgctttataaaatggcgtgaatagttatggacaggttggaaaagatgtgtagagaatgcgattaattaaaatgatgatttagtccaacaacctgtcatcaggtctgatgggattttgtaatgttgaaaattcagc

SEQ ID NO: 180753 - DNA, 601 bp, Human
tgttgtgtggcttttttatgtgctgggagaaacatcctccagctttttctagcctctgcttgtgcccttcccctccagtagtctctgtgtgagctttttaatctcctgtaatatttctaaagctacttttagttcaatgtgactaatactcttattttcataactgaatgaaatgcattttagtgtgggtatacttgatatttgaatttcatagtaaagtatcttttttattttattattttgctttattttttaaaaattaaactaaaaaattttttttgagacagagtctcactctgtygcccaggctggagtgcagggcttactgcaacctccgcctcccaggttcaagtgattctactgcctcagcctcccgagtagcagagatttcaggcgcatgccaccacgcccgggtaatttttgtatgtttagtagagatggggtttcaccatgttggtcaggctggtctcgaactcctgacctcgtgatccacccaccttggcctcccaaagtgttgggattacaggtgtgagccaccgcacccagccttctattcttctttaaacaaaatttttattttatttttaagagacagggtccc

SEQ ID NO: 180754 - DNA, 601 bp, Human
agggtcccgctttgtcacccaagctggagtgcagtggcatgatcagcacactgtaacctcgaactcctgggctcaagcaatccttttgtctcagccttccaaaatgctgggattataggcgtgagccacattgtctggcctcttttttctcttctttcccttttcccaatcccttgtcttcccaattctgacttactttttggccattaaagctttgcaaaaaattaaaagtattttgaagactgcaaaaaagatacgagagcatctctattccaattaggtcatgtgaaaagacaacatyacaactcatctagttttgtagattttttttttttttttttttgcgacagttttgctcttgttgcccaggctggagtgcagtggcgcaatcttggctcactgcaacctccacctcctgggttcaagcgattctcctgcttcagtctcccgagtagctgggattacaaggcatgcgccaccacgcctggctaattttgtatttttagtagagatggggtttctccatgttggtcaggctggtcttgaactcctgacctcaggtgatctgtccaccttggcctcctaaagtgctgggactata

SEQ ID NO: 180755 - DNA, 601 bp, Human
gctgggattataggcgtgagccacattgtctggcctcttttttctcttctttcccttttcccaatcccttgtcttcccaattctgacttactttttggccattaaagctttgcaaaaaattaaaagtattttgaagactgcaaaaaagatacgagagcatctctattccaattaggtcatgtgaaaagacaacattacaactcatctagttttgtagattttttttttttttttttttgcgacagttttgctcttgttgcccaggctggagtgcagtggcgcaatcttggctcactgcaamctccacctcctgggttcaagcgattctcctgcttcagtctcccgagtagctgggattacaaggcatgcgccaccacgcctggctaattttgtatttttagtagagatggggtttctccatgttggtcaggctggtcttgaactcctgacctcaggtgatctgtccaccttggcctcctaaagtgctgggactataggtgtgagccactgtgcttggctgtttgtagatcttaattggcttttgtgattccagaatctggcagcagtcagaccaaaaaatggttcacaaagctctgcccca

SEQ ID NO: 180756 - DNA, 601 bp, Human
tcggctcactgcaacctccacctcccaggctcaagtgattctcctgcctcagcctctcaagtagctgggattacaggcgtgtgctaccatgcttggctaatttttgtatttttagtagagacaaggtttcaccacgttggtcaagctggtgtcgaacctctgacctcaagcgatccacctgccttggcctcccaaagtgctgggattacaggtgtgagccatcgcacccagcctgattatataataatttaagcattgatgatactaaaatttcagaatttaaatagtcatttggttgacsctttataacaaagaggtgtgattctattattttccttgtttgaatacttaacaaaattatttgtgttgtatagtataactagaggaaggatttaatttttgtaaatgtaagcaaaatatttttcataaacagcctaatatttctctactcttgaccagattaggaagaaacagcaagaagtagtgggttttttggaagcgaataaaatcgactttaaggaattagatattgctggagatgaagacaacaggaggtggatgagagagaatgttcctggagagaaaaaacctcaaaatggga

SEQ ID NO: 180757 - DNA, 601 bp, Human
aaataaggtaaccctctttttttttgagatggagtttctctcttgtctcccaggctggagtgcagcagtgcagtatcagctcactgcaacctctacctcctgggttcaagtgattctcctgcctcagcctcttgagtagctgagattacaggcgtgtgccactacgcctggctaatttttatagttttagtagagacaaggtttcaccacattggctgggctggtctcgaactcctgacctcaggtgatccacctgccttggcctcccaaagtgctgggattacaggtgtaagccaccgcrcccggcccaaataaagtcactttctggggttccaggctgacatggatttatgggggacactgttcagtccagcagagggctatacaaacttatgtggttgtgttagcattcttcagaggcttaaccaaaagtcctgtgggtgtggaagtattttcaaacaatcttaatgtggtagcatatattaaggtgaacatgtggtccagttcaaattcctcctcacccctcgctcctgtcctacccacatcttccccaccttcctttacctgacccacatttctcaaaattgtggctcttgttgga

SEQ ID NO: 180758 - DNA, 601 bp, Human
tggagtgcagcagtgcagtatcagctcactgcaacctctacctcctgggttcaagtgattctcctgcctcagcctcttgagtagctgagattacaggcgtgtgccactacgcctggctaatttttatagttttagtagagacaaggtttcaccacattggctgggctggtctcgaactcctgacctcaggtgatccacctgccttggcctcccaaagtgctgggattacaggtgtaagccaccgcgcccggcccaaataaagtcactttctggggttccaggctgacatggatttatgggrgacactgttcagtccagcagagggctatacaaacttatgtggttgtgttagcattcttcagaggcttaaccaaaagtcctgtgggtgtggaagtattttcaaacaatcttaatgtggtagcatatattaaggtgaacatgtggtccagttcaaattcctcctcacccctcgctcctgtcctacccacatcttccccaccttcctttacctgacccacatttctcaaaattgtggctcttgttggataaggaaagggataatatttttttaggggggatggtggtgatgaggaattttatt

SEQ ID NO: 180759 - DNA, 601 bp, Human
gtggtgcaatcatgcctgggtaatttttaatttttaaaattttttgtagtgacaaaggggtctcactgtgttgcccaggctggtcttgaacacctggcctcaggcaaactcctggcctcccaaagtattgggattacaggcatgagccactgtgcctggtatcccctccaatttctgacccctgtcattctggctaccttcccctgagccaggctggctctgtgggcctgtgatctgggataccacacaggaccccatccacaggagggctctgtacttgtttaatgttctcctattgctrtcttgaaattctcaaccatttttgaaggaagggcctcatgttttcatcttgcactggctcttttgaattctgtagctcgtcctactctgaggcagccagtgttggcaatttcgtgtttgggtttgcagaaattttctatgtagatttacaactgaatgtcatttaaaaaatcagagtgtatcatatacgactttgttttcttgacttaataactgcatctcagagttcacagtatagctgcccatgcttattttatttgttttaattttatgatagggtctcactgtgtcacccaggttg

SEQ ID NO: 180760 - DNA, 601 bp, Human
gtgcaatcatgcctgggtaatttttaatttttaaaattttttgtagtgacaaaggggtctcactgtgttgcccaggctggtcttgaacacctggcctcaggcaaactcctggcctcccaaagtattgggattacaggcatgagccactgtgcctggtatcccctccaatttctgacccctgtcattctggctaccttcccctgagccaggctggctctgtgggcctgtgatctgggataccacacaggaccccatccacaggagggctctgtacttgtttaatgttctcctattgctgtcytgaaattctcaaccatttttgaaggaagggcctcatgttttcatcttgcactggctcttttgaattctgtagctcgtcctactctgaggcagccagtgttggcaatttcgtgtttgggtttgcagaaattttctatgtagatttacaactgaatgtcatttaaaaaatcagagtgtatcatatacgactttgttttcttgacttaataactgcatctcagagttcacagtatagctgcccatgcttattttatttgttttaattttatgatagggtctcactgtgtcacccaggttggag

SEQ ID NO: 180761 - DNA, 601 bp, Human
agatttacaactgaatgtcatttaaaaaatcagagtgtatcatatacgactttgttttcttgacttaataactgcatctcagagttcacagtatagctgcccatgcttattttatttgttttaattttatgatagggtctcactgtgtcacccaggttggagtgcagtggcgcaatcatagctcactgcagcctcaaactcctgagctcaagcgatcctcctgtgtcagactcctcagtagctgggactacaggtgtgcaccaccacacctcgctaatgttttttattttttgtagagatrgggtctcactgtatttcccaggctggtctcacactcctggcttcaagtgatgcacccatcttgcctcccgtagtgttgggattataggtgtgagctgctgtgcctggctgccccatattttaatgtctgcaaaatgttccattgtgtgtgacaattttttggcttggtcctctaatgaaaaacattcaggttgttttcagcctctcccccttacaaacagtgctgtaggaattatctttatacataacagatctttgtatccggtatgagtgtgtatatatatatgtaggataaattcct

SEQ ID NO: 180762 - DNA, 601 bp, Human
ttatttgttttaattttatgatagggtctcactgtgtcacccaggttggagtgcagtggcgcaatcatagctcactgcagcctcaaactcctgagctcaagcgatcctcctgtgtcagactcctcagtagctgggactacaggtgtgcaccaccacacctcgctaatgttttttattttttgtagagatagggtctcactgtatttcccaggctggtctcacactcctggcttcaagtgatgcacccatcttgcctcccgtagtgttgggattataggtgtgagctgctgtgcctggctgycccatattttaatgtctgcaaaatgttccattgtgtgtgacaattttttggcttggtcctctaatgaaaaacattcaggttgttttcagcctctcccccttacaaacagtgctgtaggaattatctttatacataacagatctttgtatccggtatgagtgtgtatatatatatgtaggataaattcctggaagacatctgagttaaagtacatacgcgtctcacattttgatcaatattggcaaatgctcctctgttgcagttgtactagtttacatttccaccagctgagtttgagag

SEQ ID NO: 180763 - DNA, 601 bp, Human
gggaaggaagcatgcccttcttcacatgaccacagcagagagaagtgcagagtgaagatggggaaaagccccttataaaaccatcagatctcatgagaactcactcactatcatgagaacagcatgagggaaccactcccataattcagttacctctgactgggtcccttctatgagacagattatgggaactacaattcaagatgaaatttgggtggggacacagccaaaccatatcaccatagatgttgcaaatatttcctccacatttcttacttgtcttttgactttcaaaagggattttttttttgcaatgcagaacttaaattttttttgtgtagccaaatatattaaatcttttctctttgtgattcctgaattcagatttttgttaaggaaagctttctgtgctcagaaattatcagaagaatcatctcatgtttccttctagtacttttccagggaaaataagattttaaatgtcttagtttgcttattttaatcatccttttaaatttaagtgagttacagtagacacaagattaatgtaggtgtccaccaatgttaactcctaggataaaattactacagttattttctg

SEQ ID NO: 180764 - DNA, 601 bp, Human
ggaaagctttctgtgctcagaaattatcagaagaatcatctcatgtttccttctagtacttttccagggaaaataagattttaaatgtcttagtttgcttattttaatcatccttttaaatttaagtgagttacagtagacacaagattaatgtaggtgtccaccaatgttaactcctaggataaaattactacagttattttctgctataaaaaagaagatttcaaagtcatctcttatcccagtttgctgtgatctagtaatttttttttcattttaattgcggaggagaaagaaaagkttttccaaataatgactgctatttttaagatgtattttcctataacaaatatggatctaatgaaataaatatacaaattatttcatgtttaactgtttctattctttttatttctaccttcagagaagtatttgtagtttaccttatgagaagctttgcttaatttgcttttctgtggtctatggacacacttacaaaagtatattcatgaagaagagggctttgtttccagaaagtaggtaaaaatgattatttttatttgtatgctcagattttaaaaggagactcaaaaattctgaa

SEQ ID NO: 180765 - DNA, 601 bp, Human
gactgaacacaaacaaagaagacctagatcgttcagcacagaggtgcccatttagcagaggtatgagtgtctccgggtactcagggctgtaaggaaacacaggatgcaaacccagttagggtggggagagggcttctcaacatatcgatgttactgaacaaactatgttatgttcctaaaatttattctgaaatatgccgtatgtgataagaaatacataatttaaaaaggagtgatacagtgagcaaccattgtatgcactatccagtttaagaaggacagtatactattaccagaaatrtggaagccctctgtgtgcctctctccctgatcccatcccttcccctctgcaccagtgatagtcattggaaagaaagggtcttgctttgtcacccaggctggagtgcagtggcacgatcatggctcactgcagcctcaacctcctgtactcgatcgatcctcttgcctcagcctcctgaatagctgggactataggtgtgcagcaccacacctagctaaattttgtattttttgtagagatggcatctccctatgctgctgaggctggtcttgaattcctgggctcaagcaatcctcctgc

SEQ ID NO: 180766 - DNA, 601 bp, Human
accagaaatgtggaagccctctgtgtgcctctctccctgatcccatcccttcccctctgcaccagtgatagtcattggaaagaaagggtcttgctttgtcacccaggctggagtgcagtggcacgatcatggctcactgcagcctcaacctcctgtactcgatcgatcctcttgcctcagcctcctgaatagctgggactataggtgtgcagcaccacacctagctaaattttgtattttttgtagagatggcatctccctatgctgctgaggctggtcttgaattcctgggctcaagcartcctcctgccttgaccccccaacgtgctgggattactggtgtgaatcactatgcctagaccttatttttcatttaaaaacctttgtcttcttttacctccctgaatatgcacatagtttactatgacacatgtgttcccattgcaattccttattcccaaacaaatataattttcttttagagagcctcttgttcatctgggaagcttgctaggcttgggttcttctctgtgggaaatgtttcaatttccttaatgaatggactgtttaggctatctactttttcataagttggttttca

SEQ ID NO: 180767 - DNA, 601 bp, Human
taatcagtaaccttacttttgtcccaaactttttttttttttaaagccagagtctggttctgtcacccaggctggagtgcagtcgtgcagtcttggctcactgcagcctccacctcccaggttcaagcaattctcctgcctcagcctcctgagtagctgggattacaggcacgcaccaccatgccctgctaatttttttggtatttttagtagagataggggttcaccatgttggccaggctggtcttgaactcctgaactcagatgatccgcccaccttggcctcccaaagtgctgggaygacagatgtgagccaccacacccagtctgtcccaaacattaaaagggcctttagacactttcaccctaatcactctgtttacatgtgtttggtttttcagtatttcagttggcctctcatcctgcttcacaaattaggcatttctatttgttggttgaacaatcaatgtttgttcagatttagatttacccacatatttactattaattttatctttacttcttgaatctgagatattccatctggaattattttcttcttcctgaatacatcctataagtttctttaagtgaagttctc

SEQ ID NO: 180768 - DNA, 601 bp, Human
agttgctattgagaagtcagctgtcagtctcatcactattcttttattgggaaactttgttttttcctttttcttttcctccctttcttcttctgtccattctgtctccttttcttcttcctctttctcttcgtcttcttcttcccctctctctggttgcttttaataatatttctctacgatgtgtctaggtttagagttatttttatttatctagtttagaattattgattgggcttcctgagactaagggttgttatctttcaataagtctagaaaattattagtaattggccaggcragatgttgcatgcctataatcctagcactttgggaggccgaggtgggaggattgcttgagcccaggtgttggagaccagcttgggcagcatagtgagaccttgtctcaaacaattaaattaacaaaaaaaaaatgtttagcaattgtatgcttgagtttaggttttcccctataatctgtatttgcttctccaagagctcctataagacatctgttagctcttctcacactgttttcatacaataatatttcctccacatttttcatcttttttcctctctagattatttgttgtttgtt

SEQ ID NO: 180769 - DNA, 601 bp, Human
tcttttcctccctttcttcttctgtccattctgtctccttttcttcttcctctttctcttcgtcttcttcttcccctctctctggttgcttttaataatatttctctacgatgtgtctaggtttagagttatttttatttatctagtttagaattattgattgggcttcctgagactaagggttgttatctttcaataagtctagaaaattattagtaattggccaggcgagatgttgcatgcctataatcctagcactttgggaggccgaggtgggaggattgcttgagcccaggtgttrgagaccagcttgggcagcatagtgagaccttgtctcaaacaattaaattaacaaaaaaaaaatgtttagcaattgtatgcttgagtttaggttttcccctataatctgtatttgcttctccaagagctcctataagacatctgttagctcttctcacactgttttcatacaataatatttcctccacatttttcatcttttttcctctctagattatttgttgtttgtttgtttgtttgtttatttatttattatttttaaaaatagagacagagtcttgctatgttgcccaggctggtc

SEQ ID NO: 180770 - DNA, 601 bp, Human
ttctcttcgtcttcttcttcccctctctctggttgcttttaataatatttctctacgatgtgtctaggtttagagttatttttatttatctagtttagaattattgattgggcttcctgagactaagggttgttatctttcaataagtctagaaaattattagtaattggccaggcgagatgttgcatgcctataatcctagcactttgggaggccgaggtgggaggattgcttgagcccaggtgttggagaccagcttgggcagcatagtgagaccttgtctcaaacaattaaattaacaaaaaaaaaatgtttagcaattgtatgcttgagtttaggttttcccctataatctgtatttgcttctccaagagctcctataagacatctgttagctcttctcacactgttttcatacaataatatttcctccacatttttcatcttttttcctctctagattatttgttgtttgtttgtttgtttgtttatttatttattatttttaaaaatagagacagagtcttgctatgttgcccaggctggtcttgaactcctgggctcaaacaatcctcccttctctgactcttaaagtgctggg

SEQ ID NO: 180771 - DNA, 601 bp, Human
ttgggaggccgaggtgggaggattgcttgagcccaggtgttggagaccagcttgggcagcatagtgagaccttgtctcaaacaattaaattaacaaaaaaaaaatgtttagcaattgtatgcttgagtttaggttttcccctataatctgtatttgcttctccaagagctcctataagacatctgttagctcttctcacactgttttcatacaataatatttcctccacatttttcatcttttttcctctctagattatttgttgtttgtttgtttgtttgtttatttatttattattttwaaaaatagagacagagtcttgctatgttgcccaggctggtcttgaactcctgggctcaaacaatcctcccttctctgactcttaaagtgctgggattataggcatgagccaccacacccagcctggatgatttctttgactgcatcttccaattagctaattttctcttcacgtgtgtttgtttaatccacatattgggttttacaattccgctattatatctttttattttcaggagttctttttggttcctttctaaatttgcttgattgttctctctaggtatttattctgttttcg

SEQ ID NO: 180772 - DNA, 601 bp, Human
cctataatctgtatttgcttctccaagagctcctataagacatctgttagctcttctcacactgttttcatacaataatatttcctccacatttttcatcttttttcctctctagattatttgttgtttgtttgtttgtttgtttatttatttattatttttaaaaatagagacagagtcttgctatgttgcccaggctggtcttgaactcctgggctcaaacaatcctcccttctctgactcttaaagtgctgggattataggcatgagccaccacacccagcctggatgatttctttgrctgcatcttccaattagctaattttctcttcacgtgtgtttgtttaatccacatattgggttttacaattccgctattatatctttttattttcaggagttctttttggttcctttctaaatttgcttgattgttctctctaggtatttattctgttttcgagtttctcttttatttcactaaatatattaaatatagctgttttatattctttgcctgataattccaatatctgattctgatttttaattccaccttctgttatttcttcatgctctcactatgttttctttttattcc

SEQ ID NO: 180773 - DNA, 601 bp, Human
ttcccttatttatattgtaacttttggcttcaaactgctcatttttaaaaactttattagtggctatcttagtctgttttgtgctgctaaaacagaataccacagactgggtagtttataaacaatagaagtttatttggctcatagctctggaggtggaaagtccaagatcgaggggcagcatttgatgagggctttctggctgcatcaaacatggctgaaggtatcccaggagcaagagaaagggagagcccaaactcacagcctcaagcctttttataaatgtcatcaatcagttcaygagggtggtccccttatggcctcaacagctccccttaggccccacctcccaacactgttgcattggggattaagtttccaacacaagctttttggcggagacattcaaatcacagcagcggatactgtttgaggcctggggtttatttctgctagtttccttagaactgtatcaaacctagacacatcttaaactcagatttccttttaagattttttaggatcacacatggcatgggaatttgaactgcaacctctcatgaattctacttgtggttataaattctcagaggagaatatt

SEQ ID NO: 180774 - DNA, 601 bp, Human
catagggccagattataagtaaaccagctagtggtgtgaaacttggaaaagccatttactgtgtatatttgggtcttgtcagcaattcctgagcatgggtaggggtgtgtgtgtgtgtgtgtgctcttgctgtggtatacaagcacaatgaaagtgtataaaaacaaatgtaaagttcatggttagatttcttaactctggaggttagtcatctttgataaagcaaactgggatgactttttgtgtgagctcctaacttaaggactaagaaatacaaaagatcagtttccgtaaataaacyggctcacaagtgtgcagtagttttaaactttctttttctttgcttcaaggattttgactctttcttctctgcaaaagaagagaatattatttattccttccttggtttggctcctcctccagactcaaaggtaagtttgaacaaactccattggggttcaaaacaggtaatactaaatgaaggtagaaatcaccgcatccaagactgtttaatacatgatgatctctaaattaacatgactttagtacacttcttattctgatgcagtcctatgcatagagagaatgcagtttttactaa

SEQ ID NO: 180775 - DNA, 601 bp, Human
ttttgtgtgagctcctaacttaaggactaagaaatacaaaagatcagtttccgtaaataaactggctcacaagtgtgcagtagttttaaactttctttttctttgcttcaaggattttgactctttcttctctgcaaaagaagagaatattatttattccttccttggtttggctcctcctccagactcaaaggtaagtttgaacaaactccattggggttcaaaacaggtaatactaaatgaaggtagaaatcaccgcatccaagactgtttaatacatgatgatctctaaattaacatkactttagtacacttcttattctgatgcagtcctatgcatagagagaatgcagtttttactaaaaaaagttccaaaattatgcttttcatatttatgctgtgttttcaccttgttacaataaattttataatacctaagttaggaaatatcattactttgaataatcttaagtgcattcattaaatatgtaaacatttgagctcctaggttgtgtttatacaattattttgttttgaattgacttctcatatagctttatatgagttaatttcataatgatatatacccttacattatttc

SEQ ID NO: 180776 - DNA, 601 bp, Human
aaagttccaaaattatgcttttcatatttatgctgtgttttcaccttgttacaataaattttataatacctaagttaggaaatatcattactttgaataatcttaagtgcattcattaaatatgtaaacatttgagctcctaggttgtgtttatacaattattttgttttgaattgacttctcatatagctttatatgagttaatttcataatgatatatacccttacattatttctatttaaatgaaccaaactacattttggtctcataaaaatgggacaggtaagatctcgattcaaygacaaggtaggttttatcagatttttttcttccagtgacgtctcatctttgattatgtataattaaatagagagttatgctaataaagcaggaaccatgaatttgacttgtgtgcatgtttaattcatgtgacttgctaagacttgctgatggattgaatgtggatagggatggattccatgatgacttctaatcagtgtgtgtaaaaatccactctgagagaggaccatattgaggggggaagttaagtttgaatgagacagctgagtgaagaagtgaggtaggcaattgcatactgat

SEQ ID NO: 180777 - DNA, 601 bp, Human
tgagaacgagggactatgcatagacaattattttgggggaattttcccacagagtgaaagagaaaaatggcagacatcattgttttaaaaaatgccctactccttcccaccactggaaatttgggcagagtcccttgcgtccctgcttgctgccggttccctagcttcctctctcctccctatgttctggaaagttcccccatctctgttctttacccaagctcaatctctcgtcttaacccaagttctctgtctttcagtagacatctcccgtattcctactacttctcaatccccttcytccagaccccagacctgtgggtggtaggaggggagagtctagtttttacaaaggcccactagggggttatctaaacaaaagggaattttctatccttggtcaataataatgtggcaaagctttgaaatgacttttttttaaccttttgtaggtcaaatttttgacagagttactgtcttcaccaagagtcccaataaacagaaggggagacggtagtagaaaaatatattttctgtctgttcatcacaaattccaggaatcatgtcttccttatttcttccctttgcaatatctttttat

SEQ ID NO: 180778 - DNA, 601 bp, Human
tgctgcactgtggtggaccagcttcactgtaccttccagatatgagcattttaatgaccttgatcttaggaccattaaattgtattttagaaatttgtttctggttttactgtgctatgaggagggaatttggttttgataaatgtctgtcttaagtgtctttgtaactgaatgtatattttttcatttttgtgtgatattttattttttaagttgacaaataaagtgtatatttaccatgtacaatgtgatgttgtgaaatacgtatacattgtggattggctaaactgagctaattaamatctgcctttcattgaatactttttttttgtggtgagaacacttaaaatctactctcagtgatgttcaaaacacagtgcattgttatttgctatagtcactatcttgtaaaatcaatatcttgaacttatttctcctaacagactattttgctataaaagattgttttctgaatattaaaaaaataacttttttcaaatattacatatatgatattggaaaggtcaaatagtcctacaaagattactttttaaaaaaacagtcctgctaaacatttcatgccagaaaatgccttatattt

SEQ ID NO: 180779 - DNA, 601 bp, Human
gtagaggtggtgattgtggtggtgatggtggagatgatggtggtggtgatggtggtggtggtgacagtgatggtggtgatggtggtagtggtggtgaggtgggtgatggtggtggtgatggtagtggtggtgatgttggtgttggtggtggtgatggtagtggaggtgggggtgatggaaagtgggagataaatctggctgccagtgttctagaagcaagtagggaagggaatggagggtctcccctttcagaatgtgaacttcttatatagaccccttgttttcagtatggttgcctacktcagctggcctcatgcccaggaggtcatatttcctctagttcagcttctacagagacaaaaactgcttatttagaaggggacagtcacttgccgtccagggatgaggagggaaactaaatctacttcttctttctctcacatcgctctttgtaagcaattaggtttcagattttttctggttaagtcaattattactcaacgattccctttactgcctttgaatttccgtagacattttttttttcctgcaaaaagacttcttgtccatttaccctgttcttgtgaatttatccttttct

SEQ ID NO: 180780 - DNA, 601 bp, Human
ggaatggagggtctcccctttcagaatgtgaacttcttatatagaccccttgttttcagtatggttgcctacttcagctggcctcatgcccaggaggtcatatttcctctagttcagcttctacagagacaaaaactgcttatttagaaggggacagtcacttgccgtccagggatgaggagggaaactaaatctacttcttctttctctcacatcgctctttgtaagcaattaggtttcagattttttctggttaagtcaattattactcaacgattccctttactgcctttgaatttcygtagacattttttttttcctgcaaaaagacttcttgtccatttaccctgttcttgtgaatttatccttttctttttaacatctttgttgtattgtcagtggggctctggtaagaagccaaagcaaatatctgttttcagcttctcatgattaactagaaactgcctgtagttttcaatggtcccagtcttcctgaaaaggaactatcatcccctgttattccattaatttctttccatatgttggttaatttaatttaatctatttttagttacataatttgagattaaggattttaata

SEQ ID NO: 180781 - DNA, 601 bp, Human
gggtctcccctttcagaatgtgaacttcttatatagaccccttgttttcagtatggttgcctacttcagctggcctcatgcccaggaggtcatatttcctctagttcagcttctacagagacaaaaactgcttatttagaaggggacagtcacttgccgtccagggatgaggagggaaactaaatctacttcttctttctctcacatcgctctttgtaagcaattaggtttcagattttttctggttaagtcaattattactcaacgattccctttactgcctttgaatttccgtagacattttttttttcctgcaaaaagacttcttgtccatttaccctgttcttgtgaatttatccttttctttttaacatctttgttgtattgtcagtggggctctggtaagaagccaaagcaaatatctgttttcagcttctcatgattaactagaaactgcctgtagttttcaatggtcccagtcttcctgaaaaggaactatcatcccctgttattccattaatttctttccatatgttggttaatttaatttaatctatttttagttacataatttgagattaaggattttaatatctttgct

SEQ ID NO: 180782 - DNA, 601 bp, Human
tccagaatgaatgtggtatcttatttgctttagttaagaaactcaaataggcagggaaattgtaaggccactttgttcctttccccattcctgattctctcctgcattcatcaatttggtatctctctttccacaagcaagacatctttttgtgctgtattttcaatgcctaattgttatattgtatgaaatctgctttttaaaaagacaccatggacattttattaatatttttaaacaacaatagtagtagcagtcgcaacaagaacaaactcttagccaggcattgtggttcgtgccygtaatcctagcacttaggaaggtagaggcaggaggatagtttgagcccaggcatttgtgacctgcctgggcaacatagtgagaccctgttctcaaaaacaaacaaaaacaaacaaactcctagagggctagcaacttaacagatattgcgaagctccaaatgaaattccagccattaaaaaaagtaactcatataatagcattaatagatgtcaaagaaaatatatggataagtgaataatgaggctgacaagttcaagtagattgctccaggtcacaaggctcataatctgtagaccta

SEQ ID NO: 180783 - DNA, 601 bp, Human
ttaacaaagtagccaaaccactgtcactactaatgggactcactgatatcaaatgctgcctgttgcaaacgtgaagtccatagtctcaccagtcaagtgttcttgctaaatcatttcacctgcatccaatccagtctccagctccaagttctagtctataaaaaacacagaggaagaggagcaagttaaataatatcacaaagaaagaatcagacaaaacaaaaatttggaacattcttcaagataactgacccagattcttaaaacattcagtgtcatgaaagaaataaataaaaagagrtggaattgttctagactaaaatagactgaggaaatatgagaatcagatgcaattaatatgttttaagaggttcaagtctaaagaaagtaactgtaaaatatttattgcaggcaacttggggaatttggaaaggaattggatattagatgacattagggagttcttgttagttttcttagatgtgataaaaatactggagttacgtaagagaatgcccttgtttttagaagatgatactagaatatttaagggtgcagtttgataagacagatgaaaatgttagcaagtgttcaatctatg

SEQ ID NO: 180784 - DNA, 601 bp, Human
taaaacattcagtgtcatgaaagaaataaataaaaagagatggaattgttctagactaaaatagactgaggaaatatgagaatcagatgcaattaatatgttttaagaggttcaagtctaaagaaagtaactgtaaaatatttattgcaggcaacttggggaatttggaaaggaattggatattagatgacattagggagttcttgttagttttcttagatgtgataaaaatactggagttacgtaagagaatgcccttgtttttagaagatgatactagaatatttaagggtgcagtttsataagacagatgaaaatgttagcaagtgttcaatctatgtagttcatctttaaaagcttttctttgtctttaaaattttcataatgaagagctggagcaatgcttttttttttgagacagagtctcgctctgtcacccaggctggaatgcggttgcgcagtctcagctcactgcgacctctgcctcctgggttcaagcaattcttgtgcctcagcctccagagtagctggggttacccgtgcccgccaccacgcccagctaatttttgtatttttagtagagacgaggtttcaccatgtt

SEQ ID NO: 180785 - DNA, 601 bp, Human
tttacatttcacaaagcctctgactcagacagcaacacagaagattgttagagataagatgcagaatctgggactatatctttcatatttacatcctcagagccaaatacagctcataactcgtagtaggtgttcacctctgaaattcgaggcaataattaactggggtaccaaagtcaatgaaacactccggagatattcagcaccattcttcaaattgaatgtaaatgggacaggtttgtttattgtaacttgctattttaaaaaaaattatattttgagatctatttatactaatacrtataaatctatttcagcctctgctgtgttttatcttatctcatttttattttaatatctaatctccgtttttagatcctaccctgatttgtgctcaggtactgtcatattatataaaactcttgttttgtggaagaaagggatggccacaggattatgaaacctggcctagagatacctaagaggccgtccagtccagattcttctcttctgagagaagcaacatgaagcccaaggagcttaagtgacttgtacaaagaaccccgctaattagcagtacagttcgtgctagagcctttgg

SEQ ID NO: 180786 - DNA, 601 bp, Human
ccttagttctttaaaagcatgtggtcatatctgattaaatgaacatcattcttaataggacatggcaggcaggacctaggttacataaccaatgttttcaattatgccctggcaagaaggaagacagattcttgttgaagttatgcaaataagtatattgccaaaaaatatatatgtattctgattgaataagcagattcaataagaatttttgaactccagaggaatcgggcagggagaataagaggtcatttacaagtgattcatttcagcttacaaaagcagaatctacaacattatyatgatgtatggaaagcttaagagaaagcaaaaagggcttccttatatataaggaaaataagacattaaaataacatcaacagtattccagacaaaaattactatcatccctcaccaattcatttaatcctatgtaattaattcctattccactggatcttgtggatcttgggttagtcgtctaatgaacccatctgcttctcaacaaaagttctggaaaatttgactaagtccacggatatggtctcaaagttgttttctttttttttttttttttttgagacggagtctcgctctgtcg

SEQ ID NO: 180787 - DNA, 601 bp, Human
tatatgtattctgattgaataagcagattcaataagaatttttgaactccagaggaatcgggcagggagaataagaggtcatttacaagtgattcatttcagcttacaaaagcagaatctacaacattattatgatgtatggaaagcttaagagaaagcaaaaagggcttccttatatataaggaaaataagacattaaaataacatcaacagtattccagacaaaaattactatcatccctcaccaattcatttaatcctatgtaattaattcctattccactggatcttgtggatcttsggttagtcgtctaatgaacccatctgcttctcaacaaaagttctggaaaatttgactaagtccacggatatggtctcaaagttgttttctttttttttttttttttttgagacggagtctcgctctgtcgcccaggctggagtgcagtggtgcgatctcggctcactgcaagctccacctccagggttcacgccattctcctgcctcagcctcctgcgtagctgggactacaggcgcccgccaccacgcccggctaattttttgtgttttttagtagagacggggtttcactgtgttagc

SEQ ID NO: 180788 - DNA, 601 bp, Human
gttgttttctttttttttttttttttttgagacggagtctcgctctgtcgcccaggctggagtgcagtggtgcgatctcggctcactgcaagctccacctccagggttcacgccattctcctgcctcagcctcctgcgtagctgggactacaggcgcccgccaccacgcccggctaattttttgtgttttttagtagagacggggtttcactgtgttagccaggatggtctcgatctcctgacctcgtgatccgcccgcctcggcctcccaaagtgctgggattacaggcgtgagccaccrcgcccggccggtctcaaagttctttaagcaatgccatcagaaacctgaacccaaatgtatttaacatataaccctttactgtggggctctgagcagtcattcttcatgaaagatgaagcatttttgcttgtagctcattacaaataacttcagggaagcatcaaagcaaaacatgctaacaaaaatatctgtagatgacaaaaaacttaaaatgggtgccatttattcattgcttataattttcaaaagtgaaagtctagaaagtcataacaagaataatatatttgatgagaaaatttg

SEQ ID NO: 180789 - DNA, 601 bp, Human
tctatttattaataaaactgtatgagtatatgatgggaattcccaatcgaaaaacactgttgtaaaacatgctagattcagattaaagaaggatcaagttaacatttaaaacaactgaagttatggttgataacttaagcacctgttgtctgataccaggcaaaacaacaatataatcaatgtctttttatttttattttttattttttgagatggagtctctgtcacccaggctggagtgcagtagcacaatcttggctcactgcaacttccgcctcccaagttcaagcactttcctgcstcagcctcccaagtagctgggattacaggtgtgtgccaccacgtccagctaatttttgtattttcttagtagagacggggtttcagcatgttggccaggctgatcttgaactcctgacctcagataatctgcctgccttggctttccaaagtgctaggattacagatgtgagccaccacatccagcaatcaatgtcttttagtacattaatttagtcaggggaatattattatatcaatgaaagacatccagttatttaggcaattagatttgcccttaattgacagagatatacacagc

SEQ ID NO: 180790 - DNA, 601 bp, Human
gctgttggtgtgtaactcctcagtgccaaagcttatacatcccagcgagggctgtccttctcatgggaaccacattaggaagttctaacattccaacagccagacaaacattgctcaaaagaggtttcaaatccctctattagagtcatagtaacatcttctattggaagatggattttcttgtagaacacatttcagtctaatgaataaggcagggataatatatctggatcatgtaacttttggccaaaagtgacttgtgatgaaaagttttgagattcattttccggtatcactagcragtgcctattgaaagcatttttgagtaatggcaaaatatttaagtaagtgtggcatttcctggtgacctgaaggaggaaggccaaactggacagaggacaggcgacttcacttgaaggagtacaaaaggaagaagcagaaggagctttggaggaacatttgttgagaagcataaaagatatgaatttggagcacaaaattcattcaaaagatgttctggaattttctaatttgaaactacaagatgggtccttactgcaggaaagggtatgatatctcaccaattcatttagtcctgtgt

SEQ ID NO: 180791 - DNA, 601 bp, Human
gatgcattctggcctgtagctgagcagagctgagcagtccgacatgtaacttcattgagaaccagaccgcagagttcaaggaggccttccagctgtttgactgaatgggtgatggcaaggcccttacagccagtatggggacatgacgagggccttgggccagagccccaccaatgccgaggtgctccaggtcctgggggaacctcaggagtgatgagatgaatgtgaaggtgctggactttgagcacttcctgcccatgctgcagactgtggccaggaacaaggactagggtgcctagtyttaggattatgtccgagtccaaggattatatggaaggtctttgggtgtttgacaaggaagagaagggcaccatcatgggcgctgaaatccggcaagtccttgtcatactgggtgggaagatgacagaggcagaagtagagatgctggcggccgggcatgaggacagcaatggttgtcaactctgaagagctcgtctgtgtggtgctgagtagctgggcacattcccagcatccccccagccctgtcctttgccctgtgagacactgtgtatctagccccgaaggctttctggtcacagca

SEQ ID NO: 180792 - DNA, 601 bp, Human
actagaaactatgggagaatccctgaaaggttagaaagcaaaaacatttggtttgaagaaggaaatcaaggtccaaatgcctgtcagagatgggagtggctctgtgggccctgcacagcctcagtggtgtgttccagttgcaggaagggcctgggcatgggcttggagcttgaaaggcagagcccacttccatcctgctcttagacctggcaggggtcaacacagtggtcaacagagtgatcaacagggcagggcagtgagcactgagttgggtggggaggcacagcaggtctgagggagstattcttactccagagggacagagagaagtttagatactggcagtcagcctcaaccctggctgcacattagaaatctctggggagctgttaaagctattaggttggtgcaagagtaattgcggtttttgccattaaaaatagtatgccagggctacatttgagagcaattaagcagaagcttcagtcagggagctcccaggtgaacctaatgttttatcaatgtggagagccacttctgtaaaggaaaacattgaataatagtgaaatcaagaattgtaaactatcttggaaagatctag

SEQ ID NO: 180793 - DNA, 601 bp, Human
gggaaataagtgtaagtgttcgaaagggcgcatctcaattgcaggtgaactatcttgatgggaacccatgtattgtgtaactgtgaatgttaatagagaattatgtttaatgatgactattatgaataggaaactaaacagtagtgagatagagaagcatttcagaacatttatgttaacaaggccgggaggcagagctgaggaaaacagagtgaagagaaactttagccagcaatagtaaggaaagggaaaaagcataagagagaagacaggctgtcatgaattaatacagcagaagcawttgaactaactatatcagttgttctaataaatttgaaaaggctaaaattccctggaagaaaagagacgatccgtttggatttttgcacagctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctact

SEQ ID NO: 180794 - DNA, 601 bp, Human
tgtattgtgtaactgtgaatgttaatagagaattatgtttaatgatgactattatgaataggaaactaaacagtagtgagatagagaagcatttcagaacatttatgttaacaaggccgggaggcagagctgaggaaaacagagtgaagagaaactttagccagcaatagtaaggaaagggaaaaagcataagagagaagacaggctgtcatgaattaatacagcagaagcatttgaactaactatatcagttgttctaataaatttgaaaaggctaaaattccctggaagaaaagagacratccgtttggatttttgcacagctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgt

SEQ ID NO: 180795 - DNA, 601 bp, Human
ttaatagagaattatgtttaatgatgactattatgaataggaaactaaacagtagtgagatagagaagcatttcagaacatttatgttaacaaggccgggaggcagagctgaggaaaacagagtgaagagaaactttagccagcaatagtaaggaaagggaaaaagcataagagagaagacaggctgtcatgaattaatacagcagaagcatttgaactaactatatcagttgttctaataaatttgaaaaggctaaaattccctggaagaaaagagacgatccgtttggatttttgcacrgctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgtctttgtttttataatatgttt

SEQ ID NO: 180796 - DNA, 601 bp, Human
gaagacaggctgtcatgaattaatacagcagaagcatttgaactaactatatcagttgttctaataaatttgaaaaggctaaaattccctggaagaaaagagacgatccgtttggatttttgcacagctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacrccctttgtctttatatctgtattatataaagctactctagatttcttatgcttatggtttgcctgggatagtttttccatcgatttcctttcaacttcctatgtctttgtttttataatatgttttttggagacagcatctgattgggttttgtgcatttttttttttttttttgagacagtctcacactgtctggagtgcggtggcatgatcatagctcactgcagccttgacttccctcccaggctaaaatgatgcccctgcctcagccacctgagtagctgggactacaggcatgca

SEQ ID NO: 180797 - DNA, 601 bp, Human
gaaaaggctaaaattccctggaagaaaagagacgatccgtttggatttttgcacagctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctactctagatttcttatgcttatggtttgcctgggataktttttccatcgatttcctttcaacttcctatgtctttgtttttataatatgttttttggagacagcatctgattgggttttgtgcatttttttttttttttttgagacagtctcacactgtctggagtgcggtggcatgatcatagctcactgcagccttgacttccctcccaggctaaaatgatgcccctgcctcagccacctgagtagctgggactacaggcatgcaccaccatcctcagctgatttttaaattttttatagagagagggtcctactagttgcccaggctggtctcaa

SEQ ID NO: 180798 - DNA, 601 bp, Human
gttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgtctttgtttttataatatgttttttggagacagyatctgattgggttttgtgcatttttttttttttttttgagacagtctcacactgtctggagtgcggtggcatgatcatagctcactgcagccttgacttccctcccaggctaaaatgatgcccctgcctcagccacctgagtagctgggactacaggcatgcaccaccatcctcagctgatttttaaattttttatagagagagggtcctactagttgcccaggctggtctcaaactcctaggctgtagtgatcctccctctttggcctcccagagtgctgggattacaggcatgagcca

SEQ ID NO: 180799 - DNA, 601 bp, Human
taaaaatttatattattaggcacatttgtatttataattgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgtctttgtttttataatatgttttttggagacagcatctgattgggttttgtgcatttttttttttttttttgagacagtctcacactgtctggagtgcggtggcatgatcrtagctcactgcagccttgacttccctcccaggctaaaatgatgcccctgcctcagccacctgagtagctgggactacaggcatgcaccaccatcctcagctgatttttaaattttttatagagagagggtcctactagttgcccaggctggtctcaaactcctaggctgtagtgatcctccctctttggcctcccagagtgctgggattacaggcatgagccactgcacccggctggtcttgagcattttaattcatcttgataatctgttataaatcagagtatttagttcattaacaa

SEQ ID NO: 180800 - DNA, 601 bp, Human
tgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgtctttgtttttataatatgttttttggagacagcatctgattgggttttgtgcatttttttttttttttttgagacagtctcacactgtctggagtgcggtggcatgatcatagctcactgcagccttgacttccctcccaggctaaartgatgcccctgcctcagccacctgagtagctgggactacaggcatgcaccaccatcctcagctgatttttaaattttttatagagagagggtcctactagttgcccaggctggtctcaaactcctaggctgtagtgatcctccctctttggcctcccagagtgctgggattacaggcatgagccactgcacccggctggtcttgagcattttaattcatcttgataatctgttataaatcagagtatttagttcattaacaattaatcattgacataattgtgtttaggtttactatttc

SEQ ID NO: 180801 - DNA, 601 bp, Human
ctggagtgcggtggcatgatcatagctcactgcagccttgacttccctcccaggctaaaatgatgcccctgcctcagccacctgagtagctgggactacaggcatgcaccaccatcctcagctgatttttaaattttttatagagagagggtcctactagttgcccaggctggtctcaaactcctaggctgtagtgatcctccctctttggcctcccagagtgctgggattacaggcatgagccactgcacccggctggtcttgagcattttaattcatcttgataatctgttataaatcrgagtatttagttcattaacaattaatcattgacataattgtgtttaggtttactatttctttattttttctattggcctccattttatttatttatttatttattttattttttatttttatttttagagacggagtgatctcggctcactgcaacctccgcctcccaagtacaagcgattctcctgcctcagtctcccaaatagctgggactacaggcgggtgccaccacactgggctgtttttgtatttttagtagagacgggggtttcaccacgttggccagactggtcttgaactc

SEQ ID NO: 180802 - DNA, 601 bp, Human
ttgcccaggctggtctcaaactcctaggctgtagtgatcctccctctttggcctcccagagtgctgggattacaggcatgagccactgcacccggctggtcttgagcattttaattcatcttgataatctgttataaatcagagtatttagttcattaacaattaatcattgacataattgtgtttaggtttactatttctttattttttctattggcctccattttatttatttatttatttattttattttttatttttatttttagagacggagtgatctcggctcactgcaacctcygcctcccaagtacaagcgattctcctgcctcagtctcccaaatagctgggactacaggcgggtgccaccacactgggctgtttttgtatttttagtagagacgggggtttcaccacgttggccagactggtcttgaactcctgacctcaagtaatccacccgccttggcctcccaaagtgttgttgggattacaggcatgagccaccacgcccagccccatttcaatttttattatttaaaaatacaatttccattttatttttctccagagaatagtttttcttcagtcttctaaggcc

SEQ ID NO: 180803 - DNA, 601 bp, Human
gctgggattacaggcatgagccactgcacccggctggtcttgagcattttaattcatcttgataatctgttataaatcagagtatttagttcattaacaattaatcattgacataattgtgtttaggtttactatttctttattttttctattggcctccattttatttatttatttatttattttattttttatttttatttttagagacggagtgatctcggctcactgcaacctccgcctcccaagtacaagcgattctcctgcctcagtctcccaaatagctgggactacaggcggktgccaccacactgggctgtttttgtatttttagtagagacgggggtttcaccacgttggccagactggtcttgaactcctgacctcaagtaatccacccgccttggcctcccaaagtgttgttgggattacaggcatgagccaccacgcccagccccatttcaatttttattatttaaaaatacaatttccattttatttttctccagagaatagtttttcttcagtcttctaaggcctcagctacttacatgggctttggtgggggtcgtggggcagcacccgcaggtctaagtagggg

SEQ ID NO: 180804 - DNA, 601 bp, Human
cattttatttttctccagagaatagtttttcttcagtcttctaaggcctcagctacttacatgggctttggtgggggtcgtggggcagcacccgcaggtctaagtaggggtggaggtgttcggtccttgcaagcttcacgagattgattcctcactactttgctttaatattataaactgcacaactcacacagtaatgtaacttcatatccagcttgggaagcacataggtgtcgaagaagcttgcttagaaatgtccctgactgctgtggcctccactttgtttcaaatgacaaatttyttaatggccttgttcttgggcacacatcaggtatagttcgtgcagcaaataggctacacgtggccatggccctttttggtatgacctttgttccttcttttatttgtcatcttggaggcacagactggagctggtctcccatttttattcctctgttgtatgcttttttgctttcttttgggctttatgaatgtgttttagacttcctttttaacttatctattgtatttttaactatgcctcttggcattatttggtagtggttgttctagtggctataatatgtatgtattttttaag

SEQ ID NO: 180805 - DNA, 601 bp, Human
atagtttttcttcagtcttctaaggcctcagctacttacatgggctttggtgggggtcgtggggcagcacccgcaggtctaagtaggggtggaggtgttcggtccttgcaagcttcacgagattgattcctcactactttgctttaatattataaactgcacaactcacacagtaatgtaacttcatatccagcttgggaagcacataggtgtcgaagaagcttgcttagaaatgtccctgactgctgtggcctccactttgtttcaaatgacaaatttcttaatggccttgttcttgggyacacatcaggtatagttcgtgcagcaaataggctacacgtggccatggccctttttggtatgacctttgttccttcttttatttgtcatcttggaggcacagactggagctggtctcccatttttattcctctgttgtatgcttttttgctttcttttgggctttatgaatgtgttttagacttcctttttaacttatctattgtatttttaactatgcctcttggcattatttggtagtggttgttctagtggctataatatgtatgtattttttaagttttttatttccataggtttt

SEQ ID NO: 180806 - DNA, 601 bp, Human
atttttttgcagctattgtaaaagtagttgagatcttgatttgattctcacttggtcactgttggtgtataggagagctactgatttgtgtacattaatttcatatctggaaactttgctgaattcttttattagttctaagagctttttggaggagtctttggggttttctaggtgtataatatatattcttaacatctcacagtctacttagacttaatgttataacactttcatgtaatatgtagaaacattgccatcatatgcatccattgactgtttcccatcctttatgctataygatcatgtgtatcacatttccatataccattaactctactatgtaatattcccattgaacagtcttcttcctcttcttcttcttcttcttcttttttttttttaagtaggaggtaatcttttgtgcttacccagacttttaaatttctgatgccttatgaagagtgaagtttccatctggtgtcattttctttcagcccaaagaacttcctttagtcctttagcattgtttcatagtgaaggtctgctggcaataagttctttacttttcttttatctgaagtgtctttactttgctttc

SEQ ID NO: 180807 - DNA, 601 bp, Human
acattaatttcatatctggaaactttgctgaattcttttattagttctaagagctttttggaggagtctttggggttttctaggtgtataatatatattcttaacatctcacagtctacttagacttaatgttataacactttcatgtaatatgtagaaacattgccatcatatgcatccattgactgtttcccatcctttatgctatacgatcatgtgtatcacatttccatataccattaactctactatgtaatattcccattgaacagtcttcttcctcttcttcttcttcttcttcttttttttttttaagtaggaggtaatcttttgtgcttacccagacttttaaatttctgatgccttatgaagagtgaagtttccatctggtgtcattttctttcagcccaaagaacttcctttagtcctttagcattgtttcatagtgaaggtctgctggcaataagttctttacttttcttttatctgaagtgtctttactttgctttcattcttgagggatatttcaccggatataagattcttagttgacaggtttttttcctttcaacaccttggatgtgtttttttcccttctgtc

SEQ ID NO: 180808 - DNA, 601 bp, Human
attaatttcatatctggaaactttgctgaattcttttattagttctaagagctttttggaggagtctttggggttttctaggtgtataatatatattcttaacatctcacagtctacttagacttaatgttataacactttcatgtaatatgtagaaacattgccatcatatgcatccattgactgtttcccatcctttatgctatacgatcatgtgtatcacatttccatataccattaactctactatgtaatattcccattgaacagtcttcttcctcttcttcttcttcttcttctcttttttttttaagtaggaggtaatcttttgtgcttacccagacttttaaatttctgatgccttatgaagagtgaagtttccatctggtgtcattttctttcagcccaaagaacttcctttagtcctttagcattgtttcatagtgaaggtctgctggcaataagttctttacttttcttttatctgaagtgtctttactttgctttcattcttgagggatatttcaccggatataagattcttagttgacaggtttttttcctttcaacaccttggatgtgtttttttcccttctgtctt

SEQ ID NO: 180809 - DNA, 601 bp, Human
ctttacttttcttttatctgaagtgtctttactttgctttcattcttgagggatatttcaccggatataagattcttagttgacaggtttttttcctttcaacaccttggatgtgtttttttcccttctgtcttctgatctccatagtttctgatgagacatgatcttgtttcctgtagatagtgtatgatttttctctgggtgcttttaagattttcattttatctttggtctgcagccatttgattatgatatgcctacctatgtttttttttgtgtacttattattattggggttttctgagagtcttgaatctatatcatttaccaaatttagaaaattttcaaccattatattttcaaatattatttctgctccatttgttttcatttccccttctggcactctaattacatatatgttaaatcttttgttattattccacatttccctaaggcttaaaattttttcagtcttgtttttctttgatcttcatattggataatttctattgatttattttaagttcacttatttttgtatttgtcattttcattctgcatccagtctagtaatttttttatttcatatattgtattt

SEQ ID NO: 180810 - DNA, 601 bp, Human
tctgctccatttgttttcatttccccttctggcactctaattacatatatgttaaatcttttgttattattccacatttccctaaggcttaaaattttttcagtcttgtttttctttgatcttcatattggataatttctattgatttattttaagttcacttatttttgtatttgtcattttcattctgcatccagtctagtaatttttttatttcatatattgtatttttcaattctgaaatgttacacttgtttgatttttttaatttctatttttctattgagaatcagttgtttcrttcattgcaagcatgtttgcctttacatctttgagaatagttttaatagctgctttaaaatccttgtctgcaaattccagcatccaggtcttttctgtgttggtcttcattggttgtttttttctcttgagaatgagtaacattttcctggttccttgtatgttaagtattttggatggtatcttgaacatagtgagtcttgtgttgtggagattctgtattttgttacattcttctgaaaaacattgactattgtgtttgtttcagcaggcatttactttgttggacccaaacagcaaa

SEQ ID NO: 180811 - DNA, 601 bp, Human
aggatcttgctatgttgcccaggctagtcttgaacccttggcctcaagtgatcctcccatctaggcctccagagtgttgggattacagatgtaagccatcatgctccttctgaaaagtctaaataaaatattagcgaaatatattcagaagtgaattaaagataattcaccatcatcaaacaatttattcagttgccataattcattacatgaactgattaatggagaaaaaccatatgattgcacctataaatgccaagaagatattcgatataatttatcagatatttctagttaagamtggattaaaatataagtagaaagaaacaaaacataaaatacatttatcagaaggtaattataagtatcataatgaaccatgcaatactgaagcatttctattaaaattagaagcaagataggcatgcctgtcatcaccatattattaaacattgttttaggagccgtagttattgtaataatgtaataatgtgtaataagtcttatgtatataagacatggataaaatttaaaattatctttatttggccgggtgcggtggctcacgcctgtaatcccagcactttgggaggccgaggcg

SEQ ID NO: 180812 - DNA, 601 bp, Human
ctttccaaatattaaaatatgtcctctaagctacagtgataaaagcagtatattggtcttggaactaatacatgtatttatatgtatatctgagaatatatttatatttatatgtttatataaaatattttaatttttattttcattgtatcagtatttatatataggatagtgtagaaacatcaatttatatatattatagtaaatgacaaatatataatctgaatgtaatgggaaatgatgatttatatataatatagacataatttgccatctgtctggaagaaaacaaatgtagacrtcgactttacattatatgctaaattaaattccagatggattaaagctctagatattaataacaatataaagtaatagaagcatattttagagaataaaagttagataaatttgcccataaaaagactaaaaactaaaaaaaatacaacaaaatctgtaaaaactgtagactggaggaaaacatttgtaacatgacaaaggactaaaatttttaatatagaaagatactctaaaaatttatagtaaagcacaaacaactcaagtaaaaatgagcaatgcattcactgcaatgtctacaaaa

SEQ ID NO: 180813 - DNA, 601 bp, Human
aaacttagtcatggtggaaggtgaaggggaagcaaggcaccttcttcacaaggcagcaggaaggagaagtgctgaacgaagagggaagaaccccttataaaaccattagatctcgtgagaactcactcaccatcatgaggacagcatggaggaaaccaccccatgattcagttacctccatctggtctctctcttgacatgtggggattattgacattatggggattataattcaagatgagatttgagtggggacacaaagcctaaccatattatcatccatccatccacctatctatcttctgtctatctgtctatctatctatgtctgtctgcctgcctacccatctgtttgcccatccatccattcctccgtctgtctgtctgtctctgaacattatccatccatccatctatccatccatccatctctccatccatccatgcatccatccatttatccatctatgtatgtttacctgtctactttatctttctaccttatctatcttcttaatttttaatctctaaaattataagcctccctccatacaagcaatagaaaacactgtgtaaagatagaattcttctcctcatcagc

SEQ ID NO: 180814 - DNA, 601 bp, Human
ttagtcatggtggaaggtgaaggggaagcaaggcaccttcttcacaaggcagcaggaaggagaagtgctgaacgaagagggaagaaccccttataaaaccattagatctcgtgagaactcactcaccatcatgaggacagcatggaggaaaccaccccatgattcagttacctccatctggtctctctcttgacatgtggggattattgacattatggggattataattcaagatgagatttgagtggggacacaaagcctaaccatattatcatccatccatccacctatctatcatctrtctatctgtctatctatctatgtctgtctgcctgcctacccatctgtttgcccatccatccattcctccgtctgtctgtctgtctctgaacattatccatccatccatctatccatccatccatctctccatccatccatgcatccatccatttatccatctatgtatgtttacctgtctactttatctttctaccttatctatcttcttaatttttaatctctaaaattataagcctccctccatacaagcaatagaaaacactgtgtaaagatagaattcttctcctcatcagcctga

SEQ ID NO: 180815 - DNA, 601 bp, Human
cccaggagaagaatgtgagttttcgctttttcacagcagtttgactggattctctgctgttcgagacttttacagggcttgtacaacttgactctgggcacaagcagtcagaaagagggcaaggagctgagagtttagccagggaggaagcaagtaatttctactgatgtgttaagcactggaatcctggtgcagagagggctaaagggaagacaaaggagcctgaacccagaccaggagggagccggctggacaaggcttggagaatttgttgtggtggtgttatggctaggttaggtgyatgctctttataaacaagggacctttctgcttgatcatgattaatgacagactcctagcttacacccacccaggagccctgcccagtggggaaatagagctaagggagtgcagtatatctggcggaagacaagaggaacttgaggataaaaaggactccttggggagggaaattgacactcagttaatttaagttcaatcagggaaatagcagatcttggtgaagtcacatgattaattctaaaggggttcccatgcaggagcagcagggtaaggagtgggcaatgttgggggacactgt

SEQ ID NO: 180816 - DNA, 601 bp, Human
ttatatgaatatattactaacatcatattatcaaatttacttttcaactctttaatgccatttatcctacagaaagacagattctgacttcttcctgtttgaaaaccaacacatgctctttgatttactttaattcaattaaattagaaaaaccctctgtgattgtcagtaaacagatgaaaaatgttgtaaaaacatgattaacccttatgagtgtatatgaaaataggctgaattttaaaatttaagaaggagacaaacaccacttagatatttagaatgcttgcattttgtgcttcargaacctactggcttgttttgacggtctctggtttgttgttaaaagctgagatggggccgggcgcatggctcacgcctataatccctgtactttggaaggcagaggtgggcagatcacttgaggtcaagagtttgagatcagtctggccaacatggtaaaaccccgtctctactaaaaatacaaaaattagctggctgtgatggcgcacgcctgtaatcccagctatttgggaagctgaggtgggaggatcgcttgaacccgggaggcagagtttgcagtgagctgagatcgtgccactgc

SEQ ID NO: 180817 - DNA, 601 bp, Human
tggtttgttgttaaaagctgagatggggccgggcgcatggctcacgcctataatccctgtactttggaaggcagaggtgggcagatcacttgaggtcaagagtttgagatcagtctggccaacatggtaaaaccccgtctctactaaaaatacaaaaattagctggctgtgatggcgcacgcctgtaatcccagctatttgggaagctgaggtgggaggatcgcttgaacccgggaggcagagtttgcagtgagctgagatcgtgccactgcactccagtctgggcaatagagtaagaccrtctcaaaaaaaaattgctgaaatgggaggacattgtgggctatttgtaaaggcatctctcctcccagggcaccccaggcatagacaggctgacagggaatcagaaagacaagggagagctctgtgtgttttgaacattgattttgaaagtatgagacacatcctagtagtttcatgtaggtatgacacctcagataaatccaaggctttcaaactcctggctccgttgaaaccatcttgaggctatttctttttgctcctcttggcttgctgtggttaaaacagaggtgctcccctgggc

SEQ ID NO: 180818 - DNA, 601 bp, Human
ggtcaagagtttgagatcagtctggccaacatggtaaaaccccgtctctactaaaaatacaaaaattagctggctgtgatggcgcacgcctgtaatcccagctatttgggaagctgaggtgggaggatcgcttgaacccgggaggcagagtttgcagtgagctgagatcgtgccactgcactccagtctgggcaatagagtaagaccatctcaaaaaaaaattgctgaaatgggaggacattgtgggctatttgtaaaggcatctctcctcccagggcaccccaggcatagacaggctgayagggaatcagaaagacaagggagagctctgtgtgttttgaacattgattttgaaagtatgagacacatcctagtagtttcatgtaggtatgacacctcagataaatccaaggctttcaaactcctggctccgttgaaaccatcttgaggctatttctttttgctcctcttggcttgctgtggttaaaacagaggtgctcccctgggcttccctcattaaccaacacgctgcggtggatataaagtttagaatattcgtgggcccacatttggttcctaagactcctgggcaaggaatgtc

SEQ ID NO: 180819 - DNA, 601 bp, Human
cccagtctggccacctccgtcttgccaattccaagctctttttttttttttcctcagggaccgcctagctttatcaccccattagcctaaggttttgaaaaccaaggtctatactttcttccttaggggtggaaagccagaacaaataggtcgcctgtgggaagagaaaataactcttactctgacccctctaccccctcagctttgtgtagcagaaagaacaagtcacaattcatatcctggccttcagccacacttattatgagaaggaataaaaacagttttaaacattttattctgmaataactatagactcacaggaagtttcaaaaataagagtcttgtgtgcccttcacccaacttccccaaatggtgacatctcatctagccttaatgaaaccagaaatgcaatgcattggtgcatttctgttaactagatgacaaaccatatcaagtttttaccttttttttaaaaaaacctgccttcatttgtgtgttaaaaacaattgtcatgtgtgcagtaaaaacacaaaacgagcaaaaaacctctctccagcacctggcaatgttcagttgagtgataaaccaggtaaatgcctaa

SEQ ID NO: 180820 - DNA, 601 bp, Human
ataactcttactctgacccctctaccccctcagctttgtgtagcagaaagaacaagtcacaattcatatcctggccttcagccacacttattatgagaaggaataaaaacagttttaaacattttattctgaaataactatagactcacaggaagtttcaaaaataagagtcttgtgtgcccttcacccaacttccccaaatggtgacatctcatctagccttaatgaaaccagaaatgcaatgcattggtgcatttctgttaactagatgacaaaccatatcaagtttttaccttttttwtaaaaaaacctgccttcatttgtgtgttaaaaacaattgtcatgtgtgcagtaaaaacacaaaacgagcaaaaaacctctctccagcacctggcaatgttcagttgagtgataaaccaggtaaatgcctaagtcagggacaggcttatctgatctctgctatgaaacatgcatactcaatgcacacttgtaggcactcatacaattccatttaatggagaggaatatttacctaatgtttgacattgattaaaaaaatcaacagaaatggaaacaaaaactattatcttctttaatgata

SEQ ID NO: 180821 - DNA, 601 bp, Human
taactcttactctgacccctctaccccctcagctttgtgtagcagaaagaacaagtcacaattcatatcctggccttcagccacacttattatgagaaggaataaaaacagttttaaacattttattctgaaataactatagactcacaggaagtttcaaaaataagagtcttgtgtgcccttcacccaacttccccaaatggtgacatctcatctagccttaatgaaaccagaaatgcaatgcattggtgcatttctgttaactagatgacaaaccatatcaagtttttacctttttttwaaaaaaacctgccttcatttgtgtgttaaaaacaattgtcatgtgtgcagtaaaaacacaaaacgagcaaaaaacctctctccagcacctggcaatgttcagttgagtgataaaccaggtaaatgcctaagtcagggacaggcttatctgatctctgctatgaaacatgcatactcaatgcacacttgtaggcactcatacaattccatttaatggagaggaatatttacctaatgtttgacattgattaaaaaaatcaacagaaatggaaacaaaaactattatcttctttaatgatat

SEQ ID NO: 180822 - DNA, 601 bp, Human
catggtgaaaccccatctctactaaaaatacaaaaaattagctgggtgtggtagcgggtgcctgtaatcccagctccttgggagcctgaggcaggagaatagcttgaacccaggaggcagaggttgcagtgagctgagattgcgccattgcactccagtctgggcaacgagagcaaaacttcgtctcaaaaaaaaagagtgctaggttcctccatagttgttgctagctaactataaaagttgagacttacattcctataagacttcctactgccccccaggctagctctacggttgacaktatctggttaattcatttgtttcaactgaatataactaataaaaataattggattcagaagaatgtaaaactctacataaccaataattctatggtacatataatgaattttattctgatcctatgtgaagaagaagaaaatcaaagttctttgagatccaaagagttactaacagatttcatgtgttcttctatccaatcactaacacctatttatcgagcttgcctgttggttccagaaagtggcctggaggggccagacagttcccagagatccaaaaatgaataagacacaggtta

SEQ ID NO: 180823 - DNA, 601 bp, Human
agaggggtacacagagccagatggccttttcactgttctaaggaggtgtattagtctgttctcacgctgctaataaagaaatacccaagactgggtaatttataaaggaaagaggtttaatggactcaccgttccacatggcgggggaggcctcacaatcatggcagaaggcgaaggaggagcaaagccatgtcttacatggtggcaaacaagagggcttgtgcaggggaactcccatttacaaaaccatgagatcttgtgagacttactaccacaagaacagtatgggggaacccgcccycctgattcagttacctccacctggccccacccttgacacgtggtgatgattgcaagtcaaggtgagatttgggtgggtacacagccaaaccatatcaggaggatagagtatcttgaggagatggaagtttctaaagatgagggtagtacagtaaggttgggtgctttttggaacgatctctctggctgcagtctggagcacagattggagatgagaaagaaaagaggaggtgataatcactctttaggagcttccttcagcaacccagtgagcaaagatggtggtcatggcagaggaggg

SEQ ID NO: 180824 - DNA, 601 bp, Human
attaatcttgagaggctgcctggtagtgtaacaaagacacttaattaggaatcagtagacttgcagtgagtcctgattgtgttgactccttgtcctgtgacctttgactttggcaaatgacttccctctgtggcctcagtgtcctcatctgtataaacatggtgctgggtagagaatgtatatgactgcaagatcacattcagtgccccccgtccatgattccctgagctcactgcctgaattgtaaggcattaggaatttttagggactgctctcaagaaccacatctctctctttaatkaaagcaattgtggcactctggcttcagggaggtttatcggaccattctgggaagggatggaaaagcttttgttttcttcttagaggcatttttaggagctgtaacctggttattttgctttgatctgggggaaatagaaattccagtgggctggtggcttgcacagtagagacctatttgagccttgggtgaccccacccactcttaccttgcaaatttctttctttacccagaaatcagtatttaaaatactttgtgattcagaaatgttatcattttgttctcatagaggaaaagttt

SEQ ID NO: 180825 - DNA, 601 bp, Human
ccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagcctttgttaacttttgaaatgacaaaattcatgatctttatagaaaatttaaaaaatgcagatagaagaggaaaatgaacatagcttttaaccctcgttacccagagataaccactgtagctacatacacacacacacacacacacacacactgtagctacacacacacacacacacacacactgtagctacacacacacacacacacacacacactgtagctacacacacacacacacaccccatcaatttctggtgaatactcttgtagtctccttttttttcatggaatgtgtctatatttggggaggtagtcagtacagatctgcttcatcattttaaatgttaatatatcaaaccaacccctcttcttagacctatagattatttctagtatattctacaccatgatttctcaatatttacg

SEQ ID NO: 180826 - DNA, 601 bp, Human
taggctcaagtgctctgcccaccttggcctcccaaagtgttggaattacaggcatgaaccaccacgtctgacctagaatctaaattgatgtttgagtcccagggcaaataatgtccaatatgagactggattctacctccccaaagcttgccacttaataccttcttctggtgtagccatgaaccatttagagctccgcctctgggaccaagctgtcaattcagcctattttccatgaaaacacagtgggaaattataattggagatgttgtcttccttatggtgtttgatatgtgtttaygcagagaaaggatataaatctagcttagttttccatgagacaaattccctttcctttcagtggggagcaaatgatgactagtggtttatagaataaaaggcaacactttcctttattgtatgttaagtgatgaagattgtggtaaacattctgtgtctttctctacagtctttccctaatatttgccttttcttttagaaaatggaagctatgaagcaacatttcaaatgtctctccacaaaccaaactcaacagaatactttggcttgaagccggcacacccagggttactgaggactt

SEQ ID NO: 180827 - DNA, 601 bp, Human
caaaatcacggttttgtataactgctgatgaacacttccagagtagtggcggttattttctcagagatcacaactttttacctccccacccccaccccgtaaaaaggttaaggcttcccgaagttggcttggaaactgtatatataaaaacttacacgttccctttctcctggcctcggtgctatcttgactcttttattgtcaaaaaaggaagtacaagcacgaattaaaagccaagcaccagccacaatgtacgcaacgcaaagaataaatttcctttgtagacttaatatttaatatwttttgtcgtcctaagtctcctaacatctgcagcagcattagtgtgatatagttctataaaccaggatgaatatatccattacatttttgcctcgaccactagaaaaattatttaccgtaattattaaagtataaataaagctccaatagctaatcaaaatggaagccccgcattaagaagcagtgtagcctaaggccccgctgcatcccaatgcgcgtttcgaggcttaccttcgctgctgcctttttcggcttcgcttccacttttgcaggaggtttctgaaaggcaaaagcagcactg

SEQ ID NO: 180828 - DNA, 601 bp, Human
gtaaagagggaaacaggcagatatttcagccaattagtttaaaacacacacacacacacacacacaataaaaaaagataggtaataatatactgctcacgccaacatttttaacaaggtcagctaattttttaggccttcaagtttccgtgctgttctaactgtatacagagaattaccacatggtcttctggtaatgagaaatttaaagttgaaaaatactattctcataccttccgtgaagctttatttttaaaaggatcacaaaaacagaactttctgttaaagaaaacatagttaayatttttacactcagctctgtaaaaaatttaaattaaaaaagaaaaaacatctttgttttatacctttatttaacaaggacaaatttagtaattatccaacaactcctcaatgtcaaggaaattaatcttgcctcttctgatgactgcagtgctaaacttctacctacacttttaggaaagaggtgaaggcattaacaaaaattttttttgagacttcaaatagcaaactctcacctaagttttggataaaaattaatcaccccgcgaagaacatgtagagctttacaggtttcaatgcta

SEQ ID NO: 180829 - DNA, 601 bp, Human
ataatgacttttaatacttcaacatcctttgagtaacaaatgataaatgtatttgagacaaaactgctactacacacattgctatcacaaagtttcacaatcacttctgtatttaagaactactcttttgtagtctgtttctaaagatttctcattaatttcataatcattccaatacaaaaaatacaaaactgggaaacagttaaaatagaatacataatatcttggacttgaaataataccacgtgtaaccattatcagctgaaaagctagattaaaaaaaaatcaatcaagtttcccraagtataatgtttggaccttcaaaatatttagttctagggaaagatacaagtcagaagcacacacagtgacaagatatgccttgaaaacatgtctactgtgtagtatgataatcgatacaccaagtgcttacgttctgtttagacttcaaagtctgatcaaccatgaagtcaaaggtgtattacagaaacgagatgtaaaaatgaacaaatcccttctgccctttttccttttgggaaaactgacctcataggctcgttcctcaacaaacactgacatgaagacttacctgttggcctct

SEQ ID NO: 180830 - DNA, 601 bp, Human
aaaacaataaagattcagcctggctaacagacactgtctctaagaataaagattaatgacactagtctttttatttacttgatctatgttattatttagacctttaagaaaaatacaaacaaaaacattttcattagaaatgaaagtgggaaaaaaatgccaggaaaaatgcaagtaaggggaataaattttcaaaaatatatttaaaagcaacatccagaatataaaaacaaaacaaagattgaattatatctgaaattgagcatattaaaatttcttgctcttaaataagccatttacrtatttactttccaataacataaatcatagaaaaccatttgtccaatcactttgggataccgtacaaaactttgttcaatattataatgaatactgttatctgctacaaaaaatgtacaatttagtatctactgttcagagtcaaagcaatcacacacacacacacacacacacacacacttctgacctcctcagtcttcgtttccccgttttccgcaggtaagtcttctttagtttcttggttagccacttcggcctgttttccctttgctccccttttcccttttgtttgcactttttt

SEQ ID NO: 180831 - DNA, 601 bp, Human
attttattttgtttatttattttttgagacagagtcttgctcttgttgcccaggctggagtgcaatggcgcaatctcagctcactgcaacctctgccccccgagttcaagagattctcctgcctcagcttcccaagtagctgggattacaggtgcccgccactatgcccggctaatttttgtatttttagtagagacgaggtttcaccatgttggccaggctggtctcgaactcctgatctccggtgatctgcccaccttggcctcccaaagtgctgggattacaggtgtgagccactgcrcccagctaatttttatttttttgagagggagtctctctctgtcacccaggctggagtgcagtggctcaatcttggctcactgcaacctccgcctcccaggttcaagcaattcttctgtctcagccttccaggtagctgggattacaggtttgagccactgcgcccagctaatttttatttttttgagagggagtctctctctgtcacccaggctggagtgcagtggctcaatcttggctcactgcaacctccgcctcccaggttcaagcaattcttctgtctcagccttccaggtagctg

SEQ ID NO: 180832 - DNA, 601 bp, Human
attattttttgagacagagttttgctcttttgccgaggctggagtgcagtggcgctatctcggctcactgcaacctctgcctcctgggttcaagcgattctcctgccttagcctcccgagtagctgggattacatgcatgcaccaccacacctagctaatttttgtattttttttagtagaaagagggtttcaccatgttggcctggctggtctcgaactcctgacctaaggtgatccacctgcctcagcctcccaaagtgcggagattacagctgtgagccaccacacctggccgacaattttttttttttttttaacttttaagttcagggatacatgtgcgggtttgttatataggtaaacttgtgtcatgggtgtttgttgtacagattatttcgtcacccagttattaagtctagtattcattagttatttttcctgattgtctccctcccaccccctatcctccaccctccaaaataaaaaaatttgtttttagaggccgggtcttgctctgtgactcaggacctgtggccacatcctgtgctgcctcatacaaccttatggcctctctaacctcaacccagttagctttcctaa

SEQ ID NO: 180833 - DNA, 601 bp, Human
tcgcccaggctggagtcccatggcatgatctcagctcactgtagccttgaactcctgtatacgagagatcctcccaccccggcctccagagtgttagggttgcaggccgagccaccatgccaggctgaggcatctttctaagtgtctttgttgaaagtgagaagactggcttccgttactctcaatatgtttatttctgtgatcacccttttgtaattaatctctggtgtccaccgcccactgttacccaagtgaatgcatgcctctccccacctgggctccgaccctggcagggttcctkcttgtcttgtatgtctgtctccctcaccctacagaccctgactcctgtgtcaggctgccctttcttggggacccctgtatcaccatgcctggccctgatgcctcttgccagggtgccattctgtgggaaggccctctgcactgagcttgggcactgacattctgccctgggcccctgcctcaccactgttaccctgcacctgcaccttgctctgccccgtctaatctaggactgaattcttctgggaggggagaggttacatgttccctgtcactggaataacagctctggtgatggaat

SEQ ID NO: 180834 - DNA, 601 bp, Human
tctgaggcactgtcatttgctaagagattaagtttccgcagacaaaggagttaggccagcaaccctctttcatgtctcttctgagcggcctgttcaagccaggaaggggacagatgacaatcgaaggaatgctgtggggggatggagggaaataaagcatcccccaccattgaaacttacacagggctcacctctgcgtcccttgctaacactggtgtacgtgggagaattcactattttttccaaggatggctttcgtcactaataaggtgtgttgagcatacagtctggctactcaaasgagatactcagtgagaaaagcacacccgtgttatgggagactttggttagtttatcagctaatttaaattatgtgtagattgtgttcatcctaaaacagtgaaatgccagttcacataggaaggctcgcctacttgttggcagtgttcagacatgctgctgagctcgtctttaatttgactttctcattcaaggtttcaccaagggacattagtggctgtgcgtgctcatctgttgtctgtggggactgggttcctaggcttgaggtgctcagtctggagagttttcctggttttatttt

SEQ ID NO: 180835 - DNA, 601 bp, Human
ggcacaatctcgtctcactgcagcctccgcctcccgggttccagcgatttttctgcctcagcctccctggtagcttggattagaggcgtccgccaccacgcccggttaatttttgtatttttagtagagaccaggtttcaccatgttggccaggctggtctcgaactcctgacctcaggtgatccgcccgcctcggcctcccaaagtgctggtaatacaagcgtgagccaccgcgcgggccagatttttccctttgtaattaaccatcaaggggatgaccatttgagcttgtgtaaataakagcaggcttccctagttgtcttttgcccaaaagttttagcatccatccaagacctttgtctgaaattctgtcccttttgagattactttgcattaatatgaccaaccactgcgatcaattttattccaaagagtgttggggctgtgatttcaaccctagctgcacatatatcaccggtatcgctgggagtggaacccaagcaatcatattttaaaattctccaggatgactgattctgatgtagagtaagggttgagattccccgagttagaggaaccttacaacaccctcatttgcaaa

SEQ ID NO: 180836 - DNA, 601 bp, Human
catgctatgacaagcatgaacactgaacattactcgaagtaaaagaagcctgtcagtcaaaagggccacatagtgtacgattccatttatatgaaatgtcaagaataggcaactccagagacaaagtcaatttgtgactgccaggggtcaggagggagggggaatgaggagtgacagctaatgggttcagggtttctttttggggtgaaaatgttctagaattagatcgtggtgatgggtgtgcaactctgcaaatacactaaaaaactactgaattgtatactttcaaagggtaaatttygtattttaaattatctttataaagctgtttttaaaaagaatacaaagtagacccatgtagcttttaacttcattcagcaattgttagtattttgccacattcactttctttctcctatacacatatgtgcataaacatatgtgcacagtctacggcttgacactttgatcctaaatacttcagcatgtggagtattctacataaccaaaatataaatattacactggagaaattcaacaccaatatacaacaattatagtccatagtcgaatttatattttatcagaaattaagcattct

SEQ ID NO: 180837 - DNA, 601 bp, Human
gggcaactttaccattccactgcttgtgtcttttctaatgtacttttcattacttgtatcatatttaaaaccacagaaaatatctcagcatcccagctggagtaacatttctgaagagaacatgctaacttgttaatgaaataatgaatactaaagttaaatgcatatatagtctcctgtcactgccctcccattgttattttgaaacatttccaagctccagaaaagttacgagaatacaaagtagtggaaaaattggaaccgtcatacagtgctggtagactgtaaagtggtgcagacrtttttggaaaataatttggcaactcttcaaaaagttaaagtagctcagcaaaatccactcctaggtatatatccaagagaaatgaaaacatcctctcacataaaaacttgtactagaatgttcataacattattaatagcgaaaaggtagaaataactccaatgtccatcaagagaccagtggttaaacaaaatatgatctatccatacaatggaatattattcagccacagaaaggaatgaggaactgactcatgctatgacaagcatgaacactgaacattactcgaagtaaaagaag

SEQ ID NO: 180838 - DNA, 601 bp, Human
gtcctggctgtgtatgacttctgctggggcaactttaccattccactgcttgtgtcttttctaatgtacttttcattacttgtatcatatttaaaaccacagaaaatatctcagcatcccagctggagtaacatttctgaagagaacatgctaacttgttaatgaaataatgaatactaaagttaaatgcatatatagtctcctgtcactgccctcccattgttattttgaaacatttccaagctccagaaaagttacgagaatacaaagtagtggaaaaattggaaccgtcatacagtgstggtagactgtaaagtggtgcagacatttttggaaaataatttggcaactcttcaaaaagttaaagtagctcagcaaaatccactcctaggtatatatccaagagaaatgaaaacatcctctcacataaaaacttgtactagaatgttcataacattattaatagcgaaaaggtagaaataactccaatgtccatcaagagaccagtggttaaacaaaatatgatctatccatacaatggaatattattcagccacagaaaggaatgaggaactgactcatgctatgacaagcatgaaca

SEQ ID NO: 180839 - DNA, 601 bp, Human
ctggaacactacacaaatcatcagtggatacgtccaagggcagaacagggagtcaggaagagtaaggagacttcacttttcattttaccttcttctgtagcacgttaatttttttttttttttttgagacagagtcttgctctgttgcccaggctggagtgcagtggtgtgatcttggcttactgcaacctctgcctcccgggttcaagtggttctcaaacctcagcctcccaagtagctgggattacaggcgtgcaccacacccagctaatttttgtatttttagtagagatgaggtttygccacgttggccaggctggtctcaaactcctgggctcaagtgatctgcctacctcggcctcccaaagtgctgggattacaggtgtgagtcaccgcacccagctgggatattacattttaacgtttatattttttaaatgcttcaactgtaatttttaaaaaatcattttgtcagtgagtattttttcttaaaaaaaaggtcaattttaaatctaagtataacttaggtttctctggtgtccacagaatcaagccattttcaaatgcttccacaactaagatactgaaaagcacaataaca

SEQ ID NO: 180840 - DNA, 601 bp, Human
taggtgtttccatgggaaatttaatctttcactggaagtagggaattagggaatgtttaacacaattcctgattatctcatatcacccatgggtctttggaaacagaagtcaagtttttaggccaggtgtggtggctcatgcctgtaatcccaacacttttgtcaggccaaggcaggaggattgcttgaggccaggagtttgagaccgacctgggcaacatagcgtgatttcatctctatcttaataaaatacttaaaaaaagaagttttctacccaagtggaaggatgcttagggagaasgtgccccaacagcaatgctgcaagcttggagaaagggtctatattcacgctgagccacaggaactgggatgaagaccctggaaaatcaaaccttggacaattttctattatattccattcctgaatcagagagaaaaccatatttataggaattctggaatctctactcccaatttatttgaatcatgatcttaagaatgactattttaaagcaaatacaagtaatggtgggtgcaatgtgtagctctggggctatgtcaaaataagaataaatcttatcaacatctgtctgaaattgat

SEQ ID NO: 180841 - DNA, 601 bp, Human
cagtccccctggcatgtccctgaattctctgggcctcagtcttctgaaccacaaaacggagaaaacgctacctcttaacagtatatggaggattaaagcactctgtgagctggaaaaggctatcctagtctacctagttataaaacagtattagttaggtgtttccatgggaaatttaatctttcactggaagtagggaattagggaatgtttaacacaattcctgattatctcatatcacccatgggtctttggaaacagaagtcaagtttttaggccaggtgtggtggctcatgcctgtaatcccaacacttttgtcaggccaaggcaggaggattgcttgaggccaggagtttgagaccgacctgggcaacatagcgtgatttcatctctatcttaataaaatacttaaaaaaagaagttttctacccaagtggaaggatgcttagggagaaggtgccccaacagcaatgctgcaagcttggagaaagggtctatattcacgctgagccacaggaactgggatgaagaccctggaaaatcaaaccttggacaattttctattatattccattcctgaatcagagagaaaaccatattt

SEQ ID NO: 180842 - DNA, 601 bp, Human
acagacttcggagcgtggaaaagaacatgacaatgccaccacctattactgcggcccccacgaggtgttggaagctaggataagtgtcttaaaacactatctcatttaatttttaaaatacaacctttgagtaggtatcatctccattctacagatgagaattaagacccagagaaggcacaaagaatcctggatttaggaataaaaagatgcaacttcaaatatttgctatcatcagtccccctggcatgtccctgaattctctgggcctcagtcttctgaaccacaaaacggagaaaaygctacctcttaacagtatatggaggattaaagcactctgtgagctggaaaaggctatcctagtctacctagttataaaacagtattagttaggtgtttccatgggaaatttaatctttcactggaagtagggaattagggaatgtttaacacaattcctgattatctcatatcacccatgggtctttggaaacagaagtcaagtttttaggccaggtgtggtggctcatgcctgtaatcccaacacttttgtcaggccaaggcaggaggattgcttgaggccaggagtttgagaccgacc

SEQ ID NO: 180843 - DNA, 601 bp, Human
ttttgatcaagaacacatctgctgcactaagcaaaggagttgcagcaacaccaaaatcacacttggctctcacggccaaaatcgccgtcacctccgtatgttctccttggtcactgactctccttcctccaagcagacatagacagtgggcacatatttgacaatctgtgaagcatctgacaagcactcattatgccatttggagggtgtactaacgtaactagcattgtggcatacaaagggcaattctaagggtgaacagacttcggagcgtggaaaagaacatgacaatgccaccacmtattactgcggcccccacgaggtgttggaagctaggataagtgtcttaaaacactatctcatttaatttttaaaatacaacctttgagtaggtatcatctccattctacagatgagaattaagacccagagaaggcacaaagaatcctggatttaggaataaaaagatgcaacttcaaatatttgctatcatcagtccccctggcatgtccctgaattctctgggcctcagtcttctgaaccacaaaacggagaaaacgctacctcttaacagtatatggaggattaaagcactctgtga

SEQ ID NO: 180844 - DNA, 601 bp, Human
attctggatttataaaaacaaatgaattatatttacactacagaaagatttactgcaggatttttctaaccaataagctcccctacagcgttccaagacacaaagtaatttacagtgcatttgagtccaactttttgatcaagaacacatctgctgcactaagcaaaggagttgcagcaacaccaaaatcacacttggctctcacggccaaaatcgccgtcacctccgtatgttctccttggtcactgactctccttcctccaagcagacatagacagtgggcacatatttgacaatctgygaagcatctgacaagcactcattatgccatttggagggtgtactaacgtaactagcattgtggcatacaaagggcaattctaagggtgaacagacttcggagcgtggaaaagaacatgacaatgccaccacctattactgcggcccccacgaggtgttggaagctaggataagtgtcttaaaacactatctcatttaatttttaaaatacaacctttgagtaggtatcatctccattctacagatgagaattaagacccagagaaggcacaaagaatcctggatttaggaataaaaagat

SEQ ID NO: 180845 - DNA, 601 bp, Human
gatggctaacaagtcagtttgttttctgaacggaagcttaaacctagaaaagtaactgggttggggtgggggtgtagccacatgcagtaaaagcactgcctgtctgtataacaacgacctgatgaaaaaaggaacgcgtgaaatggggagtgttagggcgtcacaaactccagtgtggttgaaatgaaagcagaaagcaaatggcaagctggcttccccttccagcttttcacaaccctgccttgctcatggtcagccccaagcacgggcggaagaaaggactggaggggagggaaagggrtggggagcgagggtaccagaggcgtgggaggacggggacaaaggggcagcaagggaccggcggaaaggaaagtcggcgttagctggattggaaacagtccagacagaacgatgggctctgctgcctccgggtggggcaccaagcggggagcggggccacgaggcaggggacagtgaagcaccatgcagcgcccaccagccggcagcgcccaccagcctgcgctgcgctgcacatggtacccgcggccccagctggccagtgtgtggcggagatgagaccctcgtgaagagactaagcggc

SEQ ID NO: 180846 - DNA, 601 bp, Human
caacaggtgaagcccatgctctgggggcttatgttttagtatcacattctggggcagaaccaacatggtaaaacatagctggttccttctacgtatggtatagtatacacacaggcgtcaatactaagtaaaatgggctgacaaaaagcatactgtccaatagtgtgatgtgaaacttcaaaatctgaaactttcttgagagcctggaaaagaaactgaagccactgaacaaaagtttaaaagaaagggaaaaatactattcataaaaagtaaacattaataaaagtaagtatatgcaggrtctttagcagcagagtattaaattctaatcatggtgtgttgcgtggcttcaggagttagatagcacatattaacaaaattatgttaatagagactacctgatttcagatttcaataggatggagcatccctagtctgaaaatctgaaatctgaaacgttccaaagtccaaagctttctgggcactgacatgacattcaaagaagaccctcactggagcatttcggattctggatttttggattagggatgctcaaccattaaatatctacaaatactccaaatctgaaaaaattccaaaa

SEQ ID NO: 180847 - DNA, 601 bp, Human
atggtaagtaatggccagtattatgtgaaatttactgaagttccaggaaagagaattttgcatggaatacactatctccaaactatcatttaaactgagatactccaatgcagttcatttcctggtacagaaacaaacaaacaaacaaacaaactaagacaatgccactcagcaaccccattcctagattttaaaacccaagtgaaatgaaagctatgttcacacaaaaatcatgcccaagtgcttctgggagctttattcatcatcacccaaacgtcttctacaggtgaatagatgaacraactgtgatacatctatgcaagggtggacaactcggccatcaaaacgaatgaactattaacacacaacctggatgaatccgaacgaaatgcattacgctaatgataaagccagattcaaaggctacaaagcacataatcatatttatgccagttacgtgacattctggaaaaagcaaactatagggactgaaaacaggggctacaaaggagcacaggggaatttggggggtgtcagatctgttccatatcttgaattgtgggtggctacagtctcaaggaactttatactgaaaagagtc

SEQ ID NO: 180848 - DNA, 601 bp, Human
cccagctacttgggaggctgaggcaggagaatcacttgaactcaagaggtggaggttgcagtgagctgagatcacgccactgcactcctgcctgggtgatagagtaagactctctcttaaaaaaaaaaaaaaatcaagttggaccatactgaaactttttgtgtatgacaaatgtagcaaatacttaaatgtaaaaactgaaataataaaagttttggacaaaaccatagagaataatttttttcacatctaagtgggaaaggcctttctatgaatgcctcaaaactctgaataaatatgrccacaaatatgactatgaacaataccactatataaatgataaactaggtaaaatacctacaacttaatataacaaattagcaaagggctgatttccctaatattttaagaatgcctaaaagaaatcaatgaaaggctgggcgcggtggctcacgcctgtaatcccagcactttgggaggccgaggtgggtggatcaggaggtgaggagttcaagaccagcctggccaagatgttgaaaccccatctctaccaaaaatataaaaattagtcgggtgtggtggtgcacgcctgtaatcccag

SEQ ID NO: 180849 - DNA, 601 bp, Human
ttctctactaaaaatacaaaaaattagccaggcatgatgatacatgcctatagtcccagctacttgggaggctgaggcaggagaatcacttgaactcaagaggtggaggttgcagtgagctgagatcacgccactgcactcctgcctgggtgatagagtaagactctctcttaaaaaaaaaaaaaaatcaagttggaccatactgaaactttttgtgtatgacaaatgtagcaaatacttaaatgtaaaaactgaaataataaaagttttggacaaaaccatagagaataatttttttcayatctaagtgggaaaggcctttctatgaatgcctcaaaactctgaataaatatggccacaaatatgactatgaacaataccactatataaatgataaactaggtaaaatacctacaacttaatataacaaattagcaaagggctgatttccctaatattttaagaatgcctaaaagaaatcaatgaaaggctgggcgcggtggctcacgcctgtaatcccagcactttgggaggccgaggtgggtggatcaggaggtgaggagttcaagaccagcctggccaagatgttgaaaccccatct

SEQ ID NO: 180850 - DNA, 601 bp, Human
gggccgggcagggtggctcacgcctgtaatcccagcactttgggaggctgaggcaggcggatcacctgagatcaggagttcaagaccaacttggccaacatggtgaaacaccttctctactaaaaatacaaaaaattagccaggcatgatgatacatgcctatagtcccagctacttgggaggctgaggcaggagaatcacttgaactcaagaggtggaggttgcagtgagctgagatcacgccactgcactcctgcctgggtgatagagtaagactctctcttaaaaaaaaaaaaaaatyaagttggaccatactgaaactttttgtgtatgacaaatgtagcaaatacttaaatgtaaaaactgaaataataaaagttttggacaaaaccatagagaataatttttttcacatctaagtgggaaaggcctttctatgaatgcctcaaaactctgaataaatatggccacaaatatgactatgaacaataccactatataaatgataaactaggtaaaatacctacaacttaatataacaaattagcaaagggctgatttccctaatattttaagaatgcctaaaagaaatcaatgaaag

SEQ ID NO: 180851 - DNA, 601 bp, Human
ggatacactagacaagctgattctgaagtttatatgcaatgataaatctgaaaagaaggaaattggagaaactagccctgtgagatattacaacgctgctataatttacaaagtgtcatacagcacacatgttcaggctgaaagatcaacagaacaaaagtctagaaatagacccagacagtatgggaagctaatgtttgataaaggtagcatttaaaatccttagggaagagagggaatattcaataagtgatactgggaaactggccagagaactcaaccaaaaaaaattaagttgggmcgggcagggtggctcacgcctgtaatcccagcactttgggaggctgaggcaggcggatcacctgagatcaggagttcaagaccaacttggccaacatggtgaaacaccttctctactaaaaatacaaaaaattagccaggcatgatgatacatgcctatagtcccagctacttgggaggctgaggcaggagaatcacttgaactcaagaggtggaggttgcagtgagctgagatcacgccactgcactcctgcctgggtgatagagtaagactctctcttaaaaaaaaaaaaaaatcaag

SEQ ID NO: 180852 - DNA, 601 bp, Human
aaactcccagatgacaaaacttaaaacatgcctgaaagccacaaaagaaaatttgaagaaatggccaaccatgccagattttgaatgggaaagatttaatgcccttaacaaatctactttcccagaagttggtttataaaggcaacctaatcttaaaagaaaataacaccacaattgtttttcttttttgagggggagatggcgggagtgggagggatacactagacaagctgattctgaagtttatatgcaatgataaatctgaaaagaaggaaattggagaaactagccctgtgagatrttacaacgctgctataatttacaaagtgtcatacagcacacatgttcaggctgaaagatcaacagaacaaaagtctagaaatagacccagacagtatgggaagctaatgtttgataaaggtagcatttaaaatccttagggaagagagggaatattcaataagtgatactgggaaactggccagagaactcaaccaaaaaaaattaagttgggccgggcagggtggctcacgcctgtaatcccagcactttgggaggctgaggcaggcggatcacctgagatcaggagttcaagaccaac

SEQ ID NO: 180853 - DNA, 601 bp, Human
tataagtcaatttcacaggaaatgtctaaaactcccagatgacaaaacttaaaacatgcctgaaagccacaaaagaaaatttgaagaaatggccaaccatgccagattttgaatgggaaagatttaatgcccttaacaaatctactttcccagaagttggtttataaaggcaacctaatcttaaaagaaaataacaccacaattgtttttcttttttgagggggagatggcgggagtgggagggatacactagacaagctgattctgaagtttatatgcaatgataaatctgaaaagaagraaattggagaaactagccctgtgagatattacaacgctgctataatttacaaagtgtcatacagcacacatgttcaggctgaaagatcaacagaacaaaagtctagaaatagacccagacagtatgggaagctaatgtttgataaaggtagcatttaaaatccttagggaagagagggaatattcaataagtgatactgggaaactggccagagaactcaaccaaaaaaaattaagttgggccgggcagggtggctcacgcctgtaatcccagcactttgggaggctgaggcaggcggat

SEQ ID NO: 180854 - DNA, 601 bp, Human
ggattaactccatttaattgtaagaagaagactgagataagtgatgattataatgaaagaagagaatgcaaaatataagtcctgacaatgtagaatgtaatcgacactagctgggagactaagagaactagaatctaggaagtagtataatgtacatggctttcccatctttgatggctgggatttaaaaatgtattattcaaaccatacttccatacttttaagacagggtcttattgtcacccaggctggagtacagtagtgtgatcatagctcactgcaacctccacctcccaggctycagtgatcctcctgcctcagcctcctgagtggctgggactataggcacacaccaccacacccagctaatttttgtattttttgtagagatggggttttgctgtgttgcccaggctagtcttgaactccagggctcaagcaatcctgccttggcctcccaaagtgctgggattacaggtgtgagccactgcacctggtctacacttttcagtatggtagctgtaagccatatgtgactattgaaacttaaacttatattaatagttaaaattcaggaccttccatttcaagtgtttaatag

SEQ ID NO: 180855 - DNA, 601 bp, Human
aaccacacagtagcgcctgaggatggtcccgttcctatgcagtcataaccctttccgtcagtctcacgggaacaggtctctgggtctccctgatgggcatattctaactatgacatcagtaaagccttttccctccttaatccctgcagcgtaggaggaaaaaagtagtgacatacctcggaagtaagcagagtaaatattttatgactcgagacacaatatagtacagaaaatacaaaattaacatttgtggataaattagatattcttataatatacaggtttattcaactcctaccartgaaagaaggatagggaattagcccacctgaggccgagggccaagggatttagaaacaggagacggtttaacagagaggcaagatctgtctacacaatgcttgattgatcctggcagaggaagataggatacactggtagaacagacattaaggaaaacccaagatctcaccaagaacttctccctcagattttcgtctagactttcatcaggaagacataagatttatggctccagatagtactaatacctcgtccaacatcacaagcagaggccttcaactgggggccgtgactacaa

SEQ ID NO: 180856 - DNA, 601 bp, Human; identical to SEQ ID NO: 33822

SEQ ID NO: 180857 - DNA, 601 bp, Human; identical to SEQ ID NO: 33823

SEQ ID NO: 180858 - DNA, 601 bp, Human; identical to SEQ ID NO: 33824

SEQ ID NO: 180859 - DNA, 601 bp, Human; identical to SEQ ID NO: 33825

SEQ ID NO: 180860 - DNA, 601 bp, Human; identical to SEQ ID NO: 33826

SEQ ID NO: 180861 - DNA, 601 bp, Human; identical to SEQ ID NO: 33827

SEQ ID NO: 180862 - DNA, 601 bp, Human; identical to SEQ ID NO: 33828

SEQ ID NO: 180863 - DNA, 601 bp, Human; identical to SEQ ID NO: 33829

SEQ ID NO: 180864 - DNA, 601 bp, Human; identical to SEQ ID NO: 33830

SEQ ID NO: 180865 - DNA, 601 bp, Human; identical to SEQ ID NO: 33831

SEQ ID NO: 180866 - DNA, 601 bp, Human
cagaaaaagcccctggccatccatcaggaaagtacttactgaagccaaattgggagcttaagaaaagaacaaagccataaatcgctctttctggcaatggcgacggtgaattttccaccatttttcctggggctttagacaatctgtggaaaaggaacacaatcagcgtcagcgatgtgctccgtggcaccattgatccattctcgcctcctcgctccgccgcgggtacggcccccgccgcgcagaaccgcctcccgcgcctccgtccgcaacccgcgcccccgcctcgagcgcatacagrcacccaggctggcgcgcgccccgcaacagaaggggtggcggaggatagggcagggaggggggttctggggcgatagacgcgcgctccagctctgcaagcgtggcctccctgtgggaggggagggcagggaacaaggctcgcgcggcgcccaccagcatgcgggcctactaggtcgcggcgcccaggccccgggccctgcccattcgtggagacttctatttctcattcgaggcggggtatgggggggccctcgacctcgggtccttcatacgcccacccaggcccctcccgacacctcgg

SEQ ID NO: 180867 - DNA, 601 bp, Human
cacgagatcccttcagattttcttaaaaagagacatagggagaaagaatcaacagttcatgtgtgcacagtctaaccaatgtattcttcccttgtcactgaacgccagaaaaagcccctggccatccatcaggaaagtacttactgaagccaaattgggagcttaagaaaagaacaaagccataaatcgctctttctggcaatggcgacggtgaattttccaccatttttcctggggctttagacaatctgtggaaaaggaacacaatcagcgtcagcgatgtgctccgtggcaccattgrtccattctcgcctcctcgctccgccgcgggtacggcccccgccgcgcagaaccgcctcccgcgcctccgtccgcaacccgcgcccccgcctcgagcgcatacagacacccaggctggcgcgcgccccgcaacagaaggggtggcggaggatagggcagggaggggggttctggggcgatagacgcgcgctccagctctgcaagcgtggcctccctgtgggaggggagggcagggaacaaggctcgcgcggcgcccaccagcatgcgggcctactaggtcgcggcgcccaggccccgggcc

SEQ ID NO: 180868 - DNA, 601 bp, Human
ctcagcctcccgagtagctggagttacaggcatgcgccaccatcccggctaattttgtatttttagtagagacagggtttttccatgttggtctggctggtctcaaactcccgacctcagatgatctgcctgcctcggccacccaaagtgccgggattacaggcgtgagccaccaggccggccagaatttaagccttaaagtgattgcttttatttattcatatagcttctaatccttgacatactctttgaacaaggatttacaaaagtgctaacaataacatcagtagctaacacttaytaagtccctaactgttcctaggcattattttacgtgctttacataaattacccccgttaatcctcacaacagtcagaagaggcagcagagtgaagtcagccagtgtatttgggttcaaatttagaaggcttttatttagtagctttgcaatcttgagcaagttactgaaaccacaggatgctcatctttaaaggacagtaataacagaacctaccccatagaactgtttcatgcgtcataagcatttaataaccatcattatcactacccttttacagataaggaacctgaggctcaaaa

SEQ ID NO: 180869 - DNA, 601 bp, Human
atcccacgataacaacaatggctaagttctgagcactcactgtgggttaagcacagttccaagcattctgtatgcattaagataatcctccaagacaatcctccaaggcaagtatgcaattttaaatgatgaggaaatggaagcttagaaaggatacatcacctacccaaggtaagcggcaaagataaattttaactacctactacatcagtgatgatgcattcttttcttaacaaatatgtattacagaattctgtatgtcaggtgtgtgagacacaatattgaatccaaaagagatggmttctgccctccctaaacttaaaatctagtggtgaatagagaaaattggtattttcactacattgttacaagtgctcacgaatgagtaataaaagatgacatagaagcacattagaaggccctccttccacttcgtatcctccttccctttgcttaatttctccccatagtacgttatcacctgatactatatacgtttttcttatttaacttgcccattgactatctccccccggcatgagaatgaagactcaaagcagggcatttttggctgttttggtccttcctggcctgtaacagt

SEQ ID NO: 180870 - DNA, 601 bp, Human
cgtttgcacaattcttataatacttataattactgtattagtctttttttttaatatcttaactcacattatattttaagcaattcaaggatacaaatcatggcttagcaattgttgtaatccttattacctagcagtttgctttaggtacagtaagtgttcaatacttcatccccacaaggttgaagtaattatagacatttaattgctcaaagggaaatttacctaccctagttctcatccaccacatactgagcttctgccctatctcccagagtacaatgttatttccctcaatccsaaatctcggcactctttactgttatcccacgataacaacaatggctaagttctgagcactcactgtgggttaagcacagttccaagcattctgtatgcattaagataatcctccaagacaatcctccaaggcaagtatgcaattttaaatgatgaggaaatggaagcttagaaaggatacatcacctacccaaggtaagcggcaaagataaattttaactacctactacatcagtgatgatgcattcttttcttaacaaatatgtattacagaattctgtatgtcaggtgtgtgagacac

SEQ ID NO: 180871 - DNA, 601 bp, Human
gggagggcagggcaggcctcccagctttgagggctgagggagatttgaaggctgaagacttcatatggtctttaaacatgttttcagttcaacccagaattaaagagctacctggtaccccaatgtctgagctattctggagttctaaggcacaaatattcttgctggcttccctacttcagcaacgtgaaaatcacagaaacaaaggcagttacctctcacctatcacaatccactttccaaaatgtggttgatatctcttttctgctatactattgtttctgtggtttgtatcttcagttttttttttttttcctgtagggtcattttaacaagatttttggaggaaatggatggagataaacatgtgtgttcatgctaccatctttaattagagatgtatcaatagcgatctttaaaaagctttcaatttctatatggctattcatgaattttaagagaacaaatatttaagatttgggtaggtttaagaaatgatatgactcctcaaaacagcattaattatatcctcatttaagaaatatattaaacttacttttgaggccaataggttaaacctaaagagtttagccaagattca

SEQ ID NO: 180872 - DNA, 601 bp, Human
ggactctattatgcctctcagtatcattatgtacatggagtgctatttttcattgagtgttttttttttctttttgagaaagcatttccctctgtcacccaggctggagtgcaacggcatgatcacagatcactagcctcaatctgctgagctcacttcagccctgcaagtagctgggactataggcacacaccaccacacctggctaatttttaatttttttgtagaaatggggtcttgagatgttggccagatgtttttttttttttaaatgatttgttctctattattttctctttckggaacttctaatagtttgaatttttaacgattatactttcttatattttcatttttttttgttctaacttctagagattacctttgttttattttccagtctttcaattaaaattttaattttggttatcatgtttacaatttccaaatacagtaatttcctgtttgcatagcattctgttcttgtttcatagttataattgtttcttacctctgagaattttatgttatttaaatttttttttctgtttcctgcattatctctatttccttcaaattccctttaattttctgctttttc

SEQ ID NO: 180873 - DNA, 601 bp, Human
tttcccaggaatccaccaataccagagcctcaaattctctgataggactctattatgcctctcagtatcattatgtacatggagtgctatttttcattgagtgttttttttttctttttgagaaagcatttccctctgtcacccaggctggagtgcaacggcatgatcacagatcactagcctcaatctgctgagctcacttcagccctgcaagtagctgggactataggcacacaccaccacacctggctaatttttaatttttttgtagaaatggggtcttgagatgttggccagatgtttttttttttttaaatgatttgttctctattattttctctttctggaacttctaatagtttgaatttttaacgattatactttcttatattttcatttttttttgttctaacttctagagattacctttgttttattttccagtctttcaattaaaattttaattttggttatcatgtttacaatttccaaatacagtaatttcctgtttgcatagcattctgttcttgtttcatagttataattgtttcttacctctgagaattttatgttatttaaatttttttttctgtttcctgca

SEQ ID NO: 180874 - DNA, 601 bp, Human
cttcatgcaaatatttccttttatataagtttgtatttatttctcttagtagcttctttttactgtccgtgtgtgtgtgtgtgtgtgtgtgtgtgtgtgtgtgtgtgtgtgttttcttttaggatggagtttcactcttgtcacccaagctggagtacagtggtgggatcttggctcactgcaacctctgcctcctgggttcaagtgattctcctgcctcagcctcccaagtagctgggattacagacgcgcaccaccaacatgggttttgcagcctgttctttgttgcttttctgggtaraagtgctaatactccactctttcattgccccagcactttccttttatataaagttacctgtgattgtatggatggagtcgagtggagaggtactcatcatgttaatcccaaacaagagcacgtagccaattactatagcaataaggaggtagacaggtaatgcaactgcccaatatctgccaaagagaatattaaagtacataatagacactttaaaaaagttgtaattctcaagagtcggtcacaaagccaacatgttttttaaatttaaattttataaagtaatatgtgtacataaga

SEQ ID NO: 180875 - DNA, 601 bp, Human
ccactgaaagttctttggttagttctgataatccttagattaaaaatcaagaacattttactagacacaaatcaaaataattttcttctttttagggtgtgcaatataaagattatatccaaagtgagaggaatttgggtgagtacgttggtatttttaatgttaatttatggaaagactacaaagggaggtccatccatcctgtcatagcaatacaacatttttatatgccttttaaaaatgtattcttactagtttttcactagaaatcagaacttttctttgttaaaatagagttttwgccagcacttaaatattcttaacatttaacaggctagaatacttcattcattcatttcttccctctccatatccatttttgcctttttactattaagtgttgattcattaaaaaaatgaggcacaaacattaattttaaactttttttttaattaagaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtg

SEQ ID NO: 180876 - DNA, 601 bp, Human
gtttcaacatcaaaacagttccgtaatatcacgattgcatccctgtgtggacgccaagtaagttactatatgttgctcattttgtgtggacagtgataaacatgttacccaataccaagaaatgcaagttcaatggaaggcttatgtcttattcttgtatgctgctcaacgtttgtgtaatagggtggaaaaaacaaatacttgagatttggatatgaatgaataattgtaacataatcagtgaaattctgaatagtactagatggtagactggaagctgagtcaggaggaattaacatgkgtgtttataagtatcagtgttatagtgcagaagagaggaaaaagatacagtattttgttcatttaataaatagcttagttattgttacctagagtgaagaaaaagagaacttattttttaatggtttgagatatatagctaagcataaagttcaatgaatttgtatatatgagaatctaatcttttaaaaaataaatttgtctttaagcaattcacgtgcttctgagataaatttgaagaaactacaacatcttgagttgatggaagatattgtggatttggcaaagaaagttgctgtaa

SEQ ID NO: 180877 - DNA, 601 bp, Human
tttcaacatcaaaacagttccgtaatatcacgattgcatccctgtgtggacgccaagtaagttactatatgttgctcattttgtgtggacagtgataaacatgttacccaataccaagaaatgcaagttcaatggaaggcttatgtcttattcttgtatgctgctcaacgtttgtgtaatagggtggaaaaaacaaatacttgagatttggatatgaatgaataattgtaacataatcagtgaaattctgaatagtactagatggtagactggaagctgagtcaggaggaattaacatggktgtttataagtatcagtgttatagtgcagaagagaggaaaaagatacagtattttgttcatttaataaatagcttagttattgttacctagagtgaagaaaaagagaacttattttttaatggtttgagatatatagctaagcataaagttcaatgaatttgtatatatgagaatctaatcttttaaaaaataaatttgtctttaagcaattcacgtgcttctgagataaatttgaagaaactacaacatcttgagttgatggaagatattgtggatttggcaaagaaagttgctgtaag

SEQ ID NO: 180878 - DNA, 601 bp, Human
tagctaagcataaagttcaatgaatttgtatatatgagaatctaatcttttaaaaaataaatttgtctttaagcaattcacgtgcttctgagataaatttgaagaaactacaacatcttgagttgatggaagatattgtggatttggcaaagaaagttgctgtaagtggtagaatgtaggttcccccgagcccttggtttaaataatataagcatttatatggtgttaggctcaaatgactaatttatagcaattaacaggtaatggttttagttttggttaacctgagataaatctgctrtccatcagtgcgtgctcagtatttgagagatcagggagatggctgatgtcatggttctacgctggggaccaggactgcatcttgtcattaaaggatagaaattggaacttgtcacagaaagtggggtatgggttcatgaaaacctttgccacaggttctgaaagtgatgtgctctatctgttgatataaaatcacatcaccatcaacaaatattttgtctttgggtaggtagactttatcagggcagatttgaggaggtgtccttcattatgctattgagataagttgagagtttttgtg

SEQ ID NO: 180879 - DNA, 601 bp, Human
gtgctctatctgttgatataaaatcacatcaccatcaacaaatattttgtctttgggtaggtagactttatcagggcagatttgaggaggtgtccttcattatgctattgagataagttgagagtttttgtggtttttaatttttttttgaaagctattggatagctttttaaatttcagttggttatggagtcaagtgttgttcttggtactattaaatttagaaagggcattctgatgtttattttctgcagtagttatttgcagtaacatacaaaccagtgtacctttataaaaaaawttaagtgcaatgaactttattattattattatttttgagatggagtcaccctctgtcgcccatgctggagtgcagtgacgagatcttggctcactgccatcttcgcctcccggattcaagcgattctcctgcctcagcctcccgagtagctgggactgtaggcgcctgccaccatgcccagttaactttttgtatttttagtagaaacggggtttcaccctgttggccaggctggtctcgaactcctgacctcagatgatccacccgcctcggcctctcaaagtgctgcgggattaccag

SEQ ID NO: 180880 - DNA, 601 bp, Human
attatactaagttattttactgctagaaccctattggagactattttggaattcttgtcttaagatcttaaggggtaacttggtcatgtaaatgcttgtcggaagtgtactactgagtacatatagtagtgttcctaaaatgtaggccatttttccgttagaaaattcaagtagaattgactgaataaggaaaaaatatgtcctttttttatttttcagaatgattcattccttattggaggcttattgagaattggttgtaaaatagaaaatgtaagtgttaaacactgaaactggcacrgccactgtggatgagtggcagtcatctcactgctcatttccccttgcattgggtccatacactcaatgttctatatgtggtatttggtagtattgacttctatattttccttaaggagactcctcattttgggggtttggatcattttctctcttttttttttttttacccatgtacatagtgtaattttgagcctattttacaagttgattctttttctcttttagattatttacctggcttatgtttccccaaatgaaattattaggcctctggtatgaatattttttgttatataat

SEQ ID NO: 180881 - DNA, 601 bp, Human
aagtgtactactgagtacatatagtagtgttcctaaaatgtaggccatttttccgttagaaaattcaagtagaattgactgaataaggaaaaaatatgtcctttttttatttttcagaatgattcattccttattggaggcttattgagaattggttgtaaaatagaaaatgtaagtgttaaacactgaaactggcacagccactgtggatgagtggcagtcatctcactgctcatttccccttgcattgggtccatacactcaatgttctatatgtggtatttggtagtattgacttctrtattttccttaaggagactcctcattttgggggtttggatcattttctctcttttttttttttttacccatgtacatagtgtaattttgagcctattttacaagttgattctttttctcttttagattatttacctggcttatgtttccccaaatgaaattattaggcctctggtatgaatattttttgttatataattactaggtaatctccagattcaatgttaaaccaatttttaatgatactgatgccataaacatctatgtttaccttaagcccattgttaactttaatttttga

SEQ ID NO: 180882 - DNA, 601 bp, Human
caagtagaattgactgaataaggaaaaaatatgtcctttttttatttttcagaatgattcattccttattggaggcttattgagaattggttgtaaaatagaaaatgtaagtgttaaacactgaaactggcacagccactgtggatgagtggcagtcatctcactgctcatttccccttgcattgggtccatacactcaatgttctatatgtggtatttggtagtattgacttctatattttccttaaggagactcctcattttgggggtttggatcattttctctctttttttttttttwacccatgtacatagtgtaattttgagcctattttacaagttgattctttttctcttttagattatttacctggcttatgtttccccaaatgaaattattaggcctctggtatgaatattttttgttatataattactaggtaatctccagattcaatgttaaaccaatttttaatgatactgatgccataaacatctatgtttaccttaagcccattgttaactttaatttttgaagttactttagacattagaagtacaaataacatttctgtgaattcttgatccttcatggagatca

SEQ ID NO: 180883 - DNA, 601 bp, Human
ggcacagccactgtggatgagtggcagtcatctcactgctcatttccccttgcattgggtccatacactcaatgttctatatgtggtatttggtagtattgacttctatattttccttaaggagactcctcattttgggggtttggatcattttctctcttttttttttttttacccatgtacatagtgtaattttgagcctattttacaagttgattctttttctcttttagattatttacctggcttatgtttccccaaatgaaattattaggcctctggtatgaatattttttgttayataattactaggtaatctccagattcaatgttaaaccaatttttaatgatactgatgccataaacatctatgtttaccttaagcccattgttaactttaatttttgaagttactttagacattagaagtacaaataacatttctgtgaattcttgatccttcatggagatcactgcactgagtgcccatttgcccagccacatcttcctcttgttctttatctccttattcttctgtttgccacagaccacgtaaaatatgtagttcctttggagaactttaatctataaatttaacctt

SEQ ID NO: 180884 - DNA, 601 bp, Human
tgcattgggtccatacactcaatgttctatatgtggtatttggtagtattgacttctatattttccttaaggagactcctcattttgggggtttggatcattttctctcttttttttttttttacccatgtacatagtgtaattttgagcctattttacaagttgattctttttctcttttagattatttacctggcttatgtttccccaaatgaaattattaggcctctggtatgaatattttttgttatataattactaggtaatctccagattcaatgttaaaccaatttttaatgawactgatgccataaacatctatgtttaccttaagcccattgttaactttaatttttgaagttactttagacattagaagtacaaataacatttctgtgaattcttgatccttcatggagatcactgcactgagtgcccatttgcccagccacatcttcctcttgttctttatctccttattcttctgtttgccacagaccacgtaaaatatgtagttcctttggagaactttaatctataaatttaaccttggggtaaggatggaagtctttgtgtagatgagatctgagaaccctcatcc

SEQ ID NO: 180885 - DNA, 601 bp, Human
atcaattgacaattgttggcctatgttaagtattttctttactgaatgtaagtataaatgctttaaattgttacttgactcagtttttaaaggtgtttgggaaaatgagatatgtagttaagtgatttctgatttatcttagaatttaaaaaaagtttttattttgttatatatggctgaaaaagagaatttcttttttttattatttatttatttatttatttatttattttgaggcagattcttgctctgttgcccaggctggagtgcagtggtgcagtctctgctcactgcaagctcygcctcccgggttcacaccattctcctgcctcagcctcccgagtagttgagactatgggcgcctgctaccacgcctggctaatttattgtatttttagtagagacagggtttcaccgtgttcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaattttcactg

SEQ ID NO: 180886 - DNA, 601 bp, Human
gttaagtgatttctgatttatcttagaatttaaaaaaagtttttattttgttatatatggctgaaaaagagaatttcttttttttattatttatttatttatttatttatttattttgaggcagattcttgctctgttgcccaggctggagtgcagtggtgcagtctctgctcactgcaagctccgcctcccgggttcacaccattctcctgcctcagcctcccgagtagttgagactatgggcgcctgctaccacgcctggctaatttattgtatttttagtagagacagggtttcaccrtgttcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaattttcactgaatggatattgtaagttgttatatgtaatactcaaagagaccacaactgggtagtctcctttgtaagaaaaagtcactgaagctaagcttatgatttttattttcttcatgaatct

SEQ ID NO: 180887 - DNA, 601 bp, Human
tcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaattttcactgaatggatattgtaagttgttatatgtaatactcaaagagaccacaactgggtagtctcctttgtaagaaaaagtcactgaagctaagcttatgatttttattttcttcatgaatctgttrttcttttatgtatgaggtaactgccttacatatttcttttactttgtgaaatatttttctttaaagcatttgaatattagcagtgtttttatagtatagttataggaatcttgaaacaggaaaggtttggcttttcagtagatgatgaccaataatttaccatctctgctgagataaaggcaaattttgcactattgacttaagtgctagaaaggaattaaatgaagacacatctttctcataggtttattagacactggggtgtattacactgatagaggttgttctcttcattgtttt

SEQ ID NO: 180888 - DNA, 601 bp, Human
gtcctagctacttgggagactgagatgagaggatcccttgggcctgggagatggaggctgcagtgagctgtgattgcaccactgccctccaacctgggtgacagaccctgtctctaaaaatatgtgtgtgtgtgtgtgtgtgtgtgtgtatagtgggtgtgtatatatatatgtaacaaaatattgggtattgtaatctcattttctacataaataatcccctatgttatttctgatatcgaagatagaaatccagatccatttttactaggtattgggttcttgatgatttttggaggtmattgatgggtcttctttcaccttggtttctcaggaaggagaactaatgaaaatgaaaggaaatgaagagttttccaaagaaagatttgatatagctattatctattacaccagagccattgaatataggtaagagcaaatagaacaaaagagatgctttttctatggcacatcaagttagaatggtagtcagaagaaataaaaacaagacggagaattggagagtatcttccaacttgtgcagaatagattttctcatccttgggtgttggaagcattggagatggcctgggtatatgaa

SEQ ID NO: 180889 - DNA, 601 bp, Human
aagatagaaatccagatccatttttactaggtattgggttcttgatgatttttggaggtcattgatgggtcttctttcaccttggtttctcaggaaggagaactaatgaaaatgaaaggaaatgaagagttttccaaagaaagatttgatatagctattatctattacaccagagccattgaatataggtaagagcaaatagaacaaaagagatgctttttctatggcacatcaagttagaatggtagtcagaagaaataaaaacaagacggagaattggagagtatcttccaacttgtgsagaatagattttctcatccttgggtgttggaagcattggagatggcctgggtatatgaagctaacgtagtagcataactcaagcaagtcaggcaaaatggtgaattttctgttccattttctttaaaactttccagtacagagttacctcttttgtcttgttctcattttgctatcaaccaagtcctcccaagttattaactggtcaaaaaggattaaaggattagttcttaatagttaagatgccacccattcagggttttttgctttctaagagggaacttttacaggataattgaga

SEQ ID NO: 180890 - DNA, 601 bp, Human
tttgaatatagggaagtttaggttggttcaaacaaagttacttatgtaagaagtgaaggaacggggacttcgccagttaagactccaggtcctatattctttttgctttgccacacatatgtaaagtttaaaaaaagttttctcatgccttatgttttctacgtgatttttatttgtttcatgtgtaatgtgctttactgactaaacattgtatctttttaagacctgaaaactaccttctttatggtaaccgagctctttgttttcttcgtactggacagtttaggtaagttggttaaartatctcaaccactgaattattatgctaaatacccatttttgggaaacgtttctgtttttcaggtatacaagaaaatccttgactggttctttggcagaaatacttaagtggttaaaagagtatgcttaggctttatatataataacaacagtgacagcagcagctattctgattgagtgcagacatatgttaagcattattttaagtgctttgcatatgttatttggttctcacagcacccgtaataggtaggtaatgttatagtccacattttacatgaccaaagtgtaccactagtaa

SEQ ID NO: 180891 - DNA, 601 bp, Human
cacacatatgtaaagtttaaaaaaagttttctcatgccttatgttttctacgtgatttttatttgtttcatgtgtaatgtgctttactgactaaacattgtatctttttaagacctgaaaactaccttctttatggtaaccgagctctttgttttcttcgtactggacagtttaggtaagttggttaaaatatctcaaccactgaattattatgctaaatacccatttttgggaaacgtttctgtttttcaggtatacaagaaaatccttgactggttctttggcagaaatacttaagtgsttaaaagagtatgcttaggctttatatataataacaacagtgacagcagcagctattctgattgagtgcagacatatgttaagcattattttaagtgctttgcatatgttatttggttctcacagcacccgtaataggtaggtaatgttatagtccacattttacatgaccaaagtgtaccactagtaaatagtgataccaagatttgaacacagattttatctgatgatgtcaaagtctgtgtttgtggcacctatattacctctttatgctctgttaattaatccatatagtataaaa

SEQ ID NO: 180892 - DNA, 601 bp, Human
tccacattttacatgaccaaagtgtaccactagtaaatagtgataccaagatttgaacacagattttatctgatgatgtcaaagtctgtgtttgtggcacctatattacctctttatgctctgttaattaatccatatagtataaaagaagcattttcatcttttctctgtttatcctggtataaaaaattaagtaaatatccttcataagtgaaagaaagcaaataaatttaatattatgagagtggagtcataattaattccagttccttatattgaatttgagctgagtttttatttrttagctaagaaagatttagagaaagatactgcaccatgattttattgttccccagtataaaatttttagaacataaattatatatattgagcattaatattgagcaggtagactattatatttaattttgtcctgccttactgtaagaaaggtgtagggtgaattcaagaatacatccacacagtagaagaatattcaaaataaaacaaaccagaaaacgaagttggaatctgggattctcagaaccaagctacataggcataaggtcctgcataggtattagttataattcatatttgc

SEQ ID NO: 180893 - DNA, 601 bp, Human
tgctggatctgctgtggaaatctggctgagcagctgcagggacagctgggggtaaagcatccaccctcccccagtttggcgaggatgcactcctcagctgttctggaaggccagacttcttatctgctgtcattgaagcaagaattgagatgtccaaagagaacagaaatgggacaatttaatactagaaaggaataaaagggttaaagtcttgaatgctaaaacttctgaaataattaatttatcctgaaagattagaaaatataagttgaaactttaaatgaaaaagagattcaatttaaaaaagaactttggcaagattgatatctaaaagggtaaaaataataatactgtatcttacaacatggttatcactgttctgagcatttaatgtgtattaactcgtaaaaccatcacaactacgtgaggtaggtgctactgcctttttacagatgatgaaacaggtatagggaggccaagcaaagtgtctgaggacactaggtggatgtgatggagccagaatttgaacccaggcagcctggatgtagagtctctactattaatcactatgggaaggtggtgatagaataaaagggaatgt

SEQ ID NO: 180894 - DNA, 601 bp, Human
acaggtatagggaggccaagcaaagtgtctgaggacactaggtggatgtgatggagccagaatttgaacccaggcagcctggatgtagagtctctactattaatcactatgggaaggtggtgatagaataaaagggaatgtgaaagtcgaaaaaattaaaaaataaatggtctaaatagtcaataaacgtttatgaggaaatgattatccttccaggacatgtagattaaaaactacgagtttctcatttatacccatcagatggacaaaagcttaaaaatctcataataccaagtgtttkagaggatgtggaacaaaggagactctcatattcagctggagaaagtgtaaattggtacaatcactttggagagcaatttgacaaggtgaagatgtgcatactctgcaacccacttctaggctcatatcctctgaactctcaaatgtgtacccaagaagatatgtacatgccttcatgatagcattgtttgtaagagtaaagaaatgaaaacgacctaaatggccatcaataggggaatggataaatatggtatattcatacaatggaattctatatggcagttaaaatgaacgcaatgtt

SEQ ID NO: 180895 - DNA, 601 bp, Human
taagagtaaagaaatgaaaacgacctaaatggccatcaataggggaatggataaatatggtatattcatacaatggaattctatatggcagttaaaatgaacgcaatgttgagtgaaaaagcaagtcacagaatgatttgtacactgtgatgccatttattaatgtttaaaaacatgcaaaacaatatgcatatatacagactgtgtattaacaatgtttaaaaatgcatgggcatgttaaacacccggggagtggctggggagagaaggagggaaaagggattggagttgggaggggtgrtacacggtgggtgtcaactgtaacaaactactacaaaaagagctgaagtatatggcaacatgttaatttcttgctaaggtggtatgccattggtacatgggtgttcattttgttaatgttctctgtacttttatgtatacttgaaatatttgataaaaagtaaaacaaaatgtaattaaaatgcacatgataaaaggaacagaaaaagaacagaaacagtgaccactaaacatcaaggataaaatagtgaacaatgatcttgaaaagagaaatataagtattgtaaggccagttgcagaa

SEQ ID NO: 180896 - DNA, 601 bp, Human
gttaatttcttgctaaggtggtatgccattggtacatgggtgttcattttgttaatgttctctgtacttttatgtatacttgaaatatttgataaaaagtaaaacaaaatgtaattaaaatgcacatgataaaaggaacagaaaaagaacagaaacagtgaccactaaacatcaaggataaaatagtgaacaatgatcttgaaaagagaaatataagtattgtaaggccagttgcagaagcgtgaagtgtgcatggggaagcctgaggtgaggtatatatggggaaacagatgcttccttatggtggcagtggcagtgatgattttaatgccaaaatagtcatacagtttgtaaatccaaccacttttgggtgaatataagttaggccaagagcctttcaaaacccccctgggcctgcgaatgttgcgcttggaaaacgcaggagatggggttggaatgaggcaggggttggggaactgcgctgcctcctgcgcccccactcctgccgcagcctctccccttcaaatcttcacattgaggattgtgtttatcccaggacacctggcttagaagatgagatgtccgttttattctgctcctt

SEQ ID NO: 180897 - DNA, 601 bp, Human
ttaatttcttgctaaggtggtatgccattggtacatgggtgttcattttgttaatgttctctgtacttttatgtatacttgaaatatttgataaaaagtaaaacaaaatgtaattaaaatgcacatgataaaaggaacagaaaaagaacagaaacagtgaccactaaacatcaaggataaaatagtgaacaatgatcttgaaaagagaaatataagtattgtaaggccagttgcagaagcgtgaagtgtgcatggggaagcctgaggtgaggtatatatggggaaacagatgcttccttcaggtggcagtggcagtgatgattttaatgccaaaatagtcatacagtttgtaaatccaaccacttttgggtgaatataagttaggccaagagcctttcaaaacccccctgggcctgcgaatgttgcgcttggaaaacgcaggagatggggttggaatgaggcaggggttggggaactgcgctgcctcctgcgcccccactcctgccgcagcctctccccttcaaatcttcacattgaggattgtgtttatcccaggacacctggcttagaagatgagatgtccgttttattctgctccttc

SEQ ID NO: 180898 - DNA, 601 bp, Human
caaccacttttgggtgaatataagttaggccaagagcctttcaaaacccccctgggcctgcgaatgttgcgcttggaaaacgcaggagatggggttggaatgaggcaggggttggggaactgcgctgcctcctgcgcccccactcctgccgcagcctctccccttcaaatcttcacattgaggattgtgtttatcccaggacacctggcttagaagatgagatgtccgttttattctgctccttctcaaagtgtacttttcaaatatgagttggtaactatagggcatttgagagtgatcrttgtaattatagtaatcagaacttttcagtttagtcaagaatctggacaaaggaatcagtcatatctgtaccttctgcagttccaacagcttatgtaatgtacatgattaggctttgcccacttagtgttcagttcattcttgtgagactcgtggaaaattcagattcttcggtgggatgtgatgaactgtgtaagggcaaatgttaattggagaaagtgaatgcttagcttgaatcgtttttgaattgctttggaaactcatgtatttttaaacttggtgtttacttgaactgttggta

SEQ ID NO: 180899 - DNA, 601 bp, Human
tgtgatgaactgtgtaagggcaaatgttaattggagaaagtgaatgcttagcttgaatcgtttttgaattgctttggaaactcatgtatttttaaacttggtgtttacttgaactgttggtattcatttaagtatttacccatcacatgataactgccttccatcagatcccaactgtgattggtagcagacagatagactttaactaactcttctcttgttgctttttttcccccctaaatttctggaagactagagatataaagcactgtatgtttctgtgagaatttcacaaattctggtgtgtgtgtgtgtgtgtgtgtgtgtgtgtgtgttggtttggtgaattattcctcactctgccctctggtgtgtgctctttatttttacttagaagccactgaatttgcttttgaagaaaacatttacttttttcagtcttctttggggtataccccctttttaaaaaaacagtaacaaatgcacatggtaagcaacagagtaggaaaaggtacactcgcccagctctgacccatcctctgattcatcctcttcagatccttgtgtatccccataatattttatgccctatacaagaatt

SEQ ID NO: 180900 - DNA, 601 bp, Human
cataatattttatgccctatacaagaatttatgttgaaccagatgaaattgccatttttgtaagtcagaatataggcagttttatttggtttaatgtaatgtatatgtctttttctttaaatgggtaggaacatactacatacactgttgtacatcttgcttttttttttacatttaagtcttggagcttgttttggatctgtatatagagacctaccttgttcttcatggctgcacagtgttttactgaatggattgcctatgtaatccattagtttgtattatattagtatatagtttttatatatatattagtttatattagtatatagattattttatttacaatgttaaattatagatatattagtatgtagatttccattttaaagattatatatacctatgcaatgattatctttttacttatgttttacactcaggttcaaatatatctgtaggacacatttctgataaatttattttactcatgatatatgaatgaaagaacatatcattttaattacagacactttttatttaaaatgtatgtttattcagtccgtggttattactcactgcatatttgtcagtgactgac

SEQ ID NO: 180901 - DNA, 601 bp, Human
tgagccttgaacacatatggccaattggagaaggatgagcctgcccaggagattattaagatgtgaccagagaggtggaacaaagactaagtgtggtgtcatagaagtaagtaaaagagtggtcagcagtgtctgttggctactgagaagccagttacagtggaacttagatttggcaacatggacatcattcactaaccttagggggagctgtcagtgggaagcttgaaacatgccaattagatggggttgagaaatgcaaggaaatggagacagctagcgtaggcagcttttaaaggtrtttggggagagagacccagggtgagtctctttaaatggtaaagaaaacttaccttattcaagagttccagaagaaggtggcactagggttgtatattcagtggctcaacaatgtcatcagagacttagatttttccagcctcagtgtgtgacttggtcctcaggctgtcccctcagaatgtaggatggctgctgtaattcagacatctttagcagaagaaggacaactttgtcttatgtcctttaaaaaaaatcttaatacacatgctgaaaagtatacaagtgttaagtgcagctggaa

SEQ ID NO: 180902 - DNA, 601 bp, Human
attgcatgaatataccacattttatccattctattgttgatgggcatttgggtagcttctcctatttggcttttacaggtagtattgttgtgaacatatgtatttatttctgttgagtgtataattaaggagtggaattgttgggacagagggtatgcttatatgcatttagctttcctgtgtgattgtatcattttgtactcttacagcagcatatgagaatttcagttctgtgccctcaacacttactatttttcatcttttattttagacattctggtgggtgtgtagtggtataccrctgtgattataatttgtattttcataaattgattaaggatgtttcagattttcataaggttattgaccatttggatattctcttttgtgaagtgcctgttgaagtcttttgctatttttttctcttgagtagaatgccctattcatttttaggagtttttcttttgtattctgaatatgagtcattggtcagatatatgtattgcaaatatcttctcacattcagtggcttgccttttcactgttgatgttttcacaaacaagttactaattttaatgtagtacagtttatcagtttttt

SEQ ID NO: 180903 - DNA, 601 bp, Human
tgtgggcatcttgagtcttcagggtgccttagtgattgagaggtcatctctgcgtattctgggtgggtgtgcctgaatgtgaaaaatgacttaaaactcgggaggaagtataggaggctgtctttataggaggcaggaaaagatttcttaacacacagtgcacaaatcagcagtgaagacaaccatcttgatatatttggctatatcgaacttaaaaacttgtgtatgtcaaaaggcaccatagatgaaatagtagtttgagaggagataatttgccacatatataactggtaggatttayagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgacatcacagaagacaggtgatttctgcatttccaactgaggtactgggttcatctcactggggagtgctggacagtgggtgcaggacagtgagtgcagcgcaccatgtgtgagctg

SEQ ID NO: 180904 - DNA, 601 bp, Human
aggtcatctctgcgtattctgggtgggtgtgcctgaatgtgaaaaatgacttaaaactcgggaggaagtataggaggctgtctttataggaggcaggaaaagatttcttaacacacagtgcacaaatcagcagtgaagacaaccatcttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaycccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgacatcacagaagacaggtgatttctgcatttccaactgaggtactgggttcatctcactggggagtgctggacagtgggtgcaggacagtgagtgcagcgcaccatgtgtgagctgaagcagggtgaggcatggcctcacggggaagcgcaagggg

SEQ ID NO: 180905 - DNA, 601 bp, Human
catctctgcgtattctgggtgggtgtgcctgaatgtgaaaaatgacttaaaactcgggaggaagtataggaggctgtctttataggaggcaggaaaagatttcttaacacacagtgcacaaatcagcagtgaagacaaccatcttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaccccrtagaaaatgggccagtaaaacaagtaagcatttcacagaagagtaatcctgaatggccaatagaaataagaaactatttcggtaggggtggagccaagatggctgaataggaacagctccagtctacagctcccagcgtgacatcacagaagacaggtgatttctgcatttccaactgaggtactgggttcatctcactggggagtgctggacagtgggtgcaggacagtgagtgcagcgcaccatgtgtgagctgaagcagggtgaggcatggcctcacggggaagcgcaaggggtcag

SEQ ID NO: 180906 - DNA, 601 bp, Human
cttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgasatcacagaagacaggtgatttctgcatttccaactgaggtactgggttcatctcactggggagtgctggacagtgggtgcaggacagtgagtgcagcgcaccatgtgtgagctgaagcagggtgaggcatggcctcacggggaagcgcaaggggtcagggaattccctttcctagtcaaagaaaggggtgacagatggcacctggaaaattgggtcacttccaccctaatactgcgcttttccaatgggcttatcaaacggcacaccaggagattatatcccgcacctggctcggagggt

SEQ ID NO: 180907 - DNA, 601 bp, Human
ttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgacstcacagaagacaggtgatttctgcatttccaactgaggtactgggttcatctcactggggagtgctggacagtgggtgcaggacagtgagtgcagcgcaccatgtgtgagctgaagcagggtgaggcatggcctcacggggaagcgcaaggggtcagggaattccctttcctagtcaaagaaaggggtgacagatggcacctggaaaattgggtcacttccaccctaatactgcgcttttccaatgggcttatcaaacggcacaccaggagattatatcccgcacctggctcggagggtc

SEQ ID NO: 180908 - DNA, 601 bp, Human
tttgagaggagataatttgccacatatataactggtaggatttacagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgacatcacagaagacaggtgatttctgcatttccaactgaggtactgggttcatctcactggggagtgctggwcagtgggtgcaggacagtgagtgcagcgcaccatgtgtgagctgaagcagggtgaggcatggcctcacggggaagcgcaaggggtcagggaattccctttcctagtcaaagaaaggggtgacagatggcacctggaaaattgggtcacttccaccctaatactgcgcttttccaatgggcttatcaaacggcacaccaggagattatatcccgcacctggctcggagggtcctacgcccatggagcctcgctcattgctagcacagcagtctgagatcaaactgcaaggtggcagcgagg

SEQ ID NO: 180909 - DNA, 601 bp, Human
attactgggtatatacccaaaggattataaatcatgctgctataaagacacatgcacacatatgtttattgcggcagtattcacaatagcaaagacttggaaccaacccacatgtccaacaatgatagactgggttaagaaaatatggcacatatacaccatggaatactaagcagccataaaaaatgatgagttcatgtcctttgtagggacatggatgaagctggaaaccatcattctcagcaaactgttgcagggacaaaaaaccaaacaccgcatgttctcactcataggtgggaawtgaacaatgagagcacatggacacaggaaggggaacatcacacaccggggcctgttgtgaggtgggaggggagagggatagcattaggagatatacctaatgctaaatgacgagttaatgggtgcagcacagcaacatggcacatgtatacctatgtaacaaacctgcacgttgtgcacatgtaccctaaaacttaaagtataataataataataataataataataataaagaaactatttctatttcctagtaattaaaattgtagggatttggtacacagataaaagaatgaaacca

SEQ ID NO: 180910 - DNA, 601 bp, Human
tacccaaaggattataaatcatgctgctataaagacacatgcacacatatgtttattgcggcagtattcacaatagcaaagacttggaaccaacccacatgtccaacaatgatagactgggttaagaaaatatggcacatatacaccatggaatactaagcagccataaaaaatgatgagttcatgtcctttgtagggacatggatgaagctggaaaccatcattctcagcaaactgttgcagggacaaaaaaccaaacaccgcatgttctcactcataggtgggaattgaacaatgagarcacatggacacaggaaggggaacatcacacaccggggcctgttgtgaggtgggaggggagagggatagcattaggagatatacctaatgctaaatgacgagttaatgggtgcagcacagcaacatggcacatgtatacctatgtaacaaacctgcacgttgtgcacatgtaccctaaaacttaaagtataataataataataataataataataataaagaaactatttctatttcctagtaattaaaattgtagggatttggtacacagataaaagaatgaaaccaatagtgcagaata

SEQ ID NO: 180911 - DNA, 601 bp, Human
taggtgggaattgaacaatgagagcacatggacacaggaaggggaacatcacacaccggggcctgttgtgaggtgggaggggagagggatagcattaggagatatacctaatgctaaatgacgagttaatgggtgcagcacagcaacatggcacatgtatacctatgtaacaaacctgcacgttgtgcacatgtaccctaaaacttaaagtataataataataataataataataataataaagaaactatttctatttcctagtaattaaaattgtagggatttggtacacagataaaakaatgaaaccaatagtgcagaatagagggcctccacacagaacccactatgtgagtaaatattacaatgtcatattgtctgagtccttcagattggcagaaattaaagaggctgatagtctggtgttggtgggtatgtgtagtaacaggaagccccagtaaactggtgggagtgtgattgcttacaaccaagtcagggagcactataatagactccacagttacttgattctgagtgtgtgtgctctagaaaatttcttgcaaatgtgcacatggtttgatatgcaaggttggtcattgca

SEQ ID NO: 180912 - DNA, 601 bp, Human
agtgtttgcttctgggcagtaagagagggaaaggagattggagagggtacaaaggagatttcagccatatctgtatcatcagaaatagttttatttatttcatttaaaaatcagaagcaaatataacaaaatgttaacagttaattctgggtatctgtgtattagtctctgtattttcctaaattataaaaatattttttttttaagtgaagctttagatgccaggcatgatggctcacacctgtaatcctagcacttcaggaggctgaggcgggcagatcacttgaagtcaggagttccragaccagcctggccaacatgtgaaaccccgtctctacaaaaaaattttaaaaaattactggatgttgtggtgcattcctgtctagctactcaggagtctgaggcaggagaatcacttgaacccaggagatggaggttacagtgagctgagatcacaccactgcattccagcctgggtcacaggtgaaactccatctcaactaaaaaaataaaaataaataaattttttttaagtggagctttaaataagacatagaaaggcacatgtatttcatacttcattcctggttttacgtaattt

SEQ ID NO: 180913 - DNA, 601 bp, Human
atactggttttcccagaaatacttcctgctattttaatatattatcaattaagaaaaacagttattaaaactttttgaagacctggcgctcactcctgtaatcccagcactttgggagggcaggacgggcagatcccttgagttcaagaccagcctgagcaacatggcaaaaccatatctttacaaaaaattagttgggcatggtggcatgtgcctataatcccagctacttgggaggctaaggtgggataatcacctgagcccaggaagtatgaggctgcagcgagctatgattgcgccmcttcaaaaaaaaaaaaaaaaaagaaaaaagaaaaaaactttaacaattattttgagaactttgtggagaatacttgttcctggcttagtttcttaaacaaaatattcacttttttttttaaattggaatgtttggtgatgtccaaacatcccttctcaggggatactctcttttgttgccttgtattggtgatgtgtcgtatgattgcagaaatatttgtatagataaaaacatataaccactagtaagtattttaaaaatttggtaactacataactaggttatttttctttttttttt

SEQ ID NO: 180914 - DNA, 601 bp, Human
gattgcgccacttcaaaaaaaaaaaaaaaaaagaaaaaagaaaaaaactttaacaattattttgagaactttgtggagaatacttgttcctggcttagtttcttaaacaaaatattcacttttttttttaaattggaatgtttggtgatgtccaaacatcccttctcaggggatactctcttttgttgccttgtattggtgatgtgtcgtatgattgcagaaatatttgtatagataaaaacatataaccactagtaagtattttaaaaatttggtaactacataactaggttatttttcttttttttttaaaaccagaaaagaatgcttattaaaggataaacttcaggagcaaaagtagatcatacagggtatatttacttttataagattgccttactttagaattaattatgagcctgagtctatggagtcatacctctaagatgtaagtgtgttagtggaatgtattctgtagatttctatgtgagggtaggacatttttttccttcttcttaatggggaagattagtacagtgctacctgtctctagactcactttcaggatttagaaagaatgagtcatttgtcctgaagagtg

SEQ ID NO: 180915 - DNA, 601 bp, Human
ggagtcatacctctaagatgtaagtgtgttagtggaatgtattctgtagatttctatgtgagggtaggacatttttttccttcttcttaatggggaagattagtacagtgctacctgtctctagactcactttcaggatttagaaagaatgagtcatttgtcctgaagagtgagaatttttcttagcctcaacagatatgtttgtgcaggtctgtgagcattgtgttttgatctatatcatataggatacaaactaataacctcagaaatgtcctcaagaacatttaaattttgaggggcscattaggacttttgttgtgaatgacagaaactgaactcagatttgatttaagtagaaaagggaattaattggctcatgtaactgagaagtctaggggttagcttcaggaatggttggatccagatttgtacacatctttctttcattttctcaactttgcctccctgtttgtcagcttcatgtttagtcttttttctagcttccctctctgatttttacatggattctcttgttatgtcttcaagctcacccatcttttcttctgcagtgttttatctgcctttatttccatccaatgta

SEQ ID NO: 180916 - DNA, 601 bp, Human
tgatttgtttccgttccggctcttgttccctgttaacctttcaggttgttctttccctggctgtggaccgttgtcccccagggatgtgctgatcagtacttagctgaagactcaaggggtccctctggagttctccctgtgtgcagctttctcttctctggtcctctgctctgtgaactcagctgccttggtcctctgtactcccgcttctgtctccttaactgagagaggctgccagtctctgcctaggttttctcttcccatgctctggcttagagacattcttatcagtaagcgggakcaatcacagggcttactttatatgtttttcatactctcttttgttgccttgttttcaatgtcttgcaagctgtggtttcttatcttttgtctttgttttaggtaggagggaaaaatcaagtccttattacttcattttggtcagaagtggaggttagagtgtaggcgctcttggttttatttttaaaaagacttttaccatgtagtgggatctgcaaactgatgtcatgagtagctgttaattctaggaaaaggagaccctctctcagtgtgtgtacagtagaccttagggatgcctcag

SEQ ID NO: 180917 - DNA, 601 bp, Human
gaactcagctgccttggtcctctgtactcccgcttctgtctccttaactgagagaggctgccagtctctgcctaggttttctcttcccatgctctggcttagagacattcttatcagtaagcgggatcaatcacagggcttactttatatgtttttcatactctcttttgttgccttgttttcaatgtcttgcaagctgtggtttcttatcttttgtctttgttttaggtaggagggaaaaatcaagtccttattacttcattttggtcagaagtggaggttagagtgtaggcgctcttgsttttatttttaaaaagacttttaccatgtagtgggatctgcaaactgatgtcatgagtagctgttaattctaggaaaaggagaccctctctcagtgtgtgtacagtagaccttagggatgcctcagactgattctgattgagtcatgtgcccacctgtggatttattgctttgacctagaaagtagtgcatttcaattggccagtctcctgggttacagccacacttccaccgtgccgtccattgttgggtggagcactggaactgacagtcctgctgttactgtgagagtgggaacatg

SEQ ID NO: 180918 - DNA, 601 bp, Human
cctgggttacagccacacttccaccgtgccgtccattgttgggtggagcactggaactgacagtcctgctgttactgtgagagtgggaacatggtggtctcctaagtgaggggagactagagagatgagcaagagggaatttccacatgtgtgatagagaatgagatagtgaaaagacccttttattgtaattgggtttcagaaactctgagatacctttaatttaagcttcattgaaataacttcagtagggaggtctgaattaagtcttttctcaactaacaggagttacattatgttktatagggttcagggaaaaggatccaataaaaggtgagaaaagtatggagaaaagagaaagaaataaagttctctgcaaatttagtagatttggtttatgatctatcattatttcttatgctagctgtgggttttttaatgcagttatttaaactttgaagtccgtaaatgcttaggggataggatttgaccttgtagcctatctgagagatgcctttgtcttcttatactttaggtgtcaggaagcatggcctataccctttcagcaaaacagagtttaatgaaatgccatatgaattgg

SEQ ID NO: 180919 - DNA, 601 bp, Human
gaatcacagtgttctttgtgaaatgtgtagtgaagaggaaagagctttggaccaggtgtcataaaaatcagggttctttggtttgcctcttaagtaagtgtgatattaggccagtttctagcctctagcctctttcactagtaaatcaccttgccagtagtactgtgcctaaaatgggaatttggtttgggaggagctagaagcagggttggttcagttagcttcaggttttggtactgttagctttgtagattaaaaagtttatacttaatatagaagatttccaaaatatgtaaatggrccagcaaagattttggttctgtagcaaaaaacccttatcattggaattaaatgtaaatccctggtttttggtttcttaaagccaggagctgcacttagagataacaatgaaaagctgagtgaaggggagacggctggatggaagatctagcctgagcacatcccccatctgtctgcactcttcggaggtatcggaaaaccatggcacaggcccatggttccatccagctctaaaaacttctcgatttccaggtgtaggaaaggcgatgacttagagattgttactgccttcaaatatttt

SEQ ID NO: 180920 - DNA, 601 bp, Human
ctatctgtgtagagttacatgttatccattaagtaattataaatgatttgtactttttatttgaaacagacagcaaccaaattgttatttattcctctgtagaaaaaaaaatccctttcagaaattttgaataaaataaaagcttttttgaaacaaaattatttaaaaatatttccttcattgctaaagttatttcctaaagaaaagacccttcagtagagctgcttgatgtttccgcaccatttgtgctaattctgcagcgtgctgatatatatatatataatatatatatatatattatatatatatatataatgttttttatatatatagcagaaattggctgtgcaggctaggagttgtagattttcattctctccttgttttctctcctaagtctttttgctttctccaatgcctgaaagtcccttagtctacatttttagtgtatgagtctttcctgctttttcttcttcgggttgtacaaagctgagctgaacagctctgtttgaccggcagatgttgttatccatcataacatgattatgtaataagatggtgagctccttgaagacaggtgccacctttgattcagatttac

SEQ ID NO: 180921 - DNA, 601 bp, Human
tctgtgtagagttacatgttatccattaagtaattataaatgatttgtactttttatttgaaacagacagcaaccaaattgttatttattcctctgtagaaaaaaaaatccctttcagaaattttgaataaaataaaagcttttttgaaacaaaattatttaaaaatatttccttcattgctaaagttatttcctaaagaaaagacccttcagtagagctgcttgatgtttccgcaccatttgtgctaattctgcagcgtgctgatatatatatatataatatatatatatatattatatwtatatatataatgttttttatatatatagcagaaattggctgtgcaggctaggagttgtagattttcattctctccttgttttctctcctaagtctttttgctttctccaatgcctgaaagtcccttagtctacatttttagtgtatgagtctttcctgctttttcttcttcgggttgtacaaagctgagctgaacagctctgtttgaccggcagatgttgttatccatcataacatgattatgtaataagatggtgagctccttgaagacaggtgccacctttgattcagatttacata

SEQ ID NO: 180922 - DNA, 601 bp, Human
cattgctaaagttatttcctaaagaaaagacccttcagtagagctgcttgatgtttccgcaccatttgtgctaattctgcagcgtgctgatatatatatatataatatatatatatatattatatatatatatataatgttttttatatatatagcagaaattggctgtgcaggctaggagttgtagattttcattctctccttgttttctctcctaagtctttttgctttctccaatgcctgaaagtcccttagtctacatttttagtgtatgagtctttcctgctttttcttcttcggrttgtacaaagctgagctgaacagctctgtttgaccggcagatgttgttatccatcataacatgattatgtaataagatggtgagctccttgaagacaggtgccacctttgattcagatttacatattgctgtcatcttgtcaatgatcacatgtgatggaatgtcagacaaagtttgtgtaacattttgttgacaccatcctaaaactaaagacatctagaaatgtaaaattgcttagatttacttttcagttttctaaatttgaggttccttactatcagcttaaagtaaatttgaaaa

SEQ ID NO: 180923 - DNA, 601 bp, Human
gtagcctaatcctgtgggaaaagaggggtgaaatgttaattggacattactatgcttggatgggaccagtttggccatgaaactcctggcagcacagagctaggacatagcctgtgccctgtgcccttcacctctgtcttggaagtatctatggcaaaaaccacaattacttttgcaccaacctaatatttccagcttcctgatgtctttcaaaggctaagatacttcctattagaaataggcaacagatagacttgagtatgctcacaagaaagcaatagcagccagggttctacctttrcttatttggcaattaaaacagattaaatgtttttctgcattcttgttcagatgtctgggataccgaagctgctaattctgtagcatgctgaacatgtagacataaagaaattggctgtggaggctttaaatttaattttagtatcctaatttaacttaacttaggatatttaaatttagcacaaggtcataggtatttttttttttttaatttttttgagacggagtctcactctgtcacccaggctggagtgcggtgttatgatgtcggctcactgcaacctctgcctcccgggttcaa

SEQ ID NO: 180924 - DNA, 601 bp, Human
taatcacgaaatggccaacggtggtaatcagaatctaaaggtaagctccattgaaaactacagtttttttcaaggatagatagtctcatatttttacagtaatattttggtggtaatagaaaccaaatttttggcgatttgaaccctttttgcctattgttactgaaataatgattctcttttaaataaataatctgagtatctcatataactacgtaaataatatttgaaagtcacagaatttcttttgaaatcacatttatgtgtttccaacatatttttaaaaataaccattttgccrcttctctttgtatcttttcccttcggttgttggaaaagtcctcttgttgataatattgaaaatttctaagagactgtgttcagttagggagaggagtttataccgagcatctccagctggatctggaattgtattgagcatttccagctggatctgaagctaagggtctgtaaacactcacctcagcctgccttagcagcccttttccagccttccaccctttttgaggtcttgaaatcacacaggtttacttagtgcttccgaaatgaactctactcttgggttcaggccattctgtcc

SEQ ID NO: 180925 - DNA, 601 bp, Human
aatcacgaaatggccaacggtggtaatcagaatctaaaggtaagctccattgaaaactacagtttttttcaaggatagatagtctcatatttttacagtaatattttggtggtaatagaaaccaaatttttggcgatttgaaccctttttgcctattgttactgaaataatgattctcttttaaataaataatctgagtatctcatataactacgtaaataatatttgaaagtcacagaatttcttttgaaatcacatttatgtgtttccaacatatttttaaaaataaccattttgccgsttctctttgtatcttttcccttcggttgttggaaaagtcctcttgttgataatattgaaaatttctaagagactgtgttcagttagggagaggagtttataccgagcatctccagctggatctggaattgtattgagcatttccagctggatctgaagctaagggtctgtaaacactcacctcagcctgccttagcagcccttttccagccttccaccctttttgaggtcttgaaatcacacaggtttacttagtgcttccgaaatgaactctactcttgggttcaggccattctgtcca

SEQ ID NO: 180926 - DNA, 601 bp, Human
atcctattctattctaaattcttttatatagctattgaattcttcatggctgggttgttttttttttttttaagtctcactaatttcattggcaggtggcggatgaggcgttgaaggtagatgattgtgactgtcatcctgaattttcaccaccatcaagtgagtattgtttttatatcaattgttgccaagttaatataatgtctcctaaatttggatgccctacaatgtgcacaagccttgcttatatccactcttgttctcctttactttataatgcttctatgttaagaaaatattsaatatttatttgaaatcaatgctcagtctttttgtattatttagtgaatgtaattttggaaattcaaataaaaggaaaggaaaagatgaagtacatagctctttttggtctgcttcttaattttttttaggctgttgtttctcattattgaaagtttattattgcctcccttcctcccacctgctaggagcctgtttagacctttttaaatctaattgttctccctcataaaattttaatagctgtttatgtaccatatgtgcatctgcgctttatgtataaaaggaattgattttgtct

SEQ ID NO: 180927 - DNA, 601 bp, Human
acaccaggctaatttttgtatttttagcagagacaaggttttgccatgctggccaggctggtctcgaaatcttggcttcaagcaatcctctcgccttggcctcccaaagtgctgggattgcaggtgtgtgccaccacgcccagcctggggtctcttcttataagggcactaatcccattcatgaggggacagcctcatgacctaattcctcccaaaggttccacttcctattaccatcgccttgaggatttggttttcaacatgtgaatcttgtcggggacacagatatccagaccataasagtgctgtaggctaagtctcatttgttttaagttgtgtgtgctcagtgcatgtatttatttacatatctagtaaacacagacaccgcagaacctcattacttggcatcatttggagatgaaggttctggagaagtgaatatttttgtgcttcatttatttctgaatcttaataccaccagagtttgatgaaaatcctctaaagtatattacatgcttccctgccttttaacacggaatttaggaaaatacaggttttcttgatggcttaaggttgtggtcacacataacagtgactgacc

SEQ ID NO: 180928 - DNA, 601 bp, Human
ccattcatgaggggacagcctcatgacctaattcctcccaaaggttccacttcctattaccatcgccttgaggatttggttttcaacatgtgaatcttgtcggggacacagatatccagaccataacagtgctgtaggctaagtctcatttgttttaagttgtgtgtgctcagtgcatgtatttatttacatatctagtaaacacagacaccgcagaacctcattacttggcatcatttggagatgaaggttctggagaagtgaatatttttgtgcttcatttatttctgaatcttaatamcaccagagtttgatgaaaatcctctaaagtatattacatgcttccctgccttttaacacggaatttaggaaaatacaggttttcttgatggcttaaggttgtggtcacacataacagtgactgacctcaagcctggtggtgttcctcccaggattcttcaggtgagattgttgattttttagttagtgatcctctcttttcccttgtcttgtttgttgggtggttggtttttctttccatagttttgcttctagcagccatttctattttttgtgacctgcagctccatgttcgctcagg

SEQ ID NO: 180929 - DNA, 601 bp, Human
ttttgaggtcttgaaatcacacaggtttacttagtgcttctgaaatgaactctctactcttgagttcaggccattctatccaaatcgtacttcttcctcaaaaccgaacacaaatgccatatcctcactaacatttttctcagccactccagcttaggtgatttttcccttttgtgagttgtgagagatattactgactatgcaatttatatgtcaataacaacacagtattttcttttcttcataaggatgattgttgtttaactactgaagtgatgtgtcttttcaccccatctgattrtaaactgagaacaggagttatctcctgtatctctctgtatctatggtagacctaaatcataatgatcactattataattgatctttaataatttaatttattatatatagaaaaatatcatcagtagcttcttttttggcttacccttttgtagttacacccacgtaccacatttctgcttctgttttcttactccaatttatattttaaaaatagttttactctcaggcttgtagatttttatgtacagattttaggaacaaatacttttgtgttcacaggtcagcctccaaaacataa

SEQ ID NO: 180930 - DNA, 601 bp, Human
aaatcacacaggtttacttagtgcttctgaaatgaactctctactcttgagttcaggccattctatccaaatcgtacttcttcctcaaaaccgaacacaaatgccatatcctcactaacatttttctcagccactccagcttaggtgatttttcccttttgtgagttgtgagagatattactgactatgcaatttatatgtcaataacaacacagtattttcttttcttcataaggatgattgttgtttaactactgaagtgatgtgtcttttcaccccatctgattataaactgagaacrggagttatctcctgtatctctctgtatctatggtagacctaaatcataatgatcactattataattgatctttaataatttaatttattatatatagaaaaatatcatcagtagcttcttttttggcttacccttttgtagttacacccacgtaccacatttctgcttctgttttcttactccaatttatattttaaaaatagttttactctcaggcttgtagatttttatgtacagattttaggaacaaatacttttgtgttcacaggtcagcctccaaaacataaaggaaaacaaaaa

SEQ ID NO: 180931 - DNA, 601 bp, Human
agtcccttctctaaggcctcctccaggaatacactgttaacagtttcatgactattgggaaacttactctgcatacgcagacatgggtatgcatatttcagatgcccttttgagtaattattgttagaggaaaatctttcctaatgaattctgactacttctaaaatgaattctatcaaacatccccatgaaaattaacagtaattaattgcctcctatctttttttttgtttttttgagatagggtcttgctctatcacttaggctgcggtgcagtggtgtaaccctagctcactgcagscttgaactcctagactctagtgattctttttgcctcagctcccaagtagccaggactactactgctactatggtgcacgtcaccatgactggataactaaaactaaatgttttttagagacagggtcttgctctgttgcccaggctggtcttgaactcctggcctcaagtgatccttctgccttggcctcccagagtgctgggattgcaggcgtgtgcctggccttgcctcctgtctttattgttaacaccccattgacaacaagatataaattgattacaatgtgaaattgtaaatctt

SEQ ID NO: 180932 - DNA, 601 bp, Human
catagtaaatcttcagtgtactttagtcgtcattactgttaccaccatcattttcattattattagaatgactctggcctacagcttgctttttgtcttttacaaaatatcttgtgtttcttcccatgttcagaacacagaggctcttccattcttcatttgctgtacagtattttgtaatatggctgtatcccccatttttgtgcatttaggctcttcattcctcttttcctccctcactttctatccctctatccatctctctctttttcttcttcctttgagagggatagatcagacrgtacttcaaacatccttgcacatacacctttgtgcacctgttcatgtatatttacaataaatactttgtaaataatgtatagaagttgtttctgtagtgggattgctgtatcaaaggggatatgtaattttatctttgacagatattgtgaaatggttctcttagaaaataggcactgttcacactccgactaatctacaggagggtgtggtataataaaaatatatatatatttggtatttgtcccagttcctggtacagagctcccaaaacccatggcatttcctgaatgataggagt

SEQ ID NO: 180933 - DNA, 601 bp, Human
acttgagtttatgctaatgaggtgactcaaggtagtgcctcagatagttcaggaggaggtctcgtcactggaaagaccaaacacctgattagagggttaagactttcagcctcatacctgacctccaaggagaggaggggggctggaaattgaggttaggcaccaatggccagtggttgatttaattgtacctacatacctacataatgaaaccttagtaaagtccttaaaagagggcatggggagcttctgggctgacgaacacattgatgtgctgagaaagtggcatgcccaaggggakcatgaagctcctcgcgccccccaaccttcctatgcatctcttcctcttggctgtttttgagttgtatcctttataataaattggtaatagtaagcacttccttgagttccattgtttttctagtgagcctgaagagggactcatgggaaccctcttgtagtcagcagggcaggagtgtgggtgacctgtgcaccccacttgcagctgaagtgagggcagtctggtgggactgattctttaccctgtgaggtctgcgctaactctgggagttagtatcagaactgaattgcattattgcac

SEQ ID NO: 180934 - DNA, 601 bp, Human
gcctcatacctgacctccaaggagaggaggggggctggaaattgaggttaggcaccaatggccagtggttgatttaattgtacctacatacctacataatgaaaccttagtaaagtccttaaaagagggcatggggagcttctgggctgacgaacacattgatgtgctgagaaagtggcatgcccaaggggatcatgaagctcctcgcgccccccaaccttcctatgcatctcttcctcttggctgtttttgagttgtatcctttataataaattggtaatagtaagcacttccttgagtkccattgtttttctagtgagcctgaagagggactcatgggaaccctcttgtagtcagcagggcaggagtgtgggtgacctgtgcaccccacttgcagctgaagtgagggcagtctggtgggactgattctttaccctgtgaggtctgcgctaactctgggagttagtatcagaactgaattgcattattgcacactcattttgtgttggacagttgaattgatacggaaaaatgacaatatttggtattggagaaaatctacacattggatgtcagaagtactttcagaaaactccacatc

SEQ ID NO: 180935 - DNA, 601 bp, Human
ttttccaatggaaaaagcaaaactctttgaacaaaacattgttcacatgaataaggttctaatcatgtacatctctaagttttttttatataattattgtattatattgtagttttgtagagatggggtctcactgtgttgtccaggttggtttcaaactcctggcctcaagcaatcctcttaaagtgttgggattacaggtgtgagctattgcactcagctattatagacatatcatttaatatatatgactgctaagaatccaatctatcactaatttaaatattaacttgataattaygttagctagaggtttaactaatgattagcactgtggaattatttgcttctcaaagagttaacagtagtattaactttaaatatttttaaaagatttaaacacagtttcattatacttattctaaaatcattagagggcaaacttttattctttaaatgatttaacttaatcagataatgttgtatataaaattctttttacgttacttcatgatggaaaatatacattaacatggaatagaatactcaattcaaaacatgtggatctttttttaggtatacataacagatattttacaaa

SEQ ID NO: 180936 - DNA, 601 bp, Human
aactaatgattagcactgtggaattatttgcttctcaaagagttaacagtagtattaactttaaatatttttaaaagatttaaacacagtttcattatacttattctaaaatcattagagggcaaacttttattctttaaatgatttaacttaatcagataatgttgtatataaaattctttttacgttacttcatgatggaaaatatacattaacatggaatagaatactcaattcaaaacatgtggatctttttttaggtatacataacagatattttacaaagaactaaaatagattmctaatcatttgcttaaaaacatttttgagaatatcttaaagttggagattttaaattatatctttttacattgatttttactgactctaaacaccatgaaatacttaaatagatgacagcctgtgaagatgaaaagactatttaaataaatatgatcgctgtttttgagcctctgtttgttcattcaacacagtttgattgaggctctctccatatgctggggagtgagagagattgggtgcacagtgatatgatttcggcctgctctgctggagctttcaggacagatcatttatgtcg

SEQ ID NO: 180937 - DNA, 601 bp, Human
atattttacaaagaactaaaatagattcctaatcatttgcttaaaaacatttttgagaatatcttaaagttggagattttaaattatatctttttacattgatttttactgactctaaacaccatgaaatacttaaatagatgacagcctgtgaagatgaaaagactatttaaataaatatgatcgctgtttttgagcctctgtttgttcattcaacacagtttgattgaggctctctccatatgctggggagtgagagagattgggtgcacagtgatatgatttcggcctgctctgctgragctttcaggacagatcatttatgtcgtattgagggaagtgacttccaatgaaagcatgaggctgtatggatctgatttctagactgataaagaaagctgggcatggtggcacgtgtctgtagtcccagctcctcaggaggctgaggtgagaggattaaccactgcactccagcctgggcaacataggaaggccctgtcttatttatttattattctcttttgttttcttttttaagcctctcactagtttgggagccctgtctcttttaaagaagaaagaaaaagaatgagaacaagat

SEQ ID NO: 180938 - DNA, 601 bp, Human
tacatatttgcatttgcggcccctttgaatggcgcacacgtgtatagcaaggagtgaggagattttaggcttaatgtctagccttgcctctccaatctttgtggaactttggtgacttacagctattcccatgtcactaaaatatgaattcaaattataatgcgtattcaaattacaaagtttttctcactttaagggcacatgatagcaattttgtttttattttttattccttatgttattccttttgcatttaacctattgttatctctcccagtaattttatctacttatattcaartatatgttaggcaggagtacagttaacaattacagtatttatttcttgcttagaattaaggtttgtttcagagcaggatggcagttgttaaaatctggtagtgatcagaatattgattgtatgttcttaagtgtctaattgttctactcccaaacaacttacttatttaaatgatggctgttgtttttcatatatattgttaaaacttaaaaatactgtctgtttagtctggagagcaagtgaggcttagtaccatgtagtgtaaaatgagccacctttgtcacaggcaacagaagaggt

SEQ ID NO: 180939 - DNA, 601 bp, Human
gtgatcagaatattgattgtatgttcttaagtgtctaattgttctactcccaaacaacttacttatttaaatgatggctgttgtttttcatatatattgttaaaacttaaaaatactgtctgtttagtctggagagcaagtgaggcttagtaccatgtagtgtaaaatgagccacctttgtcacaggcaacagaagaggtgttgcaattaggatggtaaagcagtaccttttcattttcactttaaaagtgtggtgctgagaaaggaatatgatgaataagggtagtttgggtattgatgyaaacattttatcattagttataaaatattactatgaacttggcatcttaggttttaaattaaaaatgtgtagattcaggttactgaaatagaatttcttttttccaggattttgctaatataatgaaaatgctgagaagcttaattcaagatggctatatggccttattggagcagcgttgccgcagcgctgcacaggcctttacagagttgctgaacggtttagatcctcaaaaaataaaggtaaatttgccatatcataacttgtttatcaatgctaatgcacctcagatgaatgcag

SEQ ID NO: 180940 - DNA, 601 bp, Human
ctctccttgactatagtttagggtcattagaactggctttttctctgaatcaaggttttcaactatctttagtcacaccttttcacccaggaagaaagtacaggcacacctcgtttcattatgctttgctttattgtactttgcagacaatgcatttgttacaaattgaagatttgtggcaaccctgtgtcaagcaagtctgttttctgaaagcatgtgctcacctcatgtctctgtgtcacattttggtaattctcacaatatgtcaaactttttcattatcattatcactgtatctgtratcagtgatctttgatgttactattgtaattattttggggcactacaatctgtgcctatgtaagaaagggaacttaataaattgtgtgtgtgtgttctgagtgctctgccaaccagctgttatctccacccccttccttaagtctccctgttccctgagacacgatattgaaattaggccaattaatgaccctacaatggcctctaagtattcaagtgaaaggaagagttgcacgtctctcactttaaataaaaaactagaatgattaagcttcgtgaggaaggtatgttgaaagccaag

SEQ ID NO: 180941 - DNA, 601 bp, Human
agcagtggcaggatttgagaggattcactccaattttgaaagaagttctagtgtgggtaaaatactgtcaaacagcatcacacattacagagaaaccttttctgaaagtaagagtcaatcagtatgacagacttcattgtcttattttaagaaattgccacagcaccttaattttcaggaactaccaccctgaacagttagcagtcatcaatatcaaggcaagaccatccaccaacaaaaagattatgactcactagaaatacccagtgtagatgacggttgatgggtgcagcaaaccacygtggcacgtgttatacctgtgtaacaaacctgcacgttcttctgcacatgtatcccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgct

SEQ ID NO: 180942 - DNA, 601 bp, Human
gttctagtgtgggtaaaatactgtcaaacagcatcacacattacagagaaaccttttctgaaagtaagagtcaatcagtatgacagacttcattgtcttattttaagaaattgccacagcaccttaattttcaggaactaccaccctgaacagttagcagtcatcaatatcaaggcaagaccatccaccaacaaaaagattatgactcactagaaatacccagtgtagatgacggttgatgggtgcagcaaaccactgtggcacgtgttatacctgtgtaacaaacctgcacgttcttctrcacatgtatcccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgctccagagccgagcccacagtatctctgaggtatgcctataatagc

SEQ ID NO: 180943 - DNA, 601 bp, Human
cccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgctccagagccgagcccacagtatctctgaggtatgcctataatagctaagtaaatrtcttaatctgtcactagtactgcttatatgcaaaataatatgactttaattataaattaatctattatgaatcatgcctcaaggaactctgagacagtgattctgtgttttaaatagcaggataactgctttattggaacaaaaatctcttttctaatttgatttggccaatcatattgattagtgagattttatgacaatcattgattcgtaagattgattagtgagattctattacacttctttttctgttgtgactggatgcaaattgggcagaattatattcagatttttaactga

SEQ ID NO: 180944 - DNA, 601 bp, Human
cagtgtatagacatgagctcccaggatttccattagtcatgctcctgcctggctctcctggaatgtttacctacctatactgtttggcattataactttgctttctgaggttttgagtttgctataaatgttgaaatgctctagaattactcaagtataatatataatttggtctctatttttccctgtctagatgaaggtttaactctaacttgccacctagtgaggatctaagtagtcttttacgttctgttctctcccagaagttgacagtgcccaagattcattttccttgatctcwgtgtcacagattaataatgtctcccatgaatgctctctaattctattttccaagagacagttggagacagaacttcatgattttcattttattcctgacagaataataataaataccatattttaccttattagaattgaagaaatcatttattacatttgtgatttaatgtaaaatagcgagactgatttagaaaaaaaaaatgtgttatagtagaacttacatgtttaaaagaatttcatcagaggacagcccttgcttcaaacgtttttagaatgcctcctttggaactggcctcaa

SEQ ID NO: 180945 - DNA, 601 bp, Human
tgaaggtttaactctaacttgccacctagtgaggatctaagtagtcttttacgttctgttctctcccagaagttgacagtgcccaagattcattttccttgatctcagtgtcacagattaataatgtctcccatgaatgctctctaattctattttccaagagacagttggagacagaacttcatgattttcattttattcctgacagaataataataaataccatattttaccttattagaattgaagaaatcatttattacatttgtgatttaatgtaaaatagcgagactgatttagaaaaaaaaaatgtgttatagtagaacttacatgtttaaaagaatttcatcagaggacagcccttgcttcaaacgtttttagaatgcctcctttggaactggcctcaaagctccattttgtagtgacatttctttttttcactcacagtagggttaccagtatttcttagaactatgtatcttttggatgttttccaaaaacaaaattcattcaacttagtggtttttcactgttgagaatattcaaaaaagaatgtactctaagctatgttaagtgtttactaatgggctgtttttaagac

SEQ ID NO: 180946 - DNA, 601 bp, Human
ttctattttccaagagacagttggagacagaacttcatgattttcattttattcctgacagaataataataaataccatattttaccttattagaattgaagaaatcatttattacatttgtgatttaatgtaaaatagcgagactgatttagaaaaaaaaaatgtgttatagtagaacttacatgtttaaaagaatttcatcagaggacagcccttgcttcaaacgtttttagaatgcctcctttggaactggcctcaaagctccattttgtagtgacatttctttttttcactcacagyagggttaccagtatttcttagaactatgtatcttttggatgttttccaaaaacaaaattcattcaacttagtggtttttcactgttgagaatattcaaaaaagaatgtactctaagctatgttaagtgtttactaatgggctgtttttaagacagagctttcatccgtcttgtgccacaaaagactgtgacaacgtcattggaatggcattccttccaagggattagcacttaataggatctatgttatggtgtgtttacaccataattagccttttttaaaaaacaaaaacaaaaacac

SEQ ID NO: 180947 - DNA, 601 bp, Human
tgtttaaaagaatttcatcagaggacagcccttgcttcaaacgtttttagaatgcctcctttggaactggcctcaaagctccattttgtagtgacatttctttttttcactcacagtagggttaccagtatttcttagaactatgtatcttttggatgttttccaaaaacaaaattcattcaacttagtggtttttcactgttgagaatattcaaaaaagaatgtactctaagctatgttaagtgtttactaatgggctgtttttaagacagagctttcatccgtcttgtgccacaaaagwctgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatataattcctaagaaagtgaaacacagaggtataattttgccaca

SEQ ID NO: 180948 - DNA, 601 bp, Human
ctgtttttaagacagagctttcatccgtcttgtgccacaaaagactgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatrtaattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtatatttgaaaaaaaacaggttagtagaaatgacactactttaa

SEQ ID NO: 180949 - DNA, 601 bp, Human
gtttggttgtgtctctgactatccatatgatcagaaatttatataattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtrtatttgaaaaaaaacaggttagtagaaatgacactactttaagctctaggctggtaactcatttaaaatccaatgtgataatgatccattttctagaattattttgatatctcctctgtagcacactatcataattgtgatttactttgaggacctgaaatttcactatcagtattaattgttaaagcaaggccagtcattgcagttcttggtacttcctgattttaaatctaataagtcaacaatatagtaatttgacattaaagatttaatagtctagtgtataatcatctatagata

SEQ ID NO: 180950 - DNA, 601 bp, Human
aggatgtggagaaataggaacacttttacactgttggtgggactgtaaactagttcaaccattgtggaagtcagtgtggcgattcctcagggatctcgaactagaaataccatttgacccagccatcccattactgggtatatacccaaaggattataaatcatgctgctataaagacacatgcacacatatgtttattgcggcactattcacaatagcaaagacttggaaccaacccaaatgtccctcagtgatagactggattaagaaaatgtggcacatatacaccatggaatactawgcagccataaaaaaggatgagttcatgtcctttgtagggacatggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgca

SEQ ID NO: 180951 - DNA, 601 bp, Human
gtggagaaataggaacacttttacactgttggtgggactgtaaactagttcaaccattgtggaagtcagtgtggcgattcctcagggatctcgaactagaaataccatttgacccagccatcccattactgggtatatacccaaaggattataaatcatgctgctataaagacacatgcacacatatgtttattgcggcactattcacaatagcaaagacttggaaccaacccaaatgtccctcagtgatagactggattaagaaaatgtggcacatatacaccatggaatactatgcagmcataaaaaaggatgagttcatgtcctttgtagggacatggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacgttg

SEQ ID NO: 180952 - DNA, 601 bp, Human
cccagccatcccattactgggtatatacccaaaggattataaatcatgctgctataaagacacatgcacacatatgtttattgcggcactattcacaatagcaaagacttggaaccaacccaaatgtccctcagtgatagactggattaagaaaatgtggcacatatacaccatggaatactatgcagccataaaaaaggatgagttcatgtcctttgtagggacatggatgaagctggaaaccatcattctcagcaaactgttgcagggacaaaaaaccaaacaccgcatgttctcactygtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacgttgtgcacatgtaccctagaacttaaagtataataaaaaaaatatatatatataaacaacaaacaacaaaaaagtgtacacctgccacaataaagccagtgtccaagacgagttg

SEQ ID NO: 180953 - DNA, 601 bp, Human
cagccataaaaaaggatgagttcatgtcctttgtagggacatggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacrttgtgcacatgtaccctagaacttaaagtataataaaaaaaatatatatatataaacaacaaacaacaaaaaagtgtacacctgccacaataaagccagtgtccaagacgagttgtgtttaatgtatattacttttatagcaaacagcaatagtgactttgtttttttaaagaaaatttaggttacattgaatattgctgttcagtgattcatcaaatgtattcgtcccagtaagcttgagatctttggtgacttttgaagggagtgaaaataccattttacatctttaatgcctttttc

SEQ ID NO: 180954 - DNA, 601 bp, Human
tggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacgttgtgcacatgtaccctagaacttaaagtataataaaaaawatatatatatataaacaacaaacaacaaaaaagtgtacacctgccacaataaagccagtgtccaagacgagttgtgtttaatgtatattacttttatagcaaacagcaatagtgactttgtttttttaaagaaaatttaggttacattgaatattgctgttcagtgattcatcaaatgtattcgtcccagtaagcttgagatctttggtgacttttgaagggagtgaaaataccattttacatctttaatgcctttttcataattatgactttagatttctagaagctctcaatcacttt

SEQ ID NO: 180955 - DNA, 601 bp, Human
tcaaatgtattcgtcccagtaagcttgagatctttggtgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaaggtaaccatttatttttgcagagtgtttcttactgtgaatgcttatctgcattgactgactcaggtatcaggaggcrgagaggtaggagcattccatccccacctcccttacacgcatttcccctctactgtctaatgagaatctctgacatttattgaatgttttctgtgtgccagtgtgtaccttcatttatcattatgcttaatccttatagcagccccgtgcaggggggcactgtgatcattcccattttacagatgaggaaggttaagtttagagaggtgaaatgatgcactcaaggtgaaacagcaagcaaattgtggtcctggaacttgagtccaggcattctgacttctgagtatgcatgatcatgcac

SEQ ID NO: 180956 - DNA, 601 bp, Human
tgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaaggtaaccatttatttttgcagagtgtttcttactgtgaatgcttatctgcattgactgactcaggtatcaggaggcggagaggtaggagcattccatccccacctcccttacaygcatttcccctctactgtctaatgagaatctctgacatttattgaatgttttctgtgtgccagtgtgtaccttcatttatcattatgcttaatccttatagcagccccgtgcaggggggcactgtgatcattcccattttacagatgaggaaggttaagtttagagaggtgaaatgatgcactcaaggtgaaacagcaagcaaattgtggtcctggaacttgagtccaggcattctgacttctgagtatgcatgatcatgcactctgctggacttggttgtacttagaggaaggtatagt

SEQ ID NO: 180957 - DNA, 601 bp, Human
agtatgcatgatcatgcactctgctggacttggttgtacttagaggaaggtatagtattgttgtttcatcataaagttaccacagttactgagatggtacttgaagatttagaaaaatatgaatttagtctcatatccagaagcataaagatgctttgcttgttctagaaagacttacgtgtgaaatgactgagataggcttttacttgtagtgaactctcacatgtactcagaacttgattttggctgaagcttttaaaatcacagaagtcaacttttacaactcaataataaaaagacraataatctaagaagtagtcaaaggatctgaatagacatttctgcaacgaagatatacaaatggccaaaattagcacatgaaaagacattcagcatcattagctatcagagaaacacaaatcaaaaccacagtgagataccacttcacactcattaggatgtgggcagacaataaatattggcaagggtgtagaaaaatgggaacattcagacactgctggtggtaatgtataatgatgcagctgctttggaaaatagtctggcagttcctcaaacagttaaacatagagttaccatgtct

SEQ ID NO: 180958 - DNA, 601 bp, Human
ggcataggagctattgataacaaaaagccagcactggaagcatggcatgagtctcttgggggcttcattagcagtggaataattctccagggagtccacaaacaacagtggcagagctgcaaggaggaagataatgggagtgttaggattctggatgaggtgatgttgggcaagaggagcctggtaaagtcctcaggattaccctaagggttattctgccttacttgacttcctcttaatgcttatggaagatttctgagagctgtaaattataaaatgcgatttgatgattgtaacaggrcaaaattttgattctttcgaaattctgaaaaaaaattttgtccagtcctctttttaaatctctcttatgtctcttatcagccttccttttaaaaggaaaaactttaaaagttgtatgtagtttgttgttggtgaaaaaatttagtcattcttatgctgaaaatattttgatggcaagaggttattgaaatcacaagcatttttattgacagattagtattgtaatggtatcatttttgtttattttgttttagatgctgttagagaaatttgttgaagaatgcaagttccctccagtgcc

SEQ ID NO: 180959 - DNA, 601 bp, Human
agaaatttgttgaagaatgcaagttccctccagtgccagatgccatttgttgctatcagaagtgccatggatattctaagatccagatatacataactgatccagactttaaggtaaataatgagtgtacagtgggacattaacttgcaaaatcatttcttaaaatgggctcaaaacaatctgtaattggaggcacccaagttctctggctagttagcagtcgtccacccctttcccaggattttttttttttttttgagataagtctcactctgtcacccaggctggagtgcagtggcaygatcttggctcactgcaacctccgcctcctgggttcaagcaattctcctgcctcagcctcccaagtagctgggattacaggcgtgtcccagcacgcccagctaatttttgcatttttagtagagacagggtttcaccatattggccaggatggtctcgatctcttgacttcgtgatccaccccctcagcctcccaaagtgtgggattacaggtatgaaccaccacgcccagccttcctggacttttttaggtctacatcgtctcacatgggaaccagagccactgatgtataaacgctct

SEQ ID NO: 180960 - DNA, 601 bp, Human
gctggctcattctttttcctcttcaagctaccttaggaggataggaaacaaagtgagattgttacctctgatttgttgcaattctgatctctcataaaatttgagtcccaaatctaaaggtcattgtgatcattgaattagctgttagagacctaaatttgagataagtctggcacttaattgagttatactggtttattcaagaagctagtagctgcccttgtcctgctgttccaatgtccctggttagtaaatcagatgaaataatgtttataaaatatttgatatattttgaagaatratgcaactttatgctgtggaaataaatatgttagtcaagctctctctgtctttatgtatgttgtagtgagtgagtgtgcagagacatctttaaaacgttaattaaaaaattttttgtaaccctagggttttatacgcatcagctgttgccagtactgtaaaatagaatttcacatgaattgctggaagaagttaaaaactacaacctttaatgataaaattgacaaggtaaagcataacaggattgtctgaatttttcagtatacttattgtatgtcaatttttcccccaagaattcctt

SEQ ID NO: 180961 - DNA, 601 bp, Human
taaagcataacaggattgtctgaatttttcagtatacttattgtatgtcaatttttcccccaagaattccttcctgaacattctgcacataattagaaaattttaaattataactttaataataaagtggaaaatcaaatttgtttttatttggacaatcataaaggcattaaccatagaggctttgtttttttaaagagacggatctcactgtgttgcccaggctagagtgcagtggtgcagtcgtagctcactgcagcctcagactccttgacccaagtgatcctacttcagcctcccaaagtgctgggattataggcatgagccactgcaccaggccccacttgaaagttttgatgtggaattagggatttcaaaaccaaaatttgatgaggtaatttgtactaagaagtcaactcaaaacaatttttttaatgttgggaagaaagatcaacttcaattttaaactgccatttctctccagggattttcttattaccaagataatgatgttaattaccattaagtagacatactttgagggaagtcatagtattacaatcttatttgtattcatagaatttgtttctgatctatagaa

SEQ ID NO: 180962 - DNA, 601 bp, Human
gtcaactcaaaacaatttttttaatgttgggaagaaagatcaacttcaattttaaactgccatttctctccagggattttcttattaccaagataatgatgttaattaccattaagtagacatactttgagggaagtcatagtattacaatcttatttgtattcatagaatttgtttctgatctatagaaactatggaccttttcctacacttcttaggcttatgcagaccactgttcttattggggaaagaatgaggcagttgtactaggcatctgttaacaatagcaattattaaagtwtggtagaaataaattctcacattttgtacattttcacataattaattaacaatataatgatatgagtaaataactgtcacctttgagtcacttctgctatgtctttgtcttacctaaattgagtttctctagtgatataccctcttttagtggtcttaactattcccatcattttaaatacactctgtaaattagtcagctttccctaggatatgctgaagtgatgcaacccaaatatcttgtggcatacatcagagaagtttgttttttgcttacatgacttgtcctgcagttctgcag

SEQ ID NO: 180963 - DNA, 601 bp, Human
tttaatgttgggaagaaagatcaacttcaattttaaactgccatttctctccagggattttcttattaccaagataatgatgttaattaccattaagtagacatactttgagggaagtcatagtattacaatcttatttgtattcatagaatttgtttctgatctatagaaactatggaccttttcctacacttcttaggcttatgcagaccactgttcttattggggaaagaatgaggcagttgtactaggcatctgttaacaatagcaattattaaagtatggtagaaataaattctcacattttgtacattttcacataattaattaacaatataatgatatgagtaaataactgtcacctttgagtcacttctgctatgtctttgtcttacctaaattgagtttctctagtgatataccctcttttagtggtcttaactattcccatcattttaaatacactctgtaaattagtcagctttccctaggatatgctgaagtgatgcaacccaaatatcttgtggcatacatcagagaagtttgttttttgcttacatgacttgtcctgcagttctgcagttgttggctgggactgggc

SEQ ID NO: 180964 - DNA, 601 bp, Human
ctatagaaactatggaccttttcctacacttcttaggcttatgcagaccactgttcttattggggaaagaatgaggcagttgtactaggcatctgttaacaatagcaattattaaagtatggtagaaataaattctcacattttgtacattttcacataattaattaacaatataatgatatgagtaaataactgtcacctttgagtcacttctgctatgtctttgtcttacctaaattgagtttctctagtgatataccctcttttagtggtcttaactattcccatcattttaaatacrctctgtaaattagtcagctttccctaggatatgctgaagtgatgcaacccaaatatcttgtggcatacatcagagaagtttgttttttgcttacatgacttgtcctgcagttctgcagttgttggctgggactgggctgtagcagctttattttgtgtggctctattccttgtttctcaatctaagttgaagaatgacccttttctggaacatcttcctgtgtcagaggaaaaagaacaatgtccagtctatgaagtgtttgttaaaccttttgtctagacatgtgtatgtcatgtctgg

SEQ ID NO: 180965 - DNA, 601 bp, Human
atagatttatcccccctagacataacatttttcttgttttttttttttttaatcaaataggattttctacaaggaatatgtcttacccctgactgtgaaggtgtcatttctaagattatcatcttcagcagtggtggtgaagttaaatgtgaagtaagtaataaaggggaaaccttgttagatagataaccaaaatgtttacaccttttgaaacatgatttgaatttgtagatatcatgtaatttggatcttttccaggaaagaaacaattacttcatttaagaaaatataggaaatactkggatgtgagaactgcttcattgtaatgaaagcattcttatattcttttatttcttaataggaaaaggaggctttttatatcttagttttactatttttactgtttttgataacttcattttcttaatcccggtaaacttttgggcagtagtgggtgtgcaggtttttagggagggggaagagcgtcttgagggattacctttaacttcatgacatgggaatggcaagagtgggtagttgtaataatatttacactttattagatcgtctgcttactcttaattttttaaaaactttttcc

SEQ ID NO: 180966 - DNA, 601 bp, Human
tataaatgtaagcatcttttgggccttatattcatcattattgaattgaaataaagatttcacttagtaatttaatactatcactgtcttctgttactcgaagacagaattgggttggtgtaaagaacactgaaaaacctttcagagattgtattcccactgaaaaacctttcagagattgtattttaactttctgtgcttaatgactaaacatatttattgtatataaagttaaggtagttgatgaggctgggttaggattgttgaaggaagtggccgtattttaggggaactaagttgttttttttttttgttttttttttttgagacggagtctcactctgttgcccaggctggagtgcagtggcgcgatctcggctcactgcaagctccgcctcccgggttcacgccattctcctgcctcagcctccccagtagctggaactacaggtgcccgccaccatgcccagctaattttttgtatttttagtagagatggggtttcaccgtgttagccaggatggtctcgatctcctgatccaccctcctcggcctcccaaagtgctgggattacaggcatgagccaccacgcctggcctag

SEQ ID NO: 180967 - DNA, 601 bp, Human
aaacatatttattgtatataaagttaaggtagttgatgaggctgggttaggattgttgaaggaagtggccgtattttaggggaactaagttgttttttttttttgttttttttttttgagacggagtctcactctgttgcccaggctggagtgcagtggcgcgatctcggctcactgcaagctccgcctcccgggttcacgccattctcctgcctcagcctccccagtagctggaactacaggtgcccgccaccatgcccagctaattttttgtatttttagtagagatggggtttcaccrtgttagccaggatggtctcgatctcctgatccaccctcctcggcctcccaaagtgctgggattacaggcatgagccaccacgcctggcctagaggaactaagtttcaaatgctactacatgaatggttcagaatgaagggtgtaaaatgcttacttttggtatgtttattttagcgtacactttcatgtcttttcaaaagtattgttaagtgtttatatttctaattaaagtttcttgagtttagtaaaacagtataatcaatctgaatcatattttatattatgtaattttgttatttc

SEQ ID NO: 180968 - DNA, 601 bp, Human
gtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcartaaactttaatacgaaggggaagtgtaggtctctgagtcattttcattttcctgccatataatttataactttaaatgcaggactataaatttgtatggttaagaatacttttccagtcccagctacttgggaggcggaggcaggatgattgcttaatctcaggaatttgagaccaacctggcaatgttgcaagacctgtctctaaaagaattttttaaaaaaagaactaaatatatgaaggcctttaaaaaacagaaaaactattacacacacacgcacaccacaatttttaggttatt

SEQ ID NO: 180969 - DNA, 601 bp, Human
taggttattttatagataggttacagtatacttcttcaaaaggtgcaatctaaggaaagaccagtcagtaaagaaatccagacctatattagactaaactatttgtaaatgtgtagatgtgtgaatactaggcacaaccatggtaaataacacatcctggagtctgccccctgctcaggagctgtgttgagaagacaaatctataattcagattctttgaagaaaaatttagaggcaagagtggatgagactaattgctcagggtcacctaaggcaaatctgtatctagagattaagaggmacatatcctagggttggactgagctgtggtaaatcacaggattatataactctgtactgtgttctgactttcgtaacttggctgggagaagggaagagtgagcaagccccctgccctcccctaaagcaggcgctttgcctaaagccatgcaggactgcagaaggcagctgcagatacagttgttgtgtaacacgaggtagggatgctttgggcacctaccagggcactatttatcttgctgactggatagcaactggcctagcacaatagttcattcagtcggcagctattagataagag

SEQ ID NO: 180970 - DNA, 601 bp, Human
tggctcaagtgatcttccagccttgtcctcccaaagtgctggggttacgggcctaagccaccatacctggcctcattgttatatttttaaaggaatttaatgctatactttcatctcctaggtctaataaaggtaactatgatagtagaaggctttggcccacattattcaaatctaatagacaagaattattataattagcctaacaatgttaaatggtgtttctaaaatgcccaatagcttgaacgaatctgttctcaactatttaaatgtttttgctgagaatataagcaaactatartcagctggctttcagagatgtgaaactaaatgtgattttacagtaaataatttccctcctcttctgatttgggttttgtttttattacaggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcc

SEQ ID NO: 180971 - DNA, 601 bp, Human
agcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatgggtatgtggactgagtttagacttatattacatttaatcttaagggggaaaaaatctgtgaaggacctagcttgtttaaatatatamcaaagaaaatagtgaaaattattatggtacaatcagtttatgtggggaagttagtgattaacagtagcaatttttttatatcatgaagcttttttactttatcagttaaagagatactcaaatgtaggtatgttatgctaacaatacacaatgttcttcccgtcttagatattttcacagcatcatgggaaagattgcatgttacactgacagaatctattagtaagtggtttgatttatagcattttagaaaacattggtctgcagaagtaggtgatgtttgcagaatctagaatggat

SEQ ID NO: 180972 - DNA, 601 bp, Human
ggagttagacttttaaatgtcatgctgtttgttttaaagggtacattaaaaggtctggccttgtacgatggtgtcacagatgataaagttccaatgcatataaggagtggaaagcttacttttgacaacaaaagttcttagaaaagagcacactcaaatacagatggctttatcttttcaggatactgcttcatgactgaaggtgacatgctacttgatagcctgaatttattgccatcagtttgctgctgctggtaataaaatgctgtcccgggactgagcttacaaaacctgatgcatktttggatcacaaaacaagacaactaaaaaggacacaattccctctcagcatacactcgtcctttaacttgtgttctctacatataatacacagcacttccagctgccactgtttctctgtttctagtcatgaggtcagaagccactaaccaaattattggcaatcccaatggattctcaagtgcagtagctctgccttccaccttcaccccaaacattttcagttttatctcttcatttaaaagaatagttatatttcttaaaacttttcaaaatctactgatcttgtagatcagagtgt

SEQ ID NO: 180973 - DNA, 601 bp, Human
ctgtgggcctctcccttgcagacttcagacttgagtccttcgtgagcctttgttgccttgtgtttcacgtggtccttagcacgctgggttacaggagtttgtctgtttgtctttctggcagtagaacaggagttcatcaatggtagggactgtcttgtgcatctctattcccaggactagcatagatggtacctagaaggcactcaacattatgctgaatcagattgaagttttatggttctttgtagttggtttcccgtttagtcagccattttgcccttggtttctaaaccacacttgygtcaaagccaaataaggaatagaacatggcctatgccagtagtatgaggagttattttaaggctttagtgtactatatggaaatgtaaatatttagttttctcacaaaaccatctgtatattcctacagacagccgctgtactgtgttaaggaaacaagatagtggtgaagcaccggtaagttacttgatcacttgaaatcttacgttctaatctatgttaaaccaaggatgagaaggggacccaggccagtgtttattgacatcacagccagcattcaagaaccacattaaaaggacgt

SEQ ID NO: 180974 - DNA, 601 bp, Human
tttatgttgagcttcataatgctgttatttgagtgttcactgatttttccccccattttttagtttagttcaaccaaggtgaaaaacaaaagcaagaaaaagaagccaaaggattcaaaggtatggagtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatrtaatagcaagtcttgacactcgtattctttattgtcttttttatttttctaggtatttctgagtaaaaaaaaaaaattgtcataatgtcccaaaaaataaataagtctcaaaaaatagataacatatttaaactaaaaatgatgaatactaatcattatgacagtcccaggattgatagaatcccttccttcctctcaccaaaggctctcctccaagcccattagataagtagggcatttttatttttatttttgagacagggtctccttctctcacccaggctggagagcagtggtaca

SEQ ID NO: 180975 - DNA, 601 bp, Human
cccccattttttagtttagttcaaccaaggtgaaaaacaaaagcaagaaaaagaagccaaaggattcaaaggtatggagtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatataatagcaagtcttgacactcgtattctttattgtcttttttatttttytaggtatttctgagtaaaaaaaaaaaattgtcataatgtcccaaaaaataaataagtctcaaaaaatagataacatatttaaactaaaaatgatgaatactaatcattatgacagtcccaggattgatagaatcccttccttcctctcaccaaaggctctcctccaagcccattagataagtagggcatttttatttttatttttgagacagggtctccttctctcacccaggctggagagcagtggtacagtgacggctcactgcagcctcaaactcccaggctcaagtgatcttccca

SEQ ID NO: 180976 - DNA, 601 bp, Human
agtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatataatagcaagtcttgacactcgtattctttattgtcttttttatttttctaggtatttctgagtaaaaaaaaaaaattgtcataatgtcccaaaaaataaataagtctcaaaaaatagataacatwtttaaactaaaaatgatgaatactaatcattatgacagtcccaggattgatagaatcccttccttcctctcaccaaaggctctcctccaagcccattagataagtagggcatttttatttttatttttgagacagggtctccttctctcacccaggctggagagcagtggtacagtgacggctcactgcagcctcaaactcccaggctcaagtgatcttcccacctcagcctcccgagtagccggaatgacaggcgcatgccaccatgcccagctaattttttgtattttttggagagat

SEQ ID NO: 180977 - DNA, 601 bp, Human
tctctttaatggaattttaaggtagaaaatcattgtcatttttctgtcttttaaaccagcctatgttagttgggtctggaacaacttcagtaacttcaaataatgagatcatcacttcaagtgaagaccataggtaagtataatttttaaatttttgcttcattttaactcaaatgtctttacttaataagttgtgttaatttaatatatataaacttgtgttttatttccctaactttcctttctaaagctgtgcatctgacaacctgatgtaattccatcttgattacatttatatagygtggctagaaggcattaagaattcattcaaactgtgttaaagtcacgacactggtgacattcattcactaagtacatattgagaacctaccatgtgcaaggctctgtgggaaaatcatagaaaaatgtctagaaattattctttaaaatagtcaataaagagaatgtcctgttaatacttactagcatttttgctgtaagagaggaagctgttttgggagctgtatatgatgttatgttttcaccttatatattagtgattttcaatgccatctggttgtcaaaactgagttttcaataa

SEQ ID NO: 180978 - DNA, 601 bp, Human
tatttaccagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgagtaagtgggttgaaatttttacaaccattattttatactaaggctgccaattaaagatcagaagttgtttaatttgtgcctgtttttagagattttgccacattttacacaaagttaatttaggattttttttttttttttgagacagagtcttgctgtgtcacacaggctggagtgcagtggtgcaatctctgctcactacaacctctgcctcccaggttcaggtgattgtcatgcgtcagcctcccgagtagctgggattacaggcttgcaccaccatgcctggctaatttttgtatttttagtagagaagggtttcaccatgttggccaggcaggtctccaactcctggcctcaagtgatctgcctgcctcagccttccaaaatggtgagattacaggcatgagccacctcgccccgccctga

SEQ ID NO: 180979 - DNA, 601 bp, Human
gtgatctgcctgcctcagccttccaaaatggtgagattacaggcatgagccacctcgccccgccctgaggatttttaattattaaatttagagtcctaatgattattgattttgtcagtttgagctactaagtcgatactgagtggggtggataaaacaagtaaaaaattcaggaaaatctcagatagcttaccattttgagctttgtgttattagatagtgcatgaggccttccttttaagaaaataaatcaagggctgaggtctgtaatagagtattaatttaaaagccaactcttctgctggaagtcctgtcagtagcatatccaccatatggccctttcttctgttttcctgtattgcatcattcctatttagttctgtgctcttagatccttcttcatggtttttctttagagttgaaatgctgagcaaatcatatttccagagaactcttgggtgacagtgtggaaacaactgtaaaattatactattatttcttaaagtatgctagaatttgcttcaggcatccaaaagtaaagctaaagtatgtagttttcagtatttactgtacgcaaattcaaataggatttgtttttgag

SEQ ID NO: 180980 - DNA, 601 bp, Human
gatgagcactgtggaaattctaacaacaaatgtgaagtaattccagaaagcaccagtgcagtaacaaacattccacacgtgcagatggttgccatacaggtaagagttaaatagaaaagtcttcttaatactgaagttaaattttccttttcatttttcattgccgttatatttgcaagaatccttaaagttgattgactttataatgattactgaagcttttgcctgaaaatacttttaaaatatgaactcttttgtgaggcatgacaggtaatcttctcagaaagaagcttgggtccartaaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagcgcatgaaggaggaagggaaaatgtgctggcagctcctcagaaagagaaggaaaaaggaagac

SEQ ID NO: 180981 - DNA, 601 bp, Human
taaaatatgaactcttttgtgaggcatgacaggtaatcttctcagaaagaagcttgggtccaataaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagygcatgaaggaggaagggaaaatgtgctggcagctcctcagaaagagaaggaaaaaggaagactctgacctacacaggcccagcttctcctgtcaaaccaggggaggaatgagaatgttaaaaagagacagccaggtagaaacaagagggatgtgtatgagttctttcctaacaaggaagagatgaaatcaagattctcctatggttgcctttatagggtatgaattcattaaatccttattgaattgccccactcattatgttttctaggaagctttgaaaaaaataggttaagagcaat

SEQ ID NO: 180982 - DNA, 601 bp, Human
actctgacctacacaggcccagcttctcctgtcaaaccaggggaggaatgagaatgttaaaaagagacagccaggtagaaacaagagggatgtgtatgagttctttcctaacaaggaagagatgaaatcaagattctcctatggttgcctttatagggtatgaattcattaaatccttattgaattgccccactcattatgttttctaggaagctttgaaaaaaataggttaagagcaatggatcataatcattttcagttatactaattctaaataactttcctaatatacatgtttacrgaaagcatggaacatgatctaaatgggaaaaaaaaacttgaaaaaattgtgggtgtgttttaaagtgttactacttgatgggcttattttactagagcgattgagataaagtgaattttaattttttgttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagctta

SEQ ID NO: 180983 - DNA, 601 bp, Human
caagattctcctatggttgcctttatagggtatgaattcattaaatccttattgaattgccccactcattatgttttctaggaagctttgaaaaaaataggttaagagcaatggatcataatcattttcagttatactaattctaaataactttcctaatatacatgtttacggaaagcatggaacatgatctaaatgggaaaaaaaaacttgaaaaaattgtgggtgtgttttaaagtgttactacttgatgggcttattttactagagcgattgagataaagtgaattttaattttttrttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagcttattccacacaaagttatcatggaataagcttgagaacataacaaaaaaatgattttgtttttattgttgaaatttgagaagggaaggaaaaggtaatttttttccagcatacttatttcaaattataac

SEQ ID NO: 180984 - DNA, 601 bp, Human
acttgatgggcttattttactagagcgattgagataaagtgaattttaattttttgttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagcttattccacacaaagttatcatggaataagcttgagaacataacaaaaaaatgattttgtttttattgttgaaatwtgagaagggaaggaaaaggtaatttttttccagcatacttatttcaaattataacagcgttattgttttattttattatttttaaaattttatttatttttattttaattatttttgagacacggtctcactgtcatccaggctggccagctttattgttttaactggtataatgagcatataataatttataagtaagcttattcatgcgaataatacagaaagataaagaccttctctactataataatgattcaattagaaaacctactaatataatttagttcgttaatatgcatc

SEQ ID NO: 180985 - DNA, 601 bp, Human
atatttcacaattgtgaaatctcacaatttcgctaagtcaggcattcaggagcagtttagttggatgcttctggagattctcatgtagctagccaagatgttgaccagggcttggtcatctgcgggagtaactgggcccagaggttctacttccaagatagctcactcacatggctggcaagcggatgttggcagttgtcaggaagcttcagttccttgccttgtggacctccacctagccctgcttgacctcatggggctggcttttcccagagtgtgtgatcccaggcagaagcggcartgctttaggaagtcacaaattatcacttctgctgcattctcttggtcacatagatcaatccaccaaccctgatacatggtaggagaggtctatacaaggctgtgactaacaagaggcctggttactgcacaggattaatttgaaactagacaaattgattttaaacttcatatgtaaaaatgaacatcaagaatgggtatggaagagaaactaagaaaaggagttgtgcaactaaatatcaaaacacaatataaatctatctatattaccacatacatagaccattaatatgagagtgcc

SEQ ID NO: 180986 - DNA, 601 bp, Human
cagagcttgtgtttcctgctgctatttgtacaaatagtgtttagtttttgctaatgataaaataatatatagagttcttaaattttttaaatgaataataccaaaaattatgaaagagaaattgaaaatcatctaccttcccatcactcatgttaatattttgatgtgtagccttccaggatgtttgaacatttacatataattaaacaatagtttttaaaagatgggatcacagcatatatattttatttgaaatttgcaggcttcaattaatatattgtagacttgtttccatatcagwaaatacgatttatagcatcattttaaatggatacttggttttccattttattaatgtgtgatcatttatttgaccaatttcttgttgttgaacatttagattgtatcagctttttatgcttacaggcagtcttatagtgaacattttggcctgtttactgttgttgaagtcttatgctgtgcttagctttaaaccaggtaggctctgttgtttaatgagtcagtgcttttgaccatcaaatgaatgtttttatcagtgatgggaatgttcacaaatgctttcttaaattagctgttagtt

SEQ ID NO: 180987 - DNA, 601 bp, Human
caagatgaggctggggagagtctaaggacaagaagaattagatagatcctgagactttactcagtttcctggctgggagaagtaaagaagaacaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatayctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccag

SEQ ID NO: 180988 - DNA, 601 bp, Human
acaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgyacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttac

SEQ ID NO: 180989 - DNA, 601 bp, Human
aggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcrtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttacgctcatagctcatggagaaatttcttaaaacatagaaagaaatgagtggcttttcctgatatgtccctttggcctttgactgcagattgctgaggttatga

SEQ ID NO: 180990 - DNA, 601 bp, Human
atgtttggatgtagcaaatgcatacccagccccttatagagaacagaaaaacagggaagctatagaaatctgagtgcattagagtcccactgcccataccacaccctagcacctccatgtagtagctttgtgatgttagacaatttcttcagcctctttgaccctcggtcttctcattaataatgtattgtctacttcacagctttgtgaggcctcacctggggtggttgaaaaaggacaggggctagccagagatagtaagtacagtactcaaggaggaactgtcccacccaaaattctrcttgtgcctctgctaagcaaattgtttttttacaaaccactttaagaatacttagcatatggccaggcgcggtggctcacacctgtaatcccagcactttgggaggccaaggtgggtggatcacgaggtcaggaggttgagaccatcctggctaacacggtgaaaccccgtctctactaaaaatacaaaaaaaaaaaaaaattagccaggtatggtggtgggtgtctgtagtcccagctactcaggaggctgaggcaggagaatggcatgaacccgggaggcggagcttgcaccgagccg

SEQ ID NO: 180991 - DNA, 601 bp, Human
cttctcattaataatgtattgtctacttcacagctttgtgaggcctcacctggggtggttgaaaaaggacaggggctagccagagatagtaagtacagtactcaaggaggaactgtcccacccaaaattctgcttgtgcctctgctaagcaaattgtttttttacaaaccactttaagaatacttagcatatggccaggcgcggtggctcacacctgtaatcccagcactttgggaggccaaggtgggtggatcacgaggtcaggaggttgagaccatcctggctaacacggtgaaacccygtctctactaaaaatacaaaaaaaaaaaaaaattagccaggtatggtggtgggtgtctgtagtcccagctactcaggaggctgaggcaggagaatggcatgaacccgggaggcggagcttgcaccgagccgagatcacgccactgcactcccgcctggacaacagagcgagactgtgtctcaaaaaaaaaaaaaaaaaaaaaaaggaatgcttagcatatacaggccgggcacggtggcttacacctgtaatccttgtaatcccagcactttgggaggccaaggtgggtatatcacctga

SEQ ID NO: 180992 - DNA, 601 bp, Human
tatgaagctcctactatgtgccacactcaattgtttttacatgtatttaatctcaaaacagtccttatacaatagtgttatactgtagtacataaataaatctccatgttactggtgaggaaatggaggtgggagcagctgatgcagctttccccaagccacaccagtacgaagtggcagaacaggttgtgtcaggcttcagagcccatgcatttgttctcccttaagagaaggtcagctccacggcctagttcaactaactgttaggaatgtttctcaccactttacagcagtgtaggcrtatcagttaatcactgtcataataatgctgagtgactcccagccacaaaaccccagtgacacatgactgtaatcgctaagcgtagaagtctggatcagctggtcctgcttgggctcggctgggtcagttcaccttagggctagcaagagctctgcagcatctttgctgttcttgcctacatatctgggttcagctggctgtagattgatctagaatggcctcagctgggatgactgggacaactagctctgctccacatgtcttgcatcttccaccctgaaaatcctattctgaaggcag

SEQ ID NO: 180993 - DNA, 601 bp, Human
ctcccagccacaaaaccccagtgacacatgactgtaatcgctaagcgtagaagtctggatcagctggtcctgcttgggctcggctgggtcagttcaccttagggctagcaagagctctgcagcatctttgctgttcttgcctacatatctgggttcagctggctgtagattgatctagaatggcctcagctgggatgactgggacaactagctctgctccacatgtcttgcatcttccaccctgaaaatcctattctgaaggcagtaggaaggtgcaaaggcaagcaaagatggccacacrgcacctttcaagcttctactgacttcaggtctgctcagaccccaccggcaaaagcagtcacatagccagccagagcccgggctggggaagatagactttgcctccttagcgaagggaactgcaaggtcacatgataaatggaatggctagagtgtgaaggatggagctatgaatgccatccctccactacagtaggtcagcgccagtaatttactaacactcagtaattaccaagagccttctgtgattggtgcctgcttcatcttccgccttctcccttgccagttctctacattgttc

SEQ ID NO: 180994 - DNA, 601 bp, Human
gatcctttattcatttttgaattgagtttgtctttctattattgacttataagagtttttgggccaggtgcggtggcttacacctataaaaccagcactttgagagaccaaggcagaaagatcgcttgagcccaggagtttgaaaccagcctgggcaacatggcaaaatcccatctctacaaaaagttaaaaaattaaccaggcatgatagtacgcacctgtggtcccagctacttgggaggctgagctgagagggtcacttgagcccaggggttttgaggctacagtgagccaggatcaygccattgcaccccagcctgggcaacaacagagtgagaccctgtctcaaaaggaaaaaaaagaaacaaaacagggctgggcatgatggctcacacctataatcccagcactttgggaggctaaggcaggaggattgcttgagcccagtagttcaagaccagccagggcgatgtgatgagaccctcactcgctacaaaaaaattaaaaaattaaataaataattaggtaggtatggggatacatgcctgtagttccagctactcaggaggctgaggtgggaggatcacttgagaccaggaag

SEQ ID NO: 180995 - DNA, 601 bp, Human
aacaacagagtgagaccctgtctcaaaaggaaaaaaaagaaacaaaacagggctgggcatgatggctcacacctataatcccagcactttgggaggctaaggcaggaggattgcttgagcccagtagttcaagaccagccagggcgatgtgatgagaccctcactcgctacaaaaaaattaaaaaattaaataaataattaggtaggtatggggatacatgcctgtagttccagctactcaggaggctgaggtgggaggatcacttgagaccaggaagttgaggctgcaatgagccatgawcttgccactgcactacagtttgggcaacagagcaagaccctgtctcaaaaaaacaaaaacagagagtttttctatattctggatacaagttgcttatcaaatatttgatttgcacatatttacttccatcttccatatttgtaaatgtatctcctgtctccattttgtgggttgccttttcactttcctaatggtatcatttgcagcacaaaagtttttactttgagtacactaagtccaatttctcttattcttctgttacttgtgcctttggtgtcatagctaagaaacccgtctact

SEQ ID NO: 180996 - DNA, 601 bp, Human
gtgtcatagctaagaaacccgtctacttcaagcgcactgcttacccatttaggtctgtgatccatttcacattaatttttcaaatagtatggtatagtaattatcttttatgcatattttctctaccaaactgtgatcttgaaagtaaggactgtttttcattttgtttgttttttgaatgggggtctcattgtattgccaaggtagaactcctgggctcaagggatcctcctgcctcagactcctgagtagacaagactacaaacacatgccaccagccccagaagggtggttttcaaarttatctttggttgacagcacctagcttagtatacaaactaggagctttgcaaatgtttatcaaacagtgtgtgcttggcccctgaaaagctgcatttaatgaattgtgttttcatgttctctatcagcctacatcagaggacatcaggctcacattctgtgaagtttgctgctttgtttactgctagtatggagttggggatattatccattctttcatgtgacagatatttcttgaatgttctcttaagtgtcaggctctgtgctggtcttgtggggcgtttctgcagcatcctcttct

SEQ ID NO: 180997 - DNA, 601 bp, Human
tattttctctaccaaactgtgatcttgaaagtaaggactgtttttcattttgtttgttttttgaatgggggtctcattgtattgccaaggtagaactcctgggctcaagggatcctcctgcctcagactcctgagtagacaagactacaaacacatgccaccagccccagaagggtggttttcaaaattatctttggttgacagcacctagcttagtatacaaactaggagctttgcaaatgtttatcaaacagtgtgtgcttggcccctgaaaagctgcatttaatgaattgtgttttcrtgttctctatcagcctacatcagaggacatcaggctcacattctgtgaagtttgctgctttgtttactgctagtatggagttggggatattatccattctttcatgtgacagatatttcttgaatgttctcttaagtgtcaggctctgtgctggtcttgtggggcgtttctgcagcatcctcttcttgaggcccttctgtctgccatcacttccagggcctctcttgtgcaactggtttgtttttatgttttatattgaattgtacagttcattatattttctctttgaccttgtctgcc

SEQ ID NO: 180998 - DNA, 601 bp, Human
acttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagctttggaaagagaaattaaaaaatggcaacaggaaaaaaaagaaatccaagaaagactaaaatcactgaagaagaaaattaaaaaggtttcaaatgccagtgaaatgtaagtaatgattgaaaggcagtaatttttatttaaaaaaaaatattgtggcttttggttattttcacatttttgatatttaatattaaactacatcaagtaaagtaaaaatgaatactgttttcattgttttgtctcatttaaaaaagtattcattgagtaattatctcacctgaatttttttctaaacttaac

SEQ ID NO: 180999 - DNA, 601 bp, Human
gagcatgaccagtcttggtcattttgttactaaaaagtgtggaaatatttatatttaacatactttttttgttcaattcagacatactgtcaaactagacaaggtaactagaggctgttaatgataagaaattttttttctgtactagcataaaagttaatttctgctggagaataaactttttattgttgacttttttccattttattattagatttctttacctttcctgtcacaatttaaagataagccacacgcttctctctaagttttttgcttttttttttgagacagagttttscttttgtcacccagcctggagtgcaatggtgcaatctcagctcactgcaacctctgcctcccatgttcaagcaattctcctgtctcagcctcccgagtaactgggattacaggtgcccaccaccacgcctgactaatttttctatttttttttttttttttttagtagagatggggtttcaccatgttggccaggctggtctcgaactcctgacctcagatgatccacccatctcggcctcccaaagtgctgggattacaggcatgagccattgcacctggcctgctttttacattttcc

SEQ ID NO: 181000 - DNA, 601 bp, Human
cctctgcctcccatgttcaagcaattctcctgtctcagcctcccgagtaactgggattacaggtgcccaccaccacgcctgactaatttttctatttttttttttttttttttagtagagatggggtttcaccatgttggccaggctggtctcgaactcctgacctcagatgatccacccatctcggcctcccaaagtgctgggattacaggcatgagccattgcacctggcctgctttttacattttccaaataaatgctttaaagctcaatttttctatttagatttttaagtaaaatmtttaaactttttggatctctttctcagagatgcacaagggacatgaaaaatgatttcttggatgtttctgtgctcttgatcacacttagtattcgttaagaaatgactagaacatagagctcatgattggtacagtgacacaaaccacagatggctatgaaagaaggcagggcttccatgagagtgtcagagtgtcacccagtatttgtctatttagaggagggaggaagtgttttacaaaagaagtaaaataatagttaaactggcttgtattagaaacaagcggctttagtaaacaga

SEQ ID NO: 181001 - DNA, 601 bp, Human
aatttttctatttagatttttaagtaaaatctttaaactttttggatctctttctcagagatgcacaagggacatgaaaaatgatttcttggatgtttctgtgctcttgatcacacttagtattcgttaagaaatgactagaacatagagctcatgattggtacagtgacacaaaccacagatggctatgaaagaaggcagggcttccatgagagtgtcagagtgtcacccagtatttgtctatttagaggagggaggaagtgttttacaaaagaagtaaaataatagttaaactggcttktattagaaacaagcggctttagtaaacagagatgactgcaaaggtatctcagggtagcatgaaagaagaggcagaacccgccttgtgcagggcatggctcaagaatcggagattcacacacttgttttgaaggattatcagagaatgtgagtgtgtgtgtgcgtgcgcacccgcgtgtgtgcatgaatgcttgttttgactttaagttctgttttaaagagtagaaggctgttttcattttgaatgagaatccacatcttctcattttgaataagatctctggttacactgatgatgatg

SEQ ID NO: 181002 - DNA, 601 bp, Human
aactttttttggattaacttgaaactataaacatgttgtaaaaacttttcttttgtgttacttggaatattcgtctccactgtaggctggtagtttgttgctgttattgctttataattataggttcattaaatttttactatgaatctatgcaaagtttccttttaacccttgcttgctaatggaaataatatgttttcacatactgctaaccagtacattcagtgataagcagttgcattctgcttttctcactattgtttcttacgcacattcccatcccggtttttgaataattttrtacagatttctttttccctttgggttctgtccttgtaatatgcgtcaaaacagagtttctggctcaaaggatagggaatgttttataaagcttactttttaaaatttttatttatttattttttgagatagggtcttgctctgtcacccaggctggaatgcagtagtgcagtcattgctcactgcagacaccatctcccagctcaagcaattctctcgcctcagcctctcgagtagctgggactacaggcacgcaccaccattgtattttttgtagatatagggttttgccatgctgtct

SEQ ID NO: 181003 - DNA, 601 bp, Human
agaaaagacttagtttatacagtctgcaaacattaggcttttcaattaagaattgactatgcacctgcttctaaggacaggaaaggaaaaagagccaaagtatgaatactttttgggtcctacaccagcatccgtattcctgagcttgtttaattcacaccaccgtttggtaagcaggtttgcctggtgggccctgtcaagtttactgacacctggattaaaaggctatttaatggatcatttggaccatgaggccattttacatttcctgcagtgattctcacaaaaatggccagttggyttgtggggaagccacagagagtctaaaatcttaaaagcataccccgaagcttttgatgcccttgccgagaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagt

SEQ ID NO: 181004 - DNA, 601 bp, Human
cttctaaggacaggaaaggaaaaagagccaaagtatgaatactttttgggtcctacaccagcatccgtattcctgagcttgtttaattcacaccaccgtttggtaagcaggtttgcctggtgggccctgtcaagtttactgacacctggattaaaaggctatttaatggatcatttggaccatgaggccattttacatttcctgcagtgattctcacaaaaatggccagttggtttgtggggaagccacagagagtctaaaatcttaaaagcataccccgaagcttttgatgcccttgccragaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagtctaattcatgttcacctatgatacaatcaagttctgatgattctgtcatgcttcatttaaggagaaa

SEQ ID NO: 181005 - DNA, 601 bp, Human
ttttgattcaaatttcaaaccctcagcattgaaccagagattgtgtgaatcacggacagttttagtgtatagttctttttctttctttttttttttttttttttttttttttttgagatggtgtcttgctctgtcgcacaggctggagtgcagtggcgtgatctcggctcactgcaacctccgcctcctgggttcaagtgattctcctgcttcccgagtagctgggattataggctcccaccaccacgccaggctgatttttgtatttttagtagagatagcatttcaccatgttggccakgctggtctctaactcctgacctggtgatccgcctgcctaggcctcccaaagtgctgggattacaggtgtgagccaccatgcccggccccttcttcattttcaagatttaattttttttcatgagaaaacttttctgattaaaagtaaaatgctgatttagaatataggactagtacagctgaggttgagaccaagtggtagtcaaccgcctgtactaagcacccaccataggctgcattgtggctcatctgggaaacaaagataatctcagactcatttcatctaatagtatcaactctt

SEQ ID NO: 181006 - DNA, 601 bp, Human
ctcatgttccttggcctgtcttctatctttgtgtgtgtgtgtgtgtgtgtgtgtgtgtgtgttgtatatgtattcctgactttgaacaaataatccaggagtagcagttgcctgttgcgcactgcttttgtgattcaagcaggccgctatcaccacctcagattatactcttattcctagatatttgggacataagaccaaaatctaaaaattaagaggtttcctcctcaaatacagaataaaagctgctatgcctgaggcatacagggctttgttggtccggcacatcatattttactayttgtttgaggtatttgccgaatcttgttaataacagtgaataatcttgtctttttattttaatatacacagcacagtaaagaaaagcattaattgcattttgtggactttacaacatggctaaacccatatttcttagatttggacatagatagatgcttagtaaatactaaattgaaatgaattaggcccagaggagatcagaccataggaatttaaagttagatcttgagagaaaacttaggtaaaaaagaaaaacaaaattaaaggaggactgtgtgtgagagttgaaagatataag

SEQ ID NO: 181007 - DNA, 601 bp, Human
agcaggccgctatcaccacctcagattatactcttattcctagatatttgggacataagaccaaaatctaaaaattaagaggtttcctcctcaaatacagaataaaagctgctatgcctgaggcatacagggctttgttggtccggcacatcatattttactatttgtttgaggtatttgccgaatcttgttaataacagtgaataatcttgtctttttattttaatatacacagcacagtaaagaaaagcattaattgcattttgtggactttacaacatggctaaacccatatttcttrgatttggacatagatagatgcttagtaaatactaaattgaaatgaattaggcccagaggagatcagaccataggaatttaaagttagatcttgagagaaaacttaggtaaaaaagaaaaacaaaattaaaggaggactgtgtgtgagagttgaaagatataagttccagaatgttgtggcaggacagtgaaatcttctggttcctaaagacggaggagactctctcccagcacctgacttccaccctcccactactgccagacctttgcctgggctgttcctagcctggagcactgtccc

SEQ ID NO: 181008 - DNA, 601 bp, Human
cagaatgttgtggcaggacagtgaaatcttctggttcctaaagacggaggagactctctcccagcacctgacttccaccctcccactactgccagacctttgcctgggctgttcctagcctggagcactgtccccgctctgcatcctgccttcccctgaaaccccgtcaggggctgccctcttttggcctcccactgtgtcccttctctcatgtgcattagatctcagcctggccttgaatgtctctttctcaccagtaccttgcacagtaaacattcaaacttactgtgaattcatctgaaaaaaaaaaaattaagtgtggaaaaagtgtgaccaccctgaactgagtaaaatattctgttgagatccagttttttctctccattgaatgtgcagttttagttagaattacactaaagggcacttatcatttatcgtttttccaagttcttgtaacagatatgtatagagaaaacgttggctctcaataggatattttactgttagtttgtaatcctagcttatgttattttatcaatactcaaaaggattttcatatcctaaattctgggaactcttagtgtgccaggagcttgagtaa

SEQ ID NO: 181009 - DNA, 601 bp, Human
gaggggtgtgtttggacggttagagttccagatggaacacacagtgctcctggagcctagagagacagagaacacactcctttcatactgtaatagaagcccagtatgacgcaggggcaaagccaatggagccttcttctctaagctgtgttacagcagcttagacacttctagcttcattagaccagacaggataggtctcaaataagggaacagcagcagaacaggagtccctccttcttcatggcttcgctttccgtggtttcggttatccgcagtcaaccgcagttagaaaatactyaatggaaaattccagaaatacataattcctaagttttaaattgcacactgttttgagtagcgtgatgaaatctgtattctcacatggtcacattgtgacctcctccctttgtccagtgttttcatgctgttgctgctccctgcccgcgagccacttagaagctgatttggtgaccagatgaacttctcgcgttaccccagtgcctgtgttcaagtcacccctattttactccataatggccccaaagcatgggagtaatgatgctggtcaatcagatatgccatagagaagcaatatatt

SEQ ID NO: 181010 - DNA, 601 bp, Human
gctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatyggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctct

SEQ ID NO: 181011 - DNA, 601 bp, Human
agtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgyccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacg

SEQ ID NO: 181012 - DNA, 601 bp, Human
gcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcsacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacc

SEQ ID NO: 181013 - DNA, 601 bp, Human
cgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcayctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcgg

SEQ ID NO: 181014 - DNA, 601 bp, Human
ggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacwtttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaacttctgacctcaagt

SEQ ID NO: 181015 - DNA, 601 bp, Human
ggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgascactgggtaatattcatcagaacccatgacaatttgctaagattttgatgagaccaatagcactgtctaaaactagtgttatagtatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacct

SEQ ID NO: 181016 - DNA, 601 bp, Human
agctgggattataggcatgcatgactaagcctggctaatttttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgagcactgggtaatattcatcagaacccatgacaatttgctaagattttgatgagaccaatagcactgtctaaaactagtgttatagwatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacctgagtgagcaagagctgtaaatagagttgggatgatggcaggctcttcagtagcgtttctgcctccacctctggtttccgctgttc

SEQ ID NO: 181017 - DNA, 601 bp, Human
tttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgagcactgggtaatattcatcagaacccatgacaatttgctaagattttgatgagaccaatagcactgtctaaaactagtgttatagtatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacctgagtgagcaagagctgtaaatagagttgggatgatggcaggctcttcagtagcgtttctgcctccacctctggtttccgctgttcaggttgttacgagggggacagagttgcctcttgtctcagc

SEQ ID NO: 181018 - DNA, 601 bp, Human
tcttttagttagaaatatactgtgcccatcttttctaggaaatagaaaacggtcaagttaagtgtatatttttttcaaactaaacctggctccgagctttgcactgggcattggagaggccttcaatggctcttccccggtctggcacttcctcttcttccctgaccctcgagtcatgggcagcagtggaggggcatgaaccctccttctgcagcatctgccccatctcctcctgggccgagtcatgccttgggagagacagcaaaaccctgaacagcagttcaaggtcttctcagccttsgggtgatgcctccagtgccactccctgaacttgatcccactgccagggctgcctgcattcgcccactccctcagcaggggtttttagagcatgagtttgagctaggttttctgccagctgctaaagacccagatgggactcattttgtgccttcaaggcgctcagagttaagaggcagtgagctagagtagaagttaatggtgcagtaagggtaagtgctgtgagctgcagggagaactgtgcctggagtcccaggcgacactcaggtctgctctcacatcgaaagcactgtctatgctc

SEQ ID NO: 181019 - DNA, 601 bp, Human
taattcacaccatgccatgtgattatcccatactgtactttaggtatggtaatcttcacctggggatcttctggtcacataaaacagttttttctctgaggaaattagaactttatacttttctttttgtatttttatattttttcttaagaaatgctattaaaaaataagttgtttcctcagactgtttagctgtaattgtgaataatttgccaccctttgtggcagaagatgtttgaaggccacttgaaggaagaactcgtgtcataaaaacaactgtagttattctttactattcagrtgtgtttgtttccacaggcactgggtgcaagttcctgtgaaatatgccacgaggtgttcaaatcaaaaaacgtgcgtgtgctcaaatgtgggcacaagtatcacaaaggggtaagagctctttttggccatccttacagcatgcattgggaccttcaaatattttcaaaataagaaaggaattgttttctagtcatcagtatttattgtgctttcaaactattttctttgcaaacctcccgtgtcagtgttcagtgcctccctgtcctcacaccagctctgcaggaagggcagctctgga

SEQ ID NO: 181020 - DNA, 601 bp, Human
gtttgtttccacaggcactgggtgcaagttcctgtgaaatatgccacgaggtgttcaaatcaaaaaacgtgcgtgtgctcaaatgtgggcacaagtatcacaaaggggtaagagctctttttggccatccttacagcatgcattgggaccttcaaatattttcaaaataagaaaggaattgttttctagtcatcagtatttattgtgctttcaaactattttctttgcaaacctcccgtgtcagtgttcagtgcctccctgtcctcacaccagctctgcaggaagggcagctctggagacygtcctttccatcccttgtggggagaggggaacagcagctccagccactcgttagtgctgagattcaaagcagtattagttccttgaaaggtgatttcttacacacttgactaaatggagaaacagtgaaaccatttttttgacttagtgtagtatatgaagtcagtttaacattttagaggagaaaaactaaacctagctgagtcccttctgcctgacccagggacagtcctgctcgtaccgttctgggatctgtgtgtgaactatcatggtgttctaggtaccgtgagcatttgtgtgc

SEQ ID NO: 181021 - DNA, 601 bp, Human
gctgggttagaacagatcaggtctctgccatggggatttgctaatcccttggaacgggataaatacagcatgctcactgaaaggaattgagaccacttgccaagtctctggtgtggtgtgcctccttgggtacagggtcttatatttgggctagctgactgtccacagcctctgcagtgtgggcagcagcagcaggagtgtggcgtgcaggctggagggctgttccagagccaagggccaaggccaggccaagggatgggctaagaatgagtgattgggtcatagggccgagaatgccagrctctggaatttggcgcagctgaagtggaagagccgagcctggaaccggggatcagggcaagaccaccccctgaggccaggttggaggcccagagcgctcaggatctgaccctgaggtgggatcgtttgcggctggggctttgtccacactctggcctgagcgggtgttggtgtccctgagtattgggcagctccaggcccaagagaccaagggcaagtgagccacgcctgccaaggagcccagcagcacaggggagctaagcttcctcatggtcctgaaggcatcttctgattttgtttt

SEQ ID NO: 181022 - DNA, 601 bp, Human
tgattttgttttctccttttcagtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgytgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagt

SEQ ID NO: 181023 - DNA, 601 bp, Human
acacaaggtaatctctcatctaaatgagggagtcagaggctgcaatctcagccatctaagaacttgccatccactagcaagcaggtttgtccctgaaaattcctgagcagtggacttgaaattaaacacagacccagtaaaaaatgaatatcagtaacaaataaaggggaaaacaaggtctattttccagatatagaatctaggaagtgtttaaaactctttactaaatgcacttattttaggtataaggcaaacgggccagttacaatggggagcagagattagccacatttgtctccaragggagtgggctccagggagagggaaggcccgcccatgcctcatgcagttatgacttttcctagtccttcagttgggcatcgatgggatcccacgtgggtctcttccctggaacatacccctgttatcgccatcctgcctcatctgtccccactccttgtccctgccccctgccctgcaaagcaggaagggatgaggtcaaggtgagaatgcatatcacccacgtgtacccaacagccatggctcttgcgactcacctgggcagctgtgtggctgcgcacctgactcactctttctagag

SEQ ID NO: 181024 - DNA, 601 bp, Human
aagggcccccatgcaaaactttttcctattcattaatttctgcctcttgtctctctctccttttttttttttttttttttttttttttgagacagtgtttccctctcgttgcccaggctggagtgcagtggtgcgatcttggctcaccgcaacctctgcctcccaggttcaagtgattcgtctgcctcagctgcccgagtagctgggattacaggcatgcaccaccacacccggctaatttttgtatttttagtagagacggggtttctccatatttgtcaggctggtctcgaactcccamcctcaggtgatctgcctgcctcggcctcccaaagggctggatgacaggcatgagccaccacgcccggcctgccccttgtctcttattgacctcagagaatgacagcaagtttgtactcaatggacaggtgttctgagcagaggcagcatagctcttagaactttaaatgaggcctccagggaagttgattacaatggaatgagccaaacaaggcccgcagagttcacctccacttaataactcactaatgctgtccttcaaaagtccgaagattacagctctgaaccagagcagcacaca

SEQ ID NO: 181025 - DNA, 601 bp, Human
aggccactctgggccccaccagcccacatcttccccttctttcagctctccccggttacctgttggctgggccactctgggaggccacgttttcctcttatctgtatctaagggcccccatgcaaaactttttcctattcattaatttctgcctcttgtctctctctccttttttttttttttttttttttttttttgagacagtgtttccctctcgttgcccaggctggagtgcagtggtgcgatcttggctcaccgcaacctctgcctcccaggttcaagtgattcgtctgcctcagcygcccgagtagctgggattacaggcatgcaccaccacacccggctaatttttgtatttttagtagagacggggtttctccatatttgtcaggctggtctcgaactcccaacctcaggtgatctgcctgcctcggcctcccaaagggctggatgacaggcatgagccaccacgcccggcctgccccttgtctcttattgacctcagagaatgacagcaagtttgtactcaatggacaggtgttctgagcagaggcagcatagctcttagaactttaaatgaggcctccagggaagttgatta

SEQ ID NO: 181026 - DNA, 601 bp, Human
ctcgccccaaacaggccactctgggccccaccagcccacatcttccccttctttcagctctccccggttacctgttggctgggccactctgggaggccacgttttcctcttatctgtatctaagggcccccatgcaaaactttttcctattcattaatttctgcctcttgtctctctctccttttttttttttttttttttttttttttgagacagtgtttccctctcgttgcccaggctggagtgcagtggtgcgatcttggctcaccgcaacctctgcctcccaggttcaagtgattcrtctgcctcagctgcccgagtagctgggattacaggcatgcaccaccacacccggctaatttttgtatttttagtagagacggggtttctccatatttgtcaggctggtctcgaactcccaacctcaggtgatctgcctgcctcggcctcccaaagggctggatgacaggcatgagccaccacgcccggcctgccccttgtctcttattgacctcagagaatgacagcaagtttgtactcaatggacaggtgttctgagcagaggcagcatagctcttagaactttaaatgaggcctccag

SEQ ID NO: 181027 - DNA, 601 bp, Human
aatgagaagaataatagctaacattggagaactcagctgccgccaggctcctgtactcataatctccttgagcgctcaccataatccctcccgctgccagcgagactggcacaggtatgaattaatacaaacattttgcagagaaaaaaactgagtgaagaaatgttcctaaaggagcatagtctctgtgttatcctgcaaatacctcttctacatcctcttctctcatataaggaatgtatcgtcattcactcaccatctgctattaatggaaatttgagtggttcacaacatgggctgktagcagctctgctgcaataaacattctgacacattacatgcatttttgtgcagagggtagaaaggtgtagctaaatccctttaaatgaaatttctgggtcagagtgtggccatacataaatgtgaaaggaactgcctagaagtagcattttattctcagctccatccttcagctggtgcctatcttcttagaatgcccacctccccttcctcagcctacttaaaaattgccttcccgagacctaccctgtcaagactcgccccaaacaggccactctgggccccaccagcccacatcttc

SEQ ID NO: 181028 - DNA, 601 bp, Human
aactcccgtctcaaaaaaaaaaaaaaaccactatgaaaacagtcaagacaagtaccatgaaaaatgggtccttcaaaagaaagaaagagggaaaattgaggtcattgtgagactttgtctgctgttggggagaaatcaatggcagcaaagctctggggcccctgacccactcaagacgtacagactcaaactcgagaaccacacaagccagggcaaacccaccccagggcttctgcatctgctgaaaagccaagcatgcaaacccaagtttgcccaatgggctatgtattctttaaaattaaaaaaaaaaaaaagtggcagacattgggatttagtaaaatatagtaataattttaaaaagttgtgtagaggtttggagttagaatccattaagccaaaatcctgtacttttagttcctccagtcttttccttgaatattgatatacaaaactgtaaactagcaatatcataattataatgagaagaataatagctaacattggagaactcagctgccgccaggctcctgtactcataatctccttgagcgctcaccataatccctcccgctgccagcgagactggcacaggtatgaatta

SEQ ID NO: 181029 - DNA, 601 bp, Human
caaaaatacagatttggctgggcgcagtgggtcactcctgtaatcccagcactttgggtggctaaagcaggtggatcacctgaggtcaggagtttgagaccagcctggccaacatggtgaaaccccatctgtactaaaaatacaaaaaattagccggatatggtggtgcacgcctatagttccagctgcttgggaggccgaggcgggagaattgcttgaacccgggaggcggaagttgcagtgaatggagatcacgtcactacactccagcctgggcgacaagagcgaaactcccgtctcaaaaaaaaaaaaaaaccactatgaaaacagtcaagacaagtaccatgaaaaatgggtccttcaaaagaaagaaagagggaaaattgaggtcattgtgagactttgtctgctgttggggagaaatcaatggcagcaaagctctggggcccctgacccactcaagacgtacagactcaaactcgagaaccacacaagccagggcaaacccaccccagggcttctgcatctgctgaaaagccaagcatgcaaacccaagtttgcccaatgggctatgtattctttaaaattaaaaaaaaaaaaa

SEQ ID NO: 181030 - DNA, 601 bp, Human
tctgtgtgacaaccgcaccagccaggtcatctactaaacacaaagtaacagagagcatcttaaacatgacctgtcatatccaggggactgtatgacaaaggtaagatagttgatttctgctcttggaagcttaccatttattcaagagcagccaccaataaaccacacagccaagaaacccagagaaggtgatctcgaagcctacgctgagtagaacaggcaaagctgtacaggagagttaacggaagagggaggtatctgcaggccctgggcaagaggctaggcctggcagcgacagctytgacccagcaggaagagagtggaaaggcatgaagacaggctggctccggaagacggaggagaagggtcagaccaggagaggtggcgacagtggtgttgggagcagagagcccactggggaggtagacccgggaccccgggtttattacaggaaataaacacaaagagaatcctacttgaggtgcacactgtcccggatggggatttgggctgcgtgcagacgacggggttggaagcctgcgtcaggaccctcggggcgtactggggcacgggggacgggtagtactgagccggatgcacc

SEQ ID NO: 181031 - DNA, 601 bp, Human
tgggaggcagtgcaagaggggcggactggaaagacatgagaccaaacgaaatggcaaagaaaggagatgaatggtagggtgaggaagaggagggactgaagtgacagcaaataaaatttaacctccagtcctcccacgctcgctctggcctgctccggccacccgcaggaccctgaagcccaatgagacagctcagatacttctgtgtgacaaccgcaccagccaggtcatctactaaacacaaagtaacagagagcatcttaaacatgacctgtcatatccaggggactgtatgacaaasgtaagatagttgatttctgctcttggaagcttaccatttattcaagagcagccaccaataaaccacacagccaagaaacccagagaaggtgatctcgaagcctacgctgagtagaacaggcaaagctgtacaggagagttaacggaagagggaggtatctgcaggccctgggcaagaggctaggcctggcagcgacagctttgacccagcaggaagagagtggaaaggcatgaagacaggctggctccggaagacggaggagaagggtcagaccaggagaggtggcgacagtggtgttgg

SEQ ID NO: 181032 - DNA, 601 bp, Human
ccacccacactgtctccagacactgccaattgtctctgggggtccaaattgtcctgactgagaaccactggccttgacctacccaaccacccccagaagaacatcagtgcaaacacaagtatctgctcggtggggagcatcggaagaagggaaagagagaatgagagaagggagagaaaggaattaaggctcatgaaggggtagaaaactcagagacaggaggtggctggagaggaacagggtggaagagccatttgtgaagggtgagggggtgagaggaggggtagaaacgcaggagcgrcagcacttgtcctgagtgggggagaggtggggacagacagggcttcacagagcactggcattaatcacgttgatgactgattatgtgatgtggacacatggaaattcacattctgacgaatctctaactgtacaagttgtagagacaggatgcacatttcacaaaataaaataaaagcactatcaattaaaagatcaatgtaaaagatctttggcgtagccactgctgtgcgggttccacctggacaattcttagcactgaaactagcctgaattaacagctgggaggcagtgcaagagg

SEQ ID NO: 181033 - DNA, 601 bp, Human
ctggcttccttccatccccacggtggacaaagatcaggagttcccaacctccacactaagcgatattttacctggaggattctttgctgtcggggggctgtcttgtgccttgcgggaggttgagcagcatccccggtgcctacctaggagcagcaccccctccccacttgtaaccacccacactgtctccagacactgccaattgtctctgggggtccaaattgtcctgactgagaaccactggccttgacctacccaaccacccccagaagaacatcagtgcaaacacaagtatctgctyggtggggagcatcggaagaagggaaagagagaatgagagaagggagagaaaggaattaaggctcatgaaggggtagaaaactcagagacaggaggtggctggagaggaacagggtggaagagccatttgtgaagggtgagggggtgagaggaggggtagaaacgcaggagcggcagcacttgtcctgagtgggggagaggtggggacagacagggcttcacagagcactggcattaatcacgttgatgactgattatgtgatgtggacacatggaaattcacattctgacgaatctctaa

SEQ ID NO: 181034 - DNA, 601 bp, Human
ttaaaaatagtaccagggtaagttcaattaaattactaaattatttctgagtttataaattttataatgcaaaaatcatacatgtaggttcatattcttcccttataaaagcaactgataagggactgatatatccctgtccaactctgtcatcatctagtctttcccaggaaacgtggaaatgtgtccatcatgtgggccaggggttcgtctgccttcctgggtttagccgtcactggtgggaacaccaccgtctggagatgctgacttcaggagagggccttcactgccatttcttagsggggtagctcacacagacagttccttatccccttcaccctggcttccttccatccccacggtggacaaagatcaggagttcccaacctccacactaagcgatattttacctggaggattctttgctgtcggggggctgtcttgtgccttgcgggaggttgagcagcatccccggtgcctacctaggagcagcaccccctccccacttgtaaccacccacactgtctccagacactgccaattgtctctgggggtccaaattgtcctgactgagaaccactggccttgacctacccaacca

SEQ ID NO: 181035 - DNA, 601 bp, Human
gtttcaaagccaaacattacactttcaaaatgtatacatttctatatattagatgccaacagtgttttcttaaaaatagtaccagggtaagttcaattaaattactaaattatttctgagtttataaattttataatgcaaaaatcatacatgtaggttcatattcttcccttataaaagcaactgataagggactgatatatccctgtccaactctgtcatcatctagtctttcccaggaaacgtggaaatgtgtccatcatgtgggccaggggttcgtctgccttcctgggtttagccrtcactggtgggaacaccaccgtctggagatgctgacttcaggagagggccttcactgccatttcttaggggggtagctcacacagacagttccttatccccttcaccctggcttccttccatccccacggtggacaaagatcaggagttcccaacctccacactaagcgatattttacctggaggattctttgctgtcggggggctgtcttgtgccttgcgggaggttgagcagcatccccggtgcctacctaggagcagcaccccctccccacttgtaaccacccacactgtctccaga

SEQ ID NO: 181036 - DNA, 601 bp, Human
tactcctgatgggtgcttctgaattggtgctactcaataactgggagaagagtttcaaagccaaacattacactttcaaaatgtatacatttctatatattagatgccaacagtgttttcttaaaaatagtaccagggtaagttcaattaaattactaaattatttctgagtttataaattttataatgcaaaaatcatacatgtaggttcatattcttcccttataaaagcaactgataagggactgatatatccctgtccaactctgtcatcatctagtctttcccaggaaacgtggaratgtgtccatcatgtgggccaggggttcgtctgccttcctgggtttagccgtcactggtgggaacaccaccgtctggagatgctgacttcaggagagggccttcactgccatttcttaggggggtagctcacacagacagttccttatccccttcaccctggcttccttccatccccacggtggacaaagatcaggagttcccaacctccacactaagcgatattttacctggaggattctttgctgtcggggggctgtcttgtgccttgcgggaggttgagcagcatccccggtgccta

SEQ ID NO: 181037 - DNA, 601 bp, Human
atctcagcactttgggaggccaaggcaggaggatcacctgatgtcaggagttcgagaccagcctggccagcatggcaaaaccccgtctctactaaaaatacaaaaattagccagaagcagtagtgcacctgtagtcctagctactcaggaggctgaggcaggagaatcgcttgaacctgagaggcagaggttgcagtgagctgagatcgtgccactgcactccagcctgggtgacagagcgagactttgtctcaaaaaacaaacaaacaaacaaacaacaaaaaaaaacccacgcacacamaacccactatccatttccctcaatcatgaccaacttaaggttgtcaactcagcctcatggtttctcacgtttagctgcttgtttcacacgcacatttggaggactatggaccttcgattctccaaagcctaaggtttaagctgtgtgttcgctcctactcaatcatcaaccttctacggctgttgctaaagcaaataaatacattaagtctagaaaaattccttatactcctgatgggtgcttctgaattggtgctactcaataactgggagaagagtttcaaagccaaacattacactt

SEQ ID NO: 181038 - DNA, 601 bp, Human
acccatgcactttgggagtggatctcagcactttgggaggccaaggcaggaggatcacctgatgtcaggagttcgagaccagcctggccagcatggcaaaaccccgtctctactaaaaatacaaaaattagccagaagcagtagtgcacctgtagtcctagctactcaggaggctgaggcaggagaatcgcttgaacctgagaggcagaggttgcagtgagctgagatcgtgccactgcactccagcctgggtgacagagcgagactttgtctcaaaaaacaaacaaacaaacaaacaacaaaaaaaaacccacgcacacacaacccactatccatttccctcaatcatgaccaacttaaggttgtcaactcagcctcatggtttctcacgtttagctgcttgtttcacacgcacatttggaggactatggaccttcgattctccaaagcctaaggtttaagctgtgtgttcgctcctactcaatcatcaaccttctacggctgttgctaaagcaaataaatacattaagtctagaaaaattccttatactcctgatgggtgcttctgaattggtgctactcaataactgggagaagagtt

SEQ ID NO: 181039 - DNA, 601 bp, Human
ggtcttggcttgtcacggctgctgttgcacagtttaattacaactcactggcccggcacagtggctcataccacccatgcactttgggagtggatctcagcactttgggaggccaaggcaggaggatcacctgatgtcaggagttcgagaccagcctggccagcatggcaaaaccccgtctctactaaaaatacaaaaattagccagaagcagtagtgcacctgtagtcctagctactcaggaggctgaggcaggagaatcgcttgaacctgagaggcagaggttgcagtgagctgagatygtgccactgcactccagcctgggtgacagagcgagactttgtctcaaaaaacaaacaaacaaacaaacaacaaaaaaaaacccacgcacacacaacccactatccatttccctcaatcatgaccaacttaaggttgtcaactcagcctcatggtttctcacgtttagctgcttgtttcacacgcacatttggaggactatggaccttcgattctccaaagcctaaggtttaagctgtgtgttcgctcctactcaatcatcaaccttctacggctgttgctaaagcaaataaatacattaa

SEQ ID NO: 181040 - DNA, 601 bp, Human
tgatggaggcaagctggggccaaggtagttcatgagagaaattccagatgccctctctggcccattaccaaggacactttcctccgtctatggcttcccgagtgccattttatccaagataaaataactggtctgctgagatgagggctattcagttaggtatcctgaacctcacactgagcatgtgccaatctgtacagttctcaccaggagagtgtgtaaagcgggaagccctcaagtttactttgctggacaggcatctgtagtcagcgcgtggtcagtacagacaccactgggtctyggcttgtcacggctgctgttgcacagtttaattacaactcactggcccggcacagtggctcataccacccatgcactttgggagtggatctcagcactttgggaggccaaggcaggaggatcacctgatgtcaggagttcgagaccagcctggccagcatggcaaaaccccgtctctactaaaaatacaaaaattagccagaagcagtagtgcacctgtagtcctagctactcaggaggctgaggcaggagaatcgcttgaacctgagaggcagaggttgcagtgagctgagatcgtgcc

SEQ ID NO: 181041 - DNA, 601 bp, Human
tgagggccatgcccaggcacacgatgttctcataactcggctgcaatgattatatatgatggaggcaagctggggccaaggtagttcatgagagaaattccagatgccctctctggcccattaccaaggacactttcctccgtctatggcttcccgagtgccattttatccaagataaaataactggtctgctgagatgagggctattcagttaggtatcctgaacctcacactgagcatgtgccaatctgtacagttctcaccaggagagtgtgtaaagcgggaagccctcaagtttacwttgctggacaggcatctgtagtcagcgcgtggtcagtacagacaccactgggtcttggcttgtcacggctgctgttgcacagtttaattacaactcactggcccggcacagtggctcataccacccatgcactttgggagtggatctcagcactttgggaggccaaggcaggaggatcacctgatgtcaggagttcgagaccagcctggccagcatggcaaaaccccgtctctactaaaaatacaaaaattagccagaagcagtagtgcacctgtagtcctagctactcaggaggctgag

SEQ ID NO: 181042 - DNA, 601 bp, Human
tgaggcaggagaatcacttgaacccaggaggcagaggttgcagtgagccgagatcacaccactgcactccagcctgggcgacagagcaaaaactctgtcaaaaaaaaaaaaaaagatagtatgctaaaagagggtcttaaaataggcagatgattaatgtaaaaaaaaaaaaagaactaagacctcatcttggtaattacaagcataagcaaaataataatactgtcctaaaaactatcatcactctgttagtggtactcaaagcagaataaattgtcttacccaaggctatttagcgaayggatgctactgtcccattcggacatccaccaaagctacatgtggctatttaattaatgtcccatggaattaagtaaaatgatgtaaattcaagtgctcagtcatcatatgtggctggtggctaccatgtcagacagtgcagctgtagaaccttcccatggtgtccctaagtcctgctggacagcgccagtgcaggccttttggtccaagtgcagaaataccaaactcagaggaaaggcacatttcagaaaaaaaacgaatttggaaaaggtcactgatttttctctagtgagacatagca

SEQ ID NO: 181043 - DNA, 601 bp, Human
ggatccacaatggcacatgggtctgcaccaccccaggctgatgggaaggctcaggctgcagttgcaggaggtgggacatggaggggtgggcctggtccccaacagccactgctgtgcagtgagatacaggtaactgggtgtggccccaaggtagaagaacctgtgctcacagtgctgggtggcaccaagcaccccaaagcactgggtacattctaaatgctttccccatgatgtgtcaatctcatagctaaacaagagaagggaagagagacagcctcgttatgtaagagaggaacctcayggagggcctccagaggtctcaatagcccagagagcagggtctggctcagagcactggggactgcaggagcacatggtgggatcgaggctccctgcacttactgaacttccagagtaggccagcggccagcgcagctcccacgaggaaggtccccagggtcaaggtgatgcacagtgctttcttagtctctggaagaaggaggagagtgcaacgttcagaccagagttgtttagaagtcatgctctcaaatgttatctattatttttatagtacaccacattaagaaataattatttcata

SEQ ID NO: 181044 - DNA, 601 bp, Human
aataaggaggagaagtgtccttgccaccagcaagtataagtggaattagcactggggcaccttacttccgtgggggcaatgggaaggaccctctcagtgtttgggtttggacggcactcacacgtcctctctgccacacaggtaacttgaaggatccacaatggcacatgggtctgcaccaccccaggctgatgggaaggctcaggctgcagttgcaggaggtgggacatggaggggtgggcctggtccccaacagccactgctgtgcagtgagatacaggtaactgggtgtggccccaasgtagaagaacctgtgctcacagtgctgggtggcaccaagcaccccaaagcactgggtacattctaaatgctttccccatgatgtgtcaatctcatagctaaacaagagaagggaagagagacagcctcgttatgtaagagaggaacctcacggagggcctccagaggtctcaatagcccagagagcagggtctggctcagagcactggggactgcaggagcacatggtgggatcgaggctccctgcacttactgaacttccagagtaggccagcggccagcgcagctcccacgaggaagg

SEQ ID NO: 181045 - DNA, 601 bp, Human
tcccttcccaaggttaaggctgactcaccacaccgattctcgtcctccccgccggggcagtgtgacacgccatcacaccagttagaggggttgatgcaggtacctgaggagtcgcactctatcccagagttggagcacttgctgcccacttgcagagaaaacagaagagaggtgcccttcaggctgagaaacccaatgagcctcatggagtgaggaacaccgtggcattactgtagctcgctgcagcctccaactcctggccccactgtgttttgttttgttttgtttttgagatgaagtytcattctgtcacccaggctggagtgcaggggcacaatcttggctcactgcaacctccaactcctgggttcaagtgatcctcctgccccagcctcctaagtagctgggattacaggtgcacgccaccacgcctgactaatttttgtatttttagtagagatggagtttcaacatgttggccaggcttgtggtctcaaactcctgacctcaggtggtccacctgccttggcctcttaaagtgctgggataacaggcgtgagccacctcacccagccaatcccccactttaataaggaggaga

SEQ ID NO: 181046 - DNA, 601 bp, Human
tggagcagggattcaatgacatcatgtgtcagcgtactggacgcacgccaggcccagtcacccaaaggcccctggacccggctgctgtctccaaggtgagcagaggagtcccttcccaaggttaaggctgactcaccacaccgattctcgtcctccccgccggggcagtgtgacacgccatcacaccagttagaggggttgatgcaggtacctgaggagtcgcactctatcccagagttggagcacttgctgcccacttgcagagaaaacagaagagaggtgcccttcaggctgagaaacscaatgagcctcatggagtgaggaacaccgtggcattactgtagctcgctgcagcctccaactcctggccccactgtgttttgttttgttttgtttttgagatgaagtctcattctgtcacccaggctggagtgcaggggcacaatcttggctcactgcaacctccaactcctgggttcaagtgatcctcctgccccagcctcctaagtagctgggattacaggtgcacgccaccacgcctgactaatttttgtatttttagtagagatggagtttcaacatgttggccaggcttgtggtc

SEQ ID NO: 181047 - DNA, 601 bp, Human
accgttcctagcctgcatctccaactttataaacagtttgctcatcttaactgacttcctgtggcagttcagagcacgtgtggttccaatgacacagtcctcggtggccctgtcatctcccacctgctgggtgaggttgggccggaaacacaacctctctgagccccagggctcagcctggagcagggattcaatgacatcatgtgtcagcgtactggacgcacgccaggcccagtcacccaaaggcccctggacccggctgctgtctccaaggtgagcagaggagtcccttcccaaggtyaaggctgactcaccacaccgattctcgtcctccccgccggggcagtgtgacacgccatcacaccagttagaggggttgatgcaggtacctgaggagtcgcactctatcccagagttggagcacttgctgcccacttgcagagaaaacagaagagaggtgcccttcaggctgagaaacccaatgagcctcatggagtgaggaacaccgtggcattactgtagctcgctgcagcctccaactcctggccccactgtgttttgttttgttttgtttttgagatgaagtctcattctgtcaccc

SEQ ID NO: 181048 - DNA, 601 bp, Human
ggagcaatgcttcctagttcattaaaataaataaatagataaaccacagaaaataaaatgaaacagatgagcccaccctgtgacaacagatagacctttaaaggcagcttgttttgaaaataacatagtgcatctccaattttgtttttaattaattaatttattttttgagccagctctgtctcccaggctggaatgcagtggcgtgatctcagctcactgcaacctccgcctcccaggttcaagtgattctcctgcctcagcctcctgaatagctggaattacaggcacccgccaccgygcttggctaatttttgtatttttagtggagataaggtttcaccatattggtcaggctggtctcaaactcctgacctcaggtgatccatctgcctcggcctcccaaagtgctgggattacaggcatgagccaccgttcctagcctgcatctccaactttataaacagtttgctcatcttaactgacttcctgtggcagttcagagcacgtgtggttccaatgacacagtcctcggtggccctgtcatctcccacctgctgggtgaggttgggccggaaacacaacctctctgagccccagg

SEQ ID NO: 181049 - DNA, 601 bp, Human
gagcaatctattgtacatcatagtgactgcagttaataaactatatgttgcatatttgaaaatcactacaagagtaggttttatgtgttcttaataagacacgtatatgaggtaaggcccatgttctagcttgacttagccatgccacaggcatacacgtatccaaacatcatgtggtatgccataaataggagcaatgcttcctagttcattaaaataaataaatagataaaccacagaaaataaaatgaaacagatgagcccaccctgtgacaacagatagacctttaaaggcagcttkttttgaaaataacatagtgcatctccaattttgtttttaattaattaatttattttttgagccagctctgtctcccaggctggaatgcagtggcgtgatctcagctcactgcaacctccgcctcccaggttcaagtgattctcctgcctcagcctcctgaatagctggaattacaggcacccgccaccgtgcttggctaatttttgtatttttagtggagataaggtttcaccatattggtcaggctggtctcaaactcctgacctcaggtgatccatctgcctcggcctcccaaagtgc

SEQ ID NO: 181050 - DNA, 601 bp, Human
aaggaaatccgtgtgttgaagagggacctgcacgcccacgctcactgcggcatttttcacaacagccaagacatgacatcaacctaacagtccatcagtgaatgaagggataaagaaaatgtggtgtatatgcacaaggcaatactattcagccacaagaaagaaggaaatcctgtcatttccaacaacatagatgaagctggaggacattacgctaagtgaacaagccagacacagagacacaaacactgcatgaggccacttacatgtggaatgtataaacatcaaactcacagaagcggagtagaaaggcagctatcagaggctgggggcggggggtgacaacactggggagatgttggtcagaggtcacaaaatcttagttagacaggaggaataagttcgagcaatctattgtacatcatagtgactgcagttaataaactatatgttgcatatttgaaaatcactacaagagtaggttttatgtgttcttaataagacacgtatatgaggtaaggcccatgttctagcttgacttagccatgccacaggcatacacgtatccaaacatcatgtggtatgccataaataggagcaa

SEQ ID NO: 181051 - DNA, 601 bp, Human
cagctcttaaagagaaacgagccagctccctgccatctgcagagccccattccgtacgcagctggcaggagggggatgattagcacaaccctcatactcaggatcgtttccctgttcgagtcactaactacccttgaaatcaccctcaaaaattcatgaaaaatacaaataaaaatgcaaatgaaaaccacaatgaggtatcatctcatacctcttcaaatggctactatcagaaagatggaaaataacaggagttggtgaggttgtagaagagaaatggagactttgcaccgtgggggtrggagtggaagttgctacagccattatggaaaacagtatggagtttcctcaaaaggtgagaaacagaactgccatgtgatccagcaatctcactgctgggtttatatccaaaggaaaggaaatccgtgtgttgaagagggacctgcacgcccacgctcactgcggcatttttcacaacagccaagacatgacatcaacctaacagtccatcagtgaatgaagggataaagaaaatgtggtgtatatgcacaaggcaatactattcagccacaagaaagaaggaaatcctgtcatttccaac

SEQ ID NO: 181052 - DNA, 601 bp, Human
aaaatacaaaaattagccaggtgtggtggtgagcacctgtagtcccagccacttggggggctgaggctgggggatcgcttaaccccaggacatcgaagttgcagtgagccatggtcatgcctctgcactccagcctgggcaacagagtgaaaccctgtctccaggaaaaaaaaaaaaaaaatagaaagaaaagaaaaagccattccacgtgctatcttaacctcacgctactcaatctcaaaaactcccactttattttagaaaccaaataaagcaaaagaactatgtttaatcagcaaaygcatcattttcaagtgcaaacctttttctgggaagcaagactgtgctggaggaaaggtatcaagaacacggaacacttgggcctgctcaaggccggcacgagggccgagctccacgggccagtgctcctcaccaggaaattccacagccaggactgacagcgagggcttaacaggaaaccagtccccaccaaggatggcccttaggagaggggggattactttggcatggaaaaatctttggctagaattctcggccagctctgaggcttgtggtttctacagaaaactccaggaggtta

SEQ ID NO: 181053 - DNA, 601 bp, Human
aaaagccattccaggccaggcgcggtagttcacgcctgtaatcccagcagtctgggaggctgaggcgggagaattgcttgaggtcaggagttcgagaccagtctggacaacattgatgaaacccattttctacaaaaaatacaaaaattagccaggtgtggtggtgagcacctgtagtcccagccacttggggggctgaggctgggggatcgcttaaccccaggacatcgaagttgcagtgagccatggtcatgcctctgcactccagcctgggcaacagagtgaaaccctgtctccaggaaaaaaaaaaaaaaaatagaaagaaaagaaaaagccattccacgtgctatcttaacctcacgctactcaatctcaaaaactcccactttattttagaaaccaaataaagcaaaagaactatgtttaatcagcaaatgcatcattttcaagtgcaaacctttttctgggaagcaagactgtgctggaggaaaggtatcaagaacacggaacacttgggcctgctcaaggccggcacgagggccgagctccacgggccagtgctcctcaccaggaaattccacagccaggactgacagcgagg

SEQ ID NO: 181054 - DNA, 601 bp, Human
tgtgtgtgtgtgtgtgtgtgtgtctggggtgtatggggggatgcggggtaggtaagtaagcagagcaaggaagaagagatttttcacagcatacccttttgtacttccttgattttgacctaataatactttaatagtgtacaactattaaagtatttaaataaatacgacttaaatattaagaagagagcaactcttcaggtaacataaggactttgttggtgtttattcacccacatgtgcacataggagaacatcaaaagccattccaggccaggcgcggtagttcacgcctgtaatsccagcagtctgggaggctgaggcgggagaattgcttgaggtcaggagttcgagaccagtctggacaacattgatgaaacccattttctacaaaaaatacaaaaattagccaggtgtggtggtgagcacctgtagtcccagccacttggggggctgaggctgggggatcgcttaaccccaggacatcgaagttgcagtgagccatggtcatgcctctgcactccagcctgggcaacagagtgaaaccctgtctccaggaaaaaaaaaaaaaaaatagaaagaaaagaaaaagccattccac

SEQ ID NO: 181055 - DNA, 601 bp, Human
agagtgaacaatttagtttcttttctgagattctgagaaagactcacagaaaggatagcaacggaagtagaaagtgaattagtgttaaaatatgcgcacacacacccttgggaagaaagcgctacacacatttttgaatgttttccatgggacgggtcatattcttcagcatcctaaggtgttcatttcagcaaaaacaatttctactctacgaaatggacaaattaaaagtgcaccctatgcctgttctggtctaagagagaatacatgcacagcgttatgtttgtctgtttccttttayatgaataatcaatatggaaactggataaaaccaaactgaagccggtctaggtctgtcaggttacagatccacacgccctctgacctagcagttctactcctggaagcgtttcctactgatatgctcacacacttggagcagtgtgtgttacagcaaaaggatggagaaaaccttaaggtccaccaagaagagacaggggcaataatggtgcatccatgcaaaggaccaactgtgccatggtgggaaaaaacagggggctcatttccctaaggaatgctgtccaggatggtatccagtgca

SEQ ID NO: 181056 - DNA, 601 bp, Human
tggtgagaatacttaaaatctgcccttttagcaaattccaggtatagagtacagcattgataactagagtgaacaatttagtttcttttctgagattctgagaaagactcacagaaaggatagcaacggaagtagaaagtgaattagtgttaaaatatgcgcacacacacccttgggaagaaagcgctacacacatttttgaatgttttccatgggacgggtcatattcttcagcatcctaaggtgttcatttcagcaaaaacaatttctactctacgaaatggacaaattaaaagtgcaycctatgcctgttctggtctaagagagaatacatgcacagcgttatgtttgtctgtttccttttatatgaataatcaatatggaaactggataaaaccaaactgaagccggtctaggtctgtcaggttacagatccacacgccctctgacctagcagttctactcctggaagcgtttcctactgatatgctcacacacttggagcagtgtgtgttacagcaaaaggatggagaaaaccttaaggtccaccaagaagagacaggggcaataatggtgcatccatgcaaaggaccaactgtgc

SEQ ID NO: 181057 - DNA, 601 bp, Human
agttgacaaataaaaattttacatgtaggcctggtgctgtggttcatgcctgtaatctcagcactttggaagggcaaggcgggaggatcacttgagcccagagttcgagaccaaccccatctccaccaaaaaatataaatatatatgcattagcctggcatgatggtacatgcctgtggccccagcttttcaggaggctgagggggaaggatggattgagcccaggaggtcgaggctgcaatgagccatgactgagccactgcactccagactgggtgacagaaggagaccttgtctcaamaaaacccaattgtacatgtttaatgtgtacagcgtgatgactggatatccgctgtgaaatgctcaccgtaataaagctagttaacatgtccaccacgtcacataattaccattttcttttctcttttctgtggtgagaatacttaaaatctgcccttttagcaaattccaggtatagagtacagcattgataactagagtgaacaatttagtttcttttctgagattctgagaaagactcacagaaaggatagcaacggaagtagaaagtgaattagtgttaaaatatgcgcacacacac

SEQ ID NO: 181058 - DNA, 601 bp, Human
gcttgaacccaggaggtaaaggttgcagtgagctgagatcacaccactccactccagcctgggtgacagagcaaaactccgtctcaataaataaataaataaataataagataaaaggtttttttttttaaagtgctctttaagagagcactttgagcaacaaattgtccaggagactctaaatcaacattctgctgaaatgatctcagctcttttatttaaagaaacaaaacattacaaacaccgttgaagtcgctccctattcccaatctcttctctccctccctagaggtaaccaccrtccagagttttggggactttttgctgggcaggataatacatggggtgggcgtattcacagaacagaatcccatgcagcttaagggttaagcagagcatcatgaacaggaagaagcttgaaaacagcgctgtgggaaagagagcaagtgataaatgatgcgttcaagtatcacgttattcatgcaaagctgaaagcatggaaacaatgctgtgtggtttgggagaaatacacatgggcttaaagtataaagtgaggacctggctatgctctagcctctcttcttacttcctacgagtggcc

SEQ ID NO: 181059 - DNA, 601 bp, Human
catgagccgactcacatggaatgccacttatattgtgtgagcccacgtattgcatgatcccgctcacatggaatgcctagagtaggaaatctatagacactaagtagattagtggttgcttatgagtaggagggacgggctgggaggagggatatggggtgatagttcaagggcttggggtttctttatgagctgatgaaaatatgctaaaattgactgtggtgatagttgcacatattcgtgaatatataaaagccagtgaattatatatttaaattttatggtacatacattacatatyaataagctgttttatataaaaaattatatctcaataagctatttcatatatatgttttatatataaaagcactgaattatatacttgaattttatggtacataaattagatctcaataagctgtttttaaaaatatataagataagccaggcatggtagctcacgcctgtaataccagcactttgggaggccaaggcgggcagatcacctgaggtcaggcgtttgagatcagcctggccaacatggagaaaccgatctctactaaaatgcaaaaattagccaagtgtggtggcacgcatc

SEQ ID NO: 181060 - DNA, 601 bp, Human
agcccaaccctcctcgccagctgttctggtccaacctctacccagggaggtgaatggaccctggctgagaggcaccttggaaaaagaggcacctaacgccctcagcctacccctctgaccagatgaccacagcactgggcactcccgagcaaccaggagtctatagaggccaaggaggaggcagggcaaggtggcagtgagccaaggtctgtgtgctgggcacagccctagcaggacaaattccacctgctggttatagggctcagcttttggaaggtgacaattgtccccagcactcatrtgccggtgctttcacagggaggcagagagagggtcttctcgtgtttctgctgtctgttactgtcactcggcgggtgctgccccatactcacttatagcccatgtccctgcaggccgcccgcccgtagttctcgttccagtcgtcttggcacacagggtgccaggacttcctctgagatgagtacacctgaaggatgaagtttggtccgtagaggcgaactgcacgagagggaggattatccatgagtttctttctttttttttcttttttttgagacggagtctcgctctgtcacctagg

SEQ ID NO: 181061 - DNA, 601 bp, Human
ggaatgagccggtcaccctggctgggacactgagacattatcttggattcctagaaccacgccctgacaaaataggtacacctctaaatgtctgaagaggaaagaaaactaaatagagttgaatgtcgatgttgcaagtgtgagccgctaccaacaagggcagacggtagaggctgaaaatgaaatagcagagaaacctcagccacttcctatgaataaaccaagggctgcttagagtaaccaggcctggtcagactctaatctcctcccaatgcaaaacccatccagaccgagtattgcrgctcagagaaatcagactcaggacaacgattccccatggtgtctcctagttgatttcattccaaaatttttcaagaagaaattgctgcatacctgtggtacagttttttatagatatcgacattgccggcacttgtgttcagtttcataaagctggtggatccgctgtcatccactattccttggctagagtaaaaattattcctaaaaaagaaaaccttatttgtgataatggttaaggcataagcaaacacaaatcctatactatgtcataataccgctcatacgacattcagaataa

SEQ ID NO: 181062 - DNA, 601 bp, Human
gctcaagccagtgaagtccctggcaaactggaatgagccggtcaccctggctgggacactgagacattatcttggattcctagaaccacgccctgacaaaataggtacacctctaaatgtctgaagaggaaagaaaactaaatagagttgaatgtcgatgttgcaagtgtgagccgctaccaacaagggcagacggtagaggctgaaaatgaaatagcagagaaacctcagccacttcctatgaataaaccaagggctgcttagagtaaccaggcctggtcagactctaatctcctcccartgcaaaacccatccagaccgagtattgcagctcagagaaatcagactcaggacaacgattccccatggtgtctcctagttgatttcattccaaaatttttcaagaagaaattgctgcatacctgtggtacagttttttatagatatcgacattgccggcacttgtgttcagtttcataaagctggtggatccgctgtcatccactattccttggctagagtaaaaattattcctaaaaaagaaaaccttatttgtgataatggttaaggcataagcaaacacaaatcctatactatgtca

SEQ ID NO: 181063 - DNA, 601 bp, Human
tgtcccggggttggggctaacgggaccagccagcccagctgcctggaatggagcaggacttcccttgctcaagccagtgaagtccctggcaaactggaatgagccggtcaccctggctgggacactgagacattatcttggattcctagaaccacgccctgacaaaataggtacacctctaaatgtctgaagaggaaagaaaactaaatagagttgaatgtcgatgttgcaagtgtgagccgctaccaacaagggcagacggtagaggctgaaaatgaaatagcagagaaacctcagccayttcctatgaataaaccaagggctgcttagagtaaccaggcctggtcagactctaatctcctcccaatgcaaaacccatccagaccgagtattgcagctcagagaaatcagactcaggacaacgattccccatggtgtctcctagttgatttcattccaaaatttttcaagaagaaattgctgcatacctgtggtacagttttttatagatatcgacattgccggcacttgtgttcagtttcataaagctggtggatccgctgtcatccactattccttggctagagtaaaaattattcct

SEQ ID NO: 181064 - DNA, 601 bp, Human
gctggacttggctccctgattccgtgtgtaacccagaaagacaaagaaccactcagcatttacaaagtgcccaggcagctgtgtttagcttctccacagggacaaaccgcagccctgctgttttgatgggtgcacctggccgtgcacagccctccccactgggcttgccctgccacattccccaggacagcaggctgcagtggaagtcaggcccccagacccctccaccagcggcctccaggaatgcaaacctgccccaggctcccactcagaggaaaggtggcgcggggtgattagttcrtcctcccccgaaatgcagcacctggcacctggcaggcagggaggtgatgcctagacaccaggcataagccctggggacctgggaggcaaggagagctcatgggcaaaggacactgtgtatctttcacatcagaaaacacataacagcaacaatcatagcaagtctgcaaacatcctaaatatgtgcaaagcaaaaggaagagcctaagtccatcccctcttctgccctcccagccaggtcagccactcatcatgtgacctgtggcttgtacccacttctaccccctggaaacaccacaac

SEQ ID NO: 181065 - DNA, 601 bp, Human
gctgcacagaaagaggaaaagaagtgcgcctccccccaccaccaccaccgagatagaatagagcctaccagacaatggccttctcttctttcttccaagccctccagcctccttgtgagttcccaaggctcttgccaagggacggcagcacctcctcccctccccccgtccctgcccggctggacttggctccctgattccgtgtgtaacccagaaagacaaagaaccactcagcatttacaaagtgcccaggcagctgtgtttagcttctccacagggacaaaccgcagccctgctgttytgatgggtgcacctggccgtgcacagccctccccactgggcttgccctgccacattccccaggacagcaggctgcagtggaagtcaggcccccagacccctccaccagcggcctccaggaatgcaaacctgccccaggctcccactcagaggaaaggtggcgcggggtgattagttcatcctcccccgaaatgcagcacctggcacctggcaggcagggaggtgatgcctagacaccaggcataagccctggggacctgggaggcaaggagagctcatgggcaaaggacactgtgtatct

SEQ ID NO: 181066 - DNA, 601 bp, Human
tacaataatgctagttttgtttttcctcttggaatttaaaatcatcttctaatttttaaggaagccatttggaaacctctgggctcctataactgctttaaatttgtagtgttgaaagcaatataaccaatagtttccctaggattagaagaaacgtaagagttactcatttgggagtcaaacatcccaggttatggatgaagaggaagtaactgatgcattttgtcctgcagtgaatttcccaggctatgctgagaaggaaagacgcggcccctggcatgcagagctggcccgccccgayagctgggccgtgtgctctgcggaacctgaattatttcactgagcgtcaatatcggactaggcccctccatgcctgagatggggcaagacacaaggagcctcctctgaaatgatgtctgaatagacagaacaggaaccttgtgctcacaaccacaaaatcacgatctgatgtctcctcctgtcctggctaacttgagcgacggacgtttctttaccaatcacagctttagcctagcctcattccaacctcctcctagaaaaaaaataataaagcagcctcacagaattacccctgcttcct

SEQ ID NO: 181067 - DNA, 601 bp, Human
gcatacaataatgctagttttgtttttcctcttggaatttaaaatcatcttctaatttttaaggaagccatttggaaacctctgggctcctataactgctttaaatttgtagtgttgaaagcaatataaccaatagtttccctaggattagaagaaacgtaagagttactcatttgggagtcaaacatcccaggttatggatgaagaggaagtaactgatgcattttgtcctgcagtgaatttcccaggctatgctgagaaggaaagacgcggcccctggcatgcagagctggcccgcccygacagctgggccgtgtgctctgcggaacctgaattatttcactgagcgtcaatatcggactaggcccctccatgcctgagatggggcaagacacaaggagcctcctctgaaatgatgtctgaatagacagaacaggaaccttgtgctcacaaccacaaaatcacgatctgatgtctcctcctgtcctggctaacttgagcgacggacgtttctttaccaatcacagctttagcctagcctcattccaacctcctcctagaaaaaaaataataaagcagcctcacagaattacccctgctt

SEQ ID NO: 181068 - DNA, 601 bp, Human
aaaattgtaccagctcctaggacggttgtgagggtaagcatacaataatgctagttttgtttttcctcttggaatttaaaatcatcttctaatttttaaggaagccatttggaaacctctgggctcctataactgctttaaatttgtagtgttgaaagcaatataaccaatagtttccctaggattagaagaaacgtaagagttactcatttgggagtcaaacatcccaggttatggatgaagaggaagtaactgatgcattttgtcctgcagtgaatttcccaggctatgctgagaaggraagacgcggcccctggcatgcagagctggcccgccccgacagctgggccgtgtgctctgcggaacctgaattatttcactgagcgtcaatatcggactaggcccctccatgcctgagatggggcaagacacaaggagcctcctctgaaatgatgtctgaatagacagaacaggaaccttgtgctcacaaccacaaaatcacgatctgatgtctcctcctgtcctggctaacttgagcgacggacgtttctttaccaatcacagctttagcctagcctcattccaacctcctcctagaaaa

SEQ ID NO: 181069 - DNA, 601 bp, Human
gaagaacaggcatcactgcaaaaagaacgggaaattctggtcacgatagtgcggagtcacctgcctctcacatgcttagaaatcagtcatttcttccgatgttccctctcctgtcttctgagacatagaagggtctgctagttacaactccaataaggtaagtaaatccatatagggacagtggcaaagaccagacactgagccaaggtacgcggctcacatccccacagtgtgaccttgggcaagttacttaacctctcttaaaattgtaccagctcctaggacggttgtgagggtaagyatacaataatgctagttttgtttttcctcttggaatttaaaatcatcttctaatttttaaggaagccatttggaaacctctgggctcctataactgctttaaatttgtagtgttgaaagcaatataaccaatagtttccctaggattagaagaaacgtaagagttactcatttgggagtcaaacatcccaggttatggatgaagaggaagtaactgatgcattttgtcctgcagtgaatttcccaggctatgctgagaaggaaagacgcggcccctggcatgcagagctggcccgccccg

SEQ ID NO: 181070 - DNA, 601 bp, Human
ttccaacccgtgaccccaccttcttccctcccacgcccccagagacacagggagtactgttctgaaagtagagagcttttcctagttagaagtatcaaaagggggactccagatgaacttacctatacagcgtaaagaaaccactgcttttgaagaacaggcatcactgcaaaaagaacgggaaattctggtcacgatagtgcggagtcacctgcctctcacatgcttagaaatcagtcatttcttccgatgttccctctcctgtcttctgagacatagaagggtctgctagttacaactycaataaggtaagtaaatccatatagggacagtggcaaagaccagacactgagccaaggtacgcggctcacatccccacagtgtgaccttgggcaagttacttaacctctcttaaaattgtaccagctcctaggacggttgtgagggtaagcatacaataatgctagttttgtttttcctcttggaatttaaaatcatcttctaatttttaaggaagccatttggaaacctctgggctcctataactgctttaaatttgtagtgttgaaagcaatataaccaatagtttccctaggattag

SEQ ID NO: 181071 - DNA, 601 bp, Human
caggaccacggccccacgacagcactgggccatcccagaggagagggacggtggcttccacatttgcaaacagtttggaaactgtaagcactctaaacacagagatggggacacccaagtctaagccaccgtccaaaattcaggagagaagaggcaagagcactgttgttctctggtcttgtccctcctcccgggtcccactggctgatgagcacctggtggccacaccgtggtgctggaccacagccccgcagatgctccaagtccacgttaggtggctgccagggctcactaacgccayccccctttgctttctggagaaagagacctgccgggcctccagctcatgggtggcataaagtgtagggctttgtcagcttcttgagcgtgcctgatctcagggggtgtcccttggacccaaggctgaaggtgtctacaggccatggaaatctaaaccaggagctccttggaaagagcgagacgccgctgggcacattccaacccgtgaccccaccttcttccctcccacgcccccagagacacagggagtactgttctgaaagtagagagcttttcctagttagaagtatcaaaaggggga

SEQ ID NO: 181072 - DNA, 601 bp, Human
tgccagggccaggcccccgggagcgcgctctcgccgcccacaatcctgctctggcggcttgagttcaagttgaccccgcaggctgaggatgacaaacaggaggccagtggggtgagaccagcagaagccgcccagccacccagcgcccgcccctcccaagggtctcccaggctgcaaggacagggcaggggcaccactgctggggatggacttagggggctcctgggggtctcctcttggggaagggaggatgcccctccagcccacccagacccaggaagcaccacttccctgaacactmctgtgatcccatggggtctcccgggacccaggtgggggtgttctggataacaaggccctggggactccttgagtcttggagggactgacaccactcagggaccccagattctcacacaaagaaaaggaagatgggaggggcagggctggaagtgagtgagggggtgaggagacgaggaggtgagtgagaaggtgaaggggtgagtgagggagtgagtgaggagtgaggaggtgagggggtgagtgggtaattgaaaggatgagggagtaattgagggggtgagggggtaattgagggggt

SEQ ID NO: 181073 - DNA, 601 bp, Human
aggctgacctgccagggccaggcccccgggagcgcgctctcgccgcccacaatcctgctctggcggcttgagttcaagttgaccccgcaggctgaggatgacaaacaggaggccagtggggtgagaccagcagaagccgcccagccacccagcgcccgcccctcccaagggtctcccaggctgcaaggacagggcaggggcaccactgctggggatggacttagggggctcctgggggtctcctcttggggaagggaggatgcccctccagcccacccagacccaggaagcaccacttccytgaacactcctgtgatcccatggggtctcccgggacccaggtgggggtgttctggataacaaggccctggggactccttgagtcttggagggactgacaccactcagggaccccagattctcacacaaagaaaaggaagatgggaggggcagggctggaagtgagtgagggggtgaggagacgaggaggtgagtgagaaggtgaaggggtgagtgagggagtgagtgaggagtgaggaggtgagggggtgagtgggtaattgaaaggatgagggagtaattgagggggtgagggggtaat

SEQ ID NO: 181074 - DNA, 601 bp, Human
cctggcatgagcgcacttgatgtctcacagccctaggaagcaggtgcaatactctccccatttaaacacaaggatgccggggctgcaagggttgagacctgctcaaggtcacagggtggctgtaggccagccctgagcccccacccggcccgcgccgcccctggcatacttttccacgcagtgggcggctgtcacgatccactcgggggtgatgatggagcctccgcacacgtggacgttctggacgtgcaggctgacctgccagggccaggcccccgggagcgcgctctcgccgcccacratcctgctctggcggcttgagttcaagttgaccccgcaggctgaggatgacaaacaggaggccagtggggtgagaccagcagaagccgcccagccacccagcgcccgcccctcccaagggtctcccaggctgcaaggacagggcaggggcaccactgctggggatggacttagggggctcctgggggtctcctcttggggaagggaggatgcccctccagcccacccagacccaggaagcaccacttccctgaacactcctgtgatcccatggggtctcccgggacccaggtgggggtgt

SEQ ID NO: 181075 - DNA, 601 bp, Human
catgcactgcctggcatgagcgcacttgatgtctcacagccctaggaagcaggtgcaatactctccccatttaaacacaaggatgccggggctgcaagggttgagacctgctcaaggtcacagggtggctgtaggccagccctgagcccccacccggcccgcgccgcccctggcatacttttccacgcagtgggcggctgtcacgatccactcgggggtgatgatggagcctccgcacacgtggacgttctggacgtgcaggctgacctgccagggccaggcccccgggagcgcgctctcrccgcccacaatcctgctctggcggcttgagttcaagttgaccccgcaggctgaggatgacaaacaggaggccagtggggtgagaccagcagaagccgcccagccacccagcgcccgcccctcccaagggtctcccaggctgcaaggacagggcaggggcaccactgctggggatggacttagggggctcctgggggtctcctcttggggaagggaggatgcccctccagcccacccagacccaggaagcaccacttccctgaacactcctgtgatcccatggggtctcccgggacccagg

SEQ ID NO: 181076 - DNA, 601 bp, Human
gagccataaacacagagctctcggtggatgaacttccaacgtcagaagctggaggcaagacacccagaggcaggatggttcaccaaaaaccacacagggagatagtggaagaggggctcggtctccccttctcccccacactcccccaaccccgactccctgcctcagccccccacatcatccttctttctggctcttgcatcaccttcaaggaatctgcagcacccacaatgggccgacatccctccctggggtttcaaggccatttctagcaggactggcccttattttcctttgtacrccaaagcatttcctggcacatggtaggtgcttaataaatggatactaatgaacagacttgtccgatatcaatcaaaccatttcctttatccaagagtttccctcttaagagaatcccagctcctagtgggcccagagcacccagtggtgtgaagagggggagagaagggagcacccttgggtaacagcccttgagagaaacccagttcctagagggcccagagcacctgggggtgtgaagagggggagagaagggagcacccttgggtaacagcccttgcttccttgaccttcataacag

SEQ ID NO: 181077 - DNA, 601 bp, Human
gtatccggctccatagaacatgaaagattgtctcaaaatccccgcaaatgccgtccaatgccatggattgttaagaggtctgggagagaagaaggactcagtatctcagagccataaacacagagctctcggtggatgaacttccaacgtcagaagctggaggcaagacacccagaggcaggatggttcaccaaaaaccacacagggagatagtggaagaggggctcggtctccccttctcccccacactcccccaaccccgactccctgcctcagccccccacatcatccttctttctgrctcttgcatcaccttcaaggaatctgcagcacccacaatgggccgacatccctccctggggtttcaaggccatttctagcaggactggcccttattttcctttgtacgccaaagcatttcctggcacatggtaggtgcttaataaatggatactaatgaacagacttgtccgatatcaatcaaaccatttcctttatccaagagtttccctcttaagagaatcccagctcctagtgggcccagagcacccagtggtgtgaagagggggagagaagggagcacccttgggtaacagccctt

SEQ ID NO: 181078 - DNA, 601 bp, Human
gcttcatcagcgcaatgtcattgttcttggtcttggagtcataatttggatgagaaatcactttttctacttggtatccggctccatagaacatgaaagattgtctcaaaatccccgcaaatgccgtccaatgccatggattgttaagaggtctgggagagaagaaggactcagtatctcagagccataaacacagagctctcggtggatgaacttccaacgtcagaagctggaggcaagacacccagaggcaggatggttcaccaaaaaccacacagggagatagtggaagaggggctcrgtctccccttctcccccacactcccccaaccccgactccctgcctcagccccccacatcatccttctttctggctcttgcatcaccttcaaggaatctgcagcacccacaatgggccgacatccctccctggggtttcaaggccatttctagcaggactggcccttattttcctttgtacgccaaagcatttcctggcacatggtaggtgcttaataaatggatactaatgaacagacttgtccgatatcaatcaaaccatttcctttatccaagagtttccctcttaagagaatcccag

SEQ ID NO: 181079 - DNA, 601 bp, Human
ctgcagcttcatcagcgcaatgtcattgttcttggtcttggagtcataatttggatgagaaatcactttttctacttggtatccggctccatagaacatgaaagattgtctcaaaatccccgcaaatgccgtccaatgccatggattgttaagaggtctgggagagaagaaggactcagtatctcagagccataaacacagagctctcggtggatgaacttccaacgtcagaagctggaggcaagacacccagaggcaggatggttcaccaaaaaccacacagggagatagtggaagaggkgctcggtctccccttctcccccacactcccccaaccccgactccctgcctcagccccccacatcatccttctttctggctcttgcatcaccttcaaggaatctgcagcacccacaatgggccgacatccctccctggggtttcaaggccatttctagcaggactggcccttattttcctttgtacgccaaagcatttcctggcacatggtaggtgcttaataaatggatactaatgaacagacttgtccgatatcaatcaaaccatttcctttatccaagagtttccctcttaagagaat

SEQ ID NO: 181080 - DNA, 601 bp, Human
cacaagtgtcatttccaatcaacatctctttaagattctgccaacctgcttgccaagcctgagccacacgtaccgttgaaagtcagaggcttctgcagcttcatcagcgcaatgtcattgttcttggtcttggagtcataatttggatgagaaatcactttttctacttggtatccggctccatagaacatgaaagattgtctcaaaatccccgcaaatgccgtccaatgccatggattgttaagaggtctgggagagaagaaggactcagtatctcagagccataaacacagagctctcrgtggatgaacttccaacgtcagaagctggaggcaagacacccagaggcaggatggttcaccaaaaaccacacagggagatagtggaagaggggctcggtctccccttctcccccacactcccccaaccccgactccctgcctcagccccccacatcatccttctttctggctcttgcatcaccttcaaggaatctgcagcacccacaatgggccgacatccctccctggggtttcaaggccatttctagcaggactggcccttattttcctttgtacgccaaagcatttcctggcacatg

SEQ ID NO: 181081 - DNA, 601 bp, Human
gcctcgggctatgtctccacctggccttcccacatgcaggctgctgggcctggcaccctggccaccctgcccagaggaccctgcatcccaacaagtcccacattctcactttctccccctgccagacctctccttctggcaggcaagaagttatgctacttataagtagaattatttgctagctctgcttataagaggaattatttgctagctctgcttccaaaattacatatctccaggtgaccaagacgggaaagacacacaggaggcaacagccaaaaagccgatggagtcaatggartcagctttcgccccagaggcaccacgccattgctcaggcattcgctcttctatatgtgaaccatttcccaatgtgaatacagacatgctgtagggagggctgaggttttgcttcttctgtatccacatggggctagaacattccagacccttggatggaccagagtgggaccgaataagaggctaagagaaagcatgtttgtcctgaattaagcaacttggttttagaatgtatctttaaaaatcaaggatctttacacattttaggccagtagttctcaactggaagtgactttgcctc

SEQ ID NO: 181082 - DNA, 601 bp, Human
tcactaggtctgtttcaagaagagaaaacacagtgagccaggcgggtatcacctaaggcctcgggctatgtctccacctggccttcccacatgcaggctgctgggcctggcaccctggccaccctgcccagaggaccctgcatcccaacaagtcccacattctcactttctccccctgccagacctctccttctggcaggcaagaagttatgctacttataagtagaattatttgctagctctgcttataagaggaattatttgctagctctgcttccaaaattacatatctccaggtgaycaagacgggaaagacacacaggaggcaacagccaaaaagccgatggagtcaatggagtcagctttcgccccagaggcaccacgccattgctcaggcattcgctcttctatatgtgaaccatttcccaatgtgaatacagacatgctgtagggagggctgaggttttgcttcttctgtatccacatggggctagaacattccagacccttggatggaccagagtgggaccgaataagaggctaagagaaagcatgtttgtcctgaattaagcaacttggttttagaatgtatctttaaaaa

SEQ ID NO: 181083 - DNA, 601 bp, Human
agcctcacctttctcctcggtggccccccacccggaaatccagcagagctgttctggctgcagcatcatgcctgggttgggcagacacactggtttcactaggtctgtttcaagaagagaaaacacagtgagccaggcgggtatcacctaaggcctcgggctatgtctccacctggccttcccacatgcaggctgctgggcctggcaccctggccaccctgcccagaggaccctgcatcccaacaagtcccacattctcactttctccccctgccagacctctccttctggcaggcaagamgttatgctacttataagtagaattatttgctagctctgcttataagaggaattatttgctagctctgcttccaaaattacatatctccaggtgaccaagacgggaaagacacacaggaggcaacagccaaaaagccgatggagtcaatggagtcagctttcgccccagaggcaccacgccattgctcaggcattcgctcttctatatgtgaaccatttcccaatgtgaatacagacatgctgtagggagggctgaggttttgcttcttctgtatccacatggggctagaacattccagac

SEQ ID NO: 181084 - DNA, 601 bp, Human
gattccatgaggtcttttgcccagcctgtggctctactgtagtaagtttctgctgatgaggagccaggatgccccccactaccttccctgacgctccccagaaatcacccaacctttgtacttttccccttgtttgaaaggatttgttgtctgtatggcctagacgcttttgagaaggatataaacaatatgtaaaatgaacctttgtgcctgccactaagcacttccaaccctccataaaaatgaagcagccaggctcccttcatttgaaagactgtcagagagaaatgcagattgcaamggaagtgggtggagagagcctctctctgtggttatcagggcagaggacaggcttagatgtggccaccatgggtccaggatgcccgtcctcaccaagccccctgtcactcagccacgcaggccttggtgggatctccagggcagctctaaactcacaatgagtgcaacacaggagatcctgcacctctaaactcgtatggcccagatacttcaaaagccattccacatgctgctctgtgtgatcacgataagaacacagtgtattaggtaggctgggcaggatttctcccacttagcagat

SEQ ID NO: 181085 - DNA, 601 bp, Human
aagagaggtaaagctcctgacagcagagacatttgtcttactctgttcacttctgcattcccagcacctgagtagcacccagcctgtactaggtgcaggtgcgcacaaatatttgtcgatattcccttcatcttggattccatgaggtcttttgcccagcctgtggctctactgtagtaagtttctgctgatgaggagccaggatgccccccactaccttccctgacgctccccagaaatcacccaacctttgtacttttccccttgtttgaaaggatttgttgtctgtatggcctagacrcttttgagaaggatataaacaatatgtaaaatgaacctttgtgcctgccactaagcacttccaaccctccataaaaatgaagcagccaggctcccttcatttgaaagactgtcagagagaaatgcagattgcaaaggaagtgggtggagagagcctctctctgtggttatcagggcagaggacaggcttagatgtggccaccatgggtccaggatgcccgtcctcaccaagccccctgtcactcagccacgcaggccttggtgggatctccagggcagctctaaactcacaatgagtgca

SEQ ID NO: 181086 - DNA, 601 bp, Human
atgagaagctggtgtcttcaccataatccacaaggacctatgcaatctggccccagcccacctccttggccccttgaccacacctgaagatacatgcactagcctttttgatgtgtacacatttttgccatttgagtctcagctcaaatgccacctcttccgagaagcctttcctgaccaccccttcaaaatagccgggaccttgtgatccccaccctcagatgtttggaagtacctcgctcagttgtttgtctcccatctgtctgaccacacctgccccgtccccaccaccgacatccasaagagaggtaaagctcctgacagcagagacatttgtcttactctgttcacttctgcattcccagcacctgagtagcacccagcctgtactaggtgcaggtgcgcacaaatatttgtcgatattcccttcatcttggattccatgaggtcttttgcccagcctgtggctctactgtagtaagtttctgctgatgaggagccaggatgccccccactaccttccctgacgctccccagaaatcacccaacctttgtacttttccccttgtttgaaaggatttgttgtctgtatggcctagac

SEQ ID NO: 181087 - DNA, 601 bp, Human
catccattcatccccactccccacgcagctgccagatcatggcactccccggctcacgatctccccacctcaagcagatgagaagctggtgtcttcaccataatccacaaggacctatgcaatctggccccagcccacctccttggccccttgaccacacctgaagatacatgcactagcctttttgatgtgtacacatttttgccatttgagtctcagctcaaatgccacctcttccgagaagcctttcctgaccaccccttcaaaatagccgggaccttgtgatccccaccctcagatrtttggaagtacctcgctcagttgtttgtctcccatctgtctgaccacacctgccccgtccccaccaccgacatccagaagagaggtaaagctcctgacagcagagacatttgtcttactctgttcacttctgcattcccagcacctgagtagcacccagcctgtactaggtgcaggtgcgcacaaatatttgtcgatattcccttcatcttggattccatgaggtcttttgcccagcctgtggctctactgtagtaagtttctgctgatgaggagccaggatgccccccactaccttccc

SEQ ID NO: 181088 - DNA, 601 bp, Human
cagcaatggacttgtcaccatcatcctcgtctccatccattcatccccactccccacgcagctgccagatcatggcactccccggctcacgatctccccacctcaagcagatgagaagctggtgtcttcaccataatccacaaggacctatgcaatctggccccagcccacctccttggccccttgaccacacctgaagatacatgcactagcctttttgatgtgtacacatttttgccatttgagtctcagctcaaatgccacctcttccgagaagcctttcctgaccaccccttcaaartagccgggaccttgtgatccccaccctcagatgtttggaagtacctcgctcagttgtttgtctcccatctgtctgaccacacctgccccgtccccaccaccgacatccagaagagaggtaaagctcctgacagcagagacatttgtcttactctgttcacttctgcattcccagcacctgagtagcacccagcctgtactaggtgcaggtgcgcacaaatatttgtcgatattcccttcatcttggattccatgaggtcttttgcccagcctgtggctctactgtagtaagtttctgctg

SEQ ID NO: 181089 - DNA, 601 bp, Human
caagacacggcctgcacttgccacctctgcatttcccactctcgctttgctgcctcccctcgggcatcttctgggcaccgtgggcttagtgtgcaaaaccagaaccctccgtcacaccttctcccaccccaaattctcaccaaccaatatttcctggcttgaaaaatggcaccacccgccaccctggggcttcagccacagagtggaaagccatcgtccctgacttctcactctctctcccacagacatgcaacccatcagtaagtctggtggctctagccctagtgtaccctcatctctycacatccacgcccgcactctgctatgagctggcttcctgtctcaaggaaccacagcaatggacttgtcaccatcatcctcgtctccatccattcatccccactccccacgcagctgccagatcatggcactccccggctcacgatctccccacctcaagcagatgagaagctggtgtcttcaccataatccacaaggacctatgcaatctggccccagcccacctccttggccccttgaccacacctgaagatacatgcactagcctttttgatgtgtacacatttttgccatttgagtc

SEQ ID NO: 181090 - DNA, 601 bp, Human
ttccctccctgagacctccacacgcactacacagatggtcacagccctattctccagccctgcccccgtcagctcatcccagcaccaacccctctcctgggaaacctggattctccttacaactggcggtgcctgtgctgaatgcagctctggagttcagcttcagggaaagaaattcccagctctgaaactatagggctctatcagtgccatggaatccccctcttattcacccaacggcttggttctgctgaaccaatttcccactcctcactgaaccccacccaggacacacaggcgyctgtttcccctctggcatgcacacactcttctggagcacacgcgaccctccctaggccgcctgcttctcggctcccctgcacattagagcttctcaagacacggcctgcacttgccacctctgcatttcccactctcgctttgctgcctcccctcgggcatcttctgggcaccgtgggcttagtgtgcaaaaccagaaccctccgtcacaccttctcccaccccaaattctcaccaaccaatatttcctggcttgaaaaatggcaccacccgccaccctggggcttcagccacagagtgg

SEQ ID NO: 181091 - DNA, 601 bp, Human
caaaggtagaataaaaatgttgaattacctggcaagaatcgacgttcccctgcaggaagccggcacagatcatggctggtgtgatcaggttgtcatagacatatctgctgttgcatctctgtgtctcaatgagaagcaccttggcagcgttcagcacttctgaggtcttccctaaggacagggagacttgttgagctcccagtgttgcctgcagctctcgcagggagagcacacttccctccctgagacctccacacgcactacacagatggtcacagccctattctccagccctgccccsgtcagctcatcccagcaccaacccctctcctgggaaacctggattctccttacaactggcggtgcctgtgctgaatgcagctctggagttcagcttcagggaaagaaattcccagctctgaaactatagggctctatcagtgccatggaatccccctcttattcacccaacggcttggttctgctgaaccaatttcccactcctcactgaaccccacccaggacacacaggcgcctgtttcccctctggcatgcacacactcttctggagcacacgcgaccctccctaggccgcctgctt

SEQ ID NO: 181092 - DNA, 601 bp, Human
ggatctggtaaggaccaaaggtagaataaaaatgttgaattacctggcaagaatcgacgttcccctgcaggaagccggcacagatcatggctggtgtgatcaggttgtcatagacatatctgctgttgcatctctgtgtctcaatgagaagcaccttggcagcgttcagcacttctgaggtcttccctaaggacagggagacttgttgagctcccagtgttgcctgcagctctcgcagggagagcacacttccctccctgagacctccacacgcactacacagatggtcacagccctattytccagccctgcccccgtcagctcatcccagcaccaacccctctcctgggaaacctggattctccttacaactggcggtgcctgtgctgaatgcagctctggagttcagcttcagggaaagaaattcccagctctgaaactatagggctctatcagtgccatggaatccccctcttattcacccaacggcttggttctgctgaaccaatttcccactcctcactgaaccccacccaggacacacaggcgcctgtttcccctctggcatgcacacactcttctggagcacacgcgaccctcc

SEQ ID NO: 181093 - DNA, 601 bp, Human
atttaaaatagtctaaatacttgtttctgttccactggcacttttaccaaataccggtttttcagagggtgtgtgtgatttgttgactgtacttccttctgccaccagaagcgttcgcactgtttgtggccgtcacttcccatgactgccccgagctggctccgtgtcactgaggaggctctgctgaccccaagaatgccctctctctcatggggggttcagtaggatctggtaaggaccaaaggtagaataaaaatgttgaattacctggcaagaatcgacgttcccctgcaggaagccggcacagatcatggctggtgtgatcaggttgtcatagacatatctgctgttgcatctctgtgtctcaatgagaagcaccttggcagcgttcagcacttctgaggtcttccctaaggacagggagacttgttgagctcccagtgttgcctgcagctctcgcagggagagcacacttccctccctgagacctccacacgcactacacagatggtcacagccctattctccagccctgcccccgtcagctcatcccagcaccaacccctctcctgggaaacctggattctccttacaactggcg

SEQ ID NO: 181094 - DNA, 601 bp, Human
ccctctgctctctataaatcaaaagtttcatgtgaggccgggcaccgtggttcacacttgtaatcccagcactttgggaggctgaggtgggtgaatcacctgaggtcagggcttcgagaccagcctggccaacatggagaaaccccatctctactaaaaatacaaaaagtagctgggcgtggtggcgcatgcctgtaatcccagctacttgggaggctgaggcaggagaatcacttgaacccaggaggcaaaggttgcagtgagtcgagattgtgccactgcactccagcctgggcgacasagtgagactccatctcaaaaaaaaaaaaaaaaagtttgatgtgaggtggcctgggtggaacagctgagtcagctgagccagaacgaagtgtggttggcagagcaccaaggaatttcacacaagctgagccccagcgcttttcatccaaacaccaggggaaatatgcaagtgaagccagtgagaggcaatgggcaatgggtggacactggggggatggggctgtggctggaggaagcagagtttgcttcatgctgaccagtggtcaccagtcagcttccagcagcagaaccacgcctaaca

SEQ ID NO: 181095 - DNA, 601 bp, Human
aagatgtggtcttggtgcagccaacacgtgggaacatgtgcctggtgctgagaaccttggaaatatgacaagatattgaggaagaacctcttctgtgacctgcagagaatcttttggaacaggccttgaatgaatccccattggacatgtgtgctttgatgcgagggaattctctctactaaaagtaaatgtgggtggtctgagggctatgataaaagaagccctgaaaccctccctccagagcaaaggggaaagggagaagcctgaagaaggactaaaaaatacttaactttggcaatcaaaaaaaaaaagcttttataaataataacttgcctgttaattaattcaatgacctttattttaaaatgatgaggtttaattaatttaattaacagaaatgtattgagtacctaggctcctgtctttaccgtagccaaggcagtagttggttcaagattacttctcaaccattagcatgtttccagggagcgctgcttctacagagacagatttaatttttacatgtgatggggaatgaaatatcctgtacctccctcctggcttgatttagcgataagctgctttataaccaaatctttcc

SEQ ID NO: 181096 - DNA, 601 bp, Human
aatatgacaagatattgaggaagaacctcttctgtgacctgcagagaatcttttggaacaggccttgaatgaatccccattggacatgtgtgctttgatgcgagggaattctctctactaaaagtaaatgtgggtggtctgagggctatgataaaagaagccctgaaaccctccctccagagcaaaggggaaagggagaagcctgaagaaggactaaaaaatacttaactttggcaatcaaaaaaaaaaagcttttataaataataacttgcctgttaattaattcaatgacctttatttwaaaatgatgaggtttaattaatttaattaacagaaatgtattgagtacctaggctcctgtctttaccgtagccaaggcagtagttggttcaagattacttctcaaccattagcatgtttccagggagcgctgcttctacagagacagatttaatttttacatgtgatggggaatgaaatatcctgtacctccctcctggcttgatttagcgataagctgctttataaccaaatctttccaaatgcctactgtaaagtcaggctttcctgactactgcattaggattcactacctgcctgt

SEQ ID NO: 181097 - DNA, 601 bp, Human
aatgtctctgaccaccagcagggtgtcagcagccggctagagggggcagcagtgaggtgacttctgaacctggagtgagctttcctgctctattaatggccaggagtcatgcatttattctctgctgattctctgaagcctaaaataaaaattgcttaggtggagagaaaaatggaattgtaaattcaagcaataaataaccaagaatttttcaagaattaagtaatagtcatagacaatgtctgaaagctcagtacgtgacaagcactgcgctctgtgctttaggtgtgctttcccaggwatccccacccaccacccaccacccctcgggggtcttatacgcatttgggggtgggaaaactgaagctcggagagactgaatgactttccagggcaacagggcaagaaagagggagggccaaaaatggaagccagggagctgaacttcagaagccaagttctgaaccaccagacagataacgacttccttcccttcatgcctcctgatctctttggttttggcctcaaactaccctttctagccagagaaccctgaacgtacaccccaaggtgttagggacttattgtatgactgcaactg

SEQ ID NO: 181098 - DNA, 601 bp, Human
tggaattgtaaattcaagcaataaataaccaagaatttttcaagaattaagtaatagtcatagacaatgtctgaaagctcagtacgtgacaagcactgcgctctgtgctttaggtgtgctttcccaggaatccccacccaccacccaccacccctcgggggtcttatacgcatttgggggtgggaaaactgaagctcggagagactgaatgactttccagggcaacagggcaagaaagagggagggccaaaaatggaagccagggagctgaacttcagaagccaagttctgaaccaccagrcagataacgacttccttcccttcatgcctcctgatctctttggttttggcctcaaactaccctttctagccagagaaccctgaacgtacaccccaaggtgttagggacttattgtatgactgcaactggaccctccggaactccgtgctgttcccccatctcctctttccttcagcactgctgaatgagcaacagaatgaagggctggatccaggtgtgcacgggagaggccttgagaggagaggttcaacaggaaccagagccctccagctccccttcttttatgggaaagtcaactgt

SEQ ID NO: 181099 - DNA, 601 bp, Human
atgactgcaactggaccctccggaactccgtgctgttcccccatctcctctttccttcagcactgctgaatgagcaacagaatgaagggctggatccaggtgtgcacgggagaggccttgagaggagaggttcaacaggaaccagagccctccagctccccttcttttatgggaaagtcaactgttggaagtgtgcttgttccccgaaggctttaatcaggaactagaggtccattgtttaaagcccagtgactctgtgaggagtcacaggcatgtgcccggaagcccgcctgagagctgsaaggcgtgtgtgctggcaggcagggccacgttggcatggagatgactgccaggtttgcggctgatcccattatgtgggttctttcgaactgtagaacttttgaacagttctttcaaccagcacctgcttgaaccgtgcaatttggtcttattaataataacactcttctaaagtaattataattacagcaatttctattatgaaaaaagagactttcatgttaacacaataactccagctgaagacaggagaaggtgtgcagccatataccttgtagtagcttcaaaaaaagcctttggg

SEQ ID NO: 181100 - DNA, 601 bp, Human
ggagtcacaggcatgtgcccggaagcccgcctgagagctgcaaggcgtgtgtgctggcaggcagggccacgttggcatggagatgactgccaggtttgcggctgatcccattatgtgggttctttcgaactgtagaacttttgaacagttctttcaaccagcacctgcttgaaccgtgcaatttggtcttattaataataacactcttctaaagtaattataattacagcaatttctattatgaaaaaagagactttcatgttaacacaataactccagctgaagacaggagaaggtgtgyagccatataccttgtagtagcttcaaaaaaagcctttgggattctttttctgaaagattttctgtcatctccactaacataggtaaagcagacagcaaaactattctcatacctgaacacttgaatgtaaagggccacctaattattttggcgaatcctattttaatcatggtgcattcacttgattatcagcctcttagtacacaattatttggaagacttgtattgaaaatatggatccagcatatgcaataagagtttgtgttcttcagaagaagccatccaggctccccaaatgaa

SEQ ID NO: 181101 - DNA, 601 bp, Human
ccaggatttcatgccacgggggtggtgaggggtaggaggaggtggaaagcattgaatcagaaagtcttccaggtaccagcaatgccagggttaatatggtctggcttgcttttcaggtgagcacctgtagctggcaggaaagtggcttcttggtggaggtgggcatgaattccagaagccttggagagacatccagagcccttcccactacatcgtgctgcctcctggggaaattcctaagctttttttgaatcagaaaagccactgacaagcagacagaattgtgtggcttgcgcagtgrttggagagctaggtgctttgggtactagtcccagagctgctacttgtcgaatgttgggtattggagagaagtcatttgagctgtctgagcctctgtttcctcatctgtaaatcagggaatttgaacaagtgacctcagattccttctagaagctctaacagtcaatgatatcatctatttcatttgagagaatctccatagctctaattttttgcccccagaccaatctgcttcagctttgtgtgggtgcaacacctggggtcctgttaaaatgcagaatcggattcagtgaccgagagc

SEQ ID NO: 181102 - DNA, 601 bp, Human
ctggccccagccattggactctatttggaggccactgcagaggccagatgcccctctgctcggcggtttcctgtgcagaaaggctgtgttctttcttcttcctaaatactcttcctaggttaagtgtttccttctctttgcccatctagaaaatctccacctcaagcaggtcgtgttccaaaaactcctcgtgttgggcaagtggaaaacacgcagttttttctaggggtctcattctgaggcggtgctgctgaaaatcttggtgctgaacgtgtgtttttgagatttccagtctatcacrgggccacaaggtgtaaatatcaagaaaaatgaattactagaaaggcaaagtgaaaaagacatacaaaatacaagtgtcattctttttattcttagtttggacagatagtccattcttctacactggtcccacggtttctgaagcttcctgtaatgatcagtggttaccttgttgcccaagtaactgcaaatccctcctctacaaagtgtgcttgctccaaggcagtgcaaactagaagttgttacaaatggttccagtaacaaatttgtttggcggccttttcccatgaatgagacagtg

SEQ ID NO: 181103 - DNA, 601 bp, Human
ctcttcctaggttaagtgtttccttctctttgcccatctagaaaatctccacctcaagcaggtcgtgttccaaaaactcctcgtgttgggcaagtggaaaacacgcagttttttctaggggtctcattctgaggcggtgctgctgaaaatcttggtgctgaacgtgtgtttttgagatttccagtctatcacagggccacaaggtgtaaatatcaagaaaaatgaattactagaaaggcaaagtgaaaaagacatacaaaatacaagtgtcattctttttattcttagtttggacagatastccattcttctacactggtcccacggtttctgaagcttcctgtaatgatcagtggttaccttgttgcccaagtaactgcaaatccctcctctacaaagtgtgcttgctccaaggcagtgcaaactagaagttgttacaaatggttccagtaacaaatttgtttggcggccttttcccatgaatgagacagtggttatttttgctaaagcagaaaggaaatgtgatactattgggctgtgttttgccctctggagtaatcctgcttggggaaaatggaggcttgttccagaatgcagaaat

SEQ ID NO: 181104 - DNA, 601 bp, Human
tcggctggcctaggagttgctgcccagagaggcaaagggagaatgtccagtggaaacagctgccctgagcatacagggcacgctgacacctgctgattcccccatccttaaggtcctgtattgttcctaacaccacgtggatcttcttgccagatgcattaaagtgtgagaagagttaaaaatcacttataactggagtgactgggggttaaagaggagaaaaaatttgaacctgactcaaaggatgagcatgtttttctttctttcttcggcacattggctgggtgtggcggctccatgsctataatcccagcactttggaaggccgaggtgggaggattgcttgaggttaggagttcaagatcagcctaggcaacatagcaagtccctatctatataattttttttttaaattagccaagcttggtggtgcatgcctgtagtcccagctactcaggaggctgaggcaggaggatcacttgagctcaggagttcaaggctgcaatgaattacgattgtgccactgcactccagcatgtgcaacagagcaagaccttgcctcaaaacatattaagcacctactgcatgtcagggccttggt

SEQ ID NO: 181105 - DNA, 601 bp, Human
gaagatgaaactgtctatcctgggggtgttgatgacaaatctggcagccataaagatgattctatgatgctataatttttgaaatatttactgtagaattttgtccaccctccctgtccacatacacactagcttaggttaattagaagagcaaacagaattaacagtggcatcatggtatctggttgggtcttagagtagcttctatacccaacaagcccacaggagatgtttcccaggaggaggtggctggttaaagccatagaaaggaagtactacagtcaggaagaagagcaagatyaatgctcctattcccatctacagcattacattacctcttctggctgagtgttgattattttaaataggtagcagaggtcttccaaagctttactgatattggttgtggttgtagtgcccttcctttgtgcctgtgactcataagaaacaggtttagtcctggatctgtgtgcccaagtaggtgttccctgaagtttaacagcagtgggggtacttaacaatacctgataaggccccttccatttcattgtaattgattcttggggtatccctgtctttaccctgtctttaaggttttagc

SEQ ID NO: 181106 - DNA, 601 bp, Human
ttcaccgtctcttgctgtcttgccaactgctgtctcttgtctctcaccaattgctgcctctctgtctctgctgtcttgcctctctgccaattgccaccatctccgctgtccttgtccctttgctggttgccagatgatgcaggacaggcaagccccaagactggggcttagcctgggagagttcttggatttgcccaaagattcaagggtgagctggtggtgttaggcagcagctttcatggaagcagctgtgcacagcagcgccagagatgccgctccttgcagatcagggctgctccayaggctgtgtgccctgagtagcagctcagaggcagttctgcagtcatatttatacctacctttaactatatgcaaattaatgggcggtgtatgcagatacttctaggatgagggtggtaaccttagggccattgggtcattgccatggaaaggggtggtaacttctgggtgttgccatggaaacggtaaaccgacatggcatgctggtgggtgtgtcctatggaaaactgcatctgccctgacctgttttagctagtgctcagtttggtcctatgtccaagccttgcctctggaatcaagt

SEQ ID NO: 181107 - DNA, 601 bp, Human
acctgacttccgtaagcctctactttactggaggaccacagtgacattttgggtcctctggaattaacgtcagctcagagccagtgtccagtagtccctgaaatgtctgatcatctccctttccccagtgcacagttaccctgataaaaggccagaggtctctttggggaaggatgggagaaagattcactgcatacattgtcggtaatgtagtggggtccttcctcaaggggacccgacctccccttcattcaaggggttctgggtctgtaaactagctcaagtctggaaattgattgamgagccatgattctctgtttttataattcaaattagtgttttggccatttgacctagaagttttctgcttgtataaattaagtaggaatgcagtgggcttcctatcaatttcacttctaggaacaccatgattaattaaccaatgccggagctctacacgagccagactgttctgattgctgctttgcctctgctgtccattagggtagctgtgcccacctgaccttatcatatctagtttttgaaacatggcagggaaaatgattccacgtaacctgaccatatcagctgggtgactgaa

SEQ ID NO: 181108 - DNA, 601 bp, Human
caacatggcacatgtatacatatgtaacaaacctgcacattgtgcacatgtaccctaaaacttcaagtataattaaaaaaaaaaacaaaaaaaaaacccaaaacctcttcttgggagctctggagtagaattctctttctggctggactctgataaatacagctggtgaccattatttcagaatgaaatttcgtttagtttatgagtctgtccaaatatttcgatcatttaaattcagatgttagtttacctcggtttgtggagaatggactgggctgtagaaacttagaagccaagcgamtgtggactccgctgtcttcattgctgtcttgttactatggatgtcggattaggtgcacccgtgaggtcttggattgtaaccccatgttctgcaggtctcaggacctcttccctgcactgtgctagcccggccccctgtgatggactgaattgtgtccctcaaatttatacgttgaagtccaaacctccagtacttcaaaatatgactatctttggagatggggccttaaaagaggtcatgaagttaaaatgtggccatgagggtgggccctgatccagtctgacaagtgtccttatatag

SEQ ID NO: 181109 - DNA, 601 bp, Human
aaaaacccaaaacctcttcttgggagctctggagtagaattctctttctggctggactctgataaatacagctggtgaccattatttcagaatgaaatttcgtttagtttatgagtctgtccaaatatttcgatcatttaaattcagatgttagtttacctcggtttgtggagaatggactgggctgtagaaacttagaagccaagcgaatgtggactccgctgtcttcattgctgtcttgttactatggatgtcggattaggtgcacccgtgaggtcttggattgtaaccccatgttctrcaggtctcaggacctcttccctgcactgtgctagcccggccccctgtgatggactgaattgtgtccctcaaatttatacgttgaagtccaaacctccagtacttcaaaatatgactatctttggagatggggccttaaaagaggtcatgaagttaaaatgtggccatgagggtgggccctgatccagtctgacaagtgtccttatataggacatgcagagagacaccagggatgtgcgcagagggaccgccatgtgaagaagcagcaagaggagcaagaggacggccatctgcaagccaa

SEQ ID NO: 181110 - DNA, 601 bp, Human
ccaaaacctcttcttgggagctctggagtagaattctctttctggctggactctgataaatacagctggtgaccattatttcagaatgaaatttcgtttagtttatgagtctgtccaaatatttcgatcatttaaattcagatgttagtttacctcggtttgtggagaatggactgggctgtagaaacttagaagccaagcgaatgtggactccgctgtcttcattgctgtcttgttactatggatgtcggattaggtgcacccgtgaggtcttggattgtaaccccatgttctgcaggtmtcaggacctcttccctgcactgtgctagcccggccccctgtgatggactgaattgtgtccctcaaatttatacgttgaagtccaaacctccagtacttcaaaatatgactatctttggagatggggccttaaaagaggtcatgaagttaaaatgtggccatgagggtgggccctgatccagtctgacaagtgtccttatataggacatgcagagagacaccagggatgtgcgcagagggaccgccatgtgaagaagcagcaagaggagcaagaggacggccatctgcaagccaaggggga

SEQ ID NO: 181111 - DNA, 601 bp, Human
aagtcgtgacattcaggtgaacctgaaagttatagcttcttttatagccagttatccaagggctgaagccatcgagctgcctgccttctgagcacttgaaacaaaaaggattggaatgtttggtacaaaacccagcacttaaaacctatgaggctttcagctgtgactcttactgtctcgcctccatctgggaagttcattgatcttcaaaacctggcaggctcctcaggggagagaaggtttaagatggagcagccagctcaaatccctattaggtccaagagccaagaggcgcaacgcrcagctagttgggaacatatgaacaccctcccaaaaagctgcaagactgttgtgcgtgtaaatctaagtgaggaaattatgtggtgaaatgggttttttcaaagtttgcacttaggcccttttccgaagaaaatctgtgttgacagtggagggagataatgtttgagttaattgatgagggttttaagcagtaatcaatatttcccaaactagcaaacccagcatgttttagggtcattttcaatgattaaaattaaaatttggttgtttcaaaactttggttgaatgctaaccactggag

SEQ ID NO: 181112 - DNA, 601 bp, Human
ggggtgaagcccaggctggagtgcagtggtgcagtcttggctcactgtagcctccgcctcccgggttcaagcaattctcctgcttcagcctcccgagtagctggaattacaggcacccaccatcatgcccggctaatttttgtttttgtttttgttttgttttttgtttttttagtagagacagggtttcaacatgttggccaggctagccttgaactcctgacctcaggtgatctggccacctcggccccccaaaatgcagggattacaggcatgagccactgcgcccggccaagagttrgcattttctttctcaagatgggagatatgatgtcccatgtataataagcgggagtgatcctgggagagggggaaaaactgatgatgcagaagaaagggaattaggggcatgctgtcctgagtgggcactgagtggggtggtccagtgcccacggagaggggctggagctaggaccatgggtggtacctgtctccactgctgctccagcaaacatatttaacactcacgttcaagggctgtcacacgtatgttgaagactttgccaaggttaatatgttgcaatttttttctccaagtctt

SEQ ID NO: 181113 - DNA, 601 bp, Human
gccatagaagccaaagagggatgcatctgtcatttctcttctgggttagcattctttcaaaatatctggacaccataaaaatgtagaggtcagtcaatagagatttaatgctttcttgtgagaaattcccttggaagggctttaagaaagtctttttagaagagaataatatctttgatcactatatgcctattaaaatactttttttttcttgtgggtttaccatggaaaaaaacatcaaagccttatatgagccacatagaaatagcctgtttcttaaatggctggcctgaaattagcraagggtagcaaattgaacacaatggtttttctgtgttgcgcattcagtttgggctgatcagatcccatgcaaaaagattactgtaaaacgaagatgaaattttagattttaagaagatttcattgtaaagctaggtcacagcattccacattcaggtgagtactaggatttgtagattatcagtcattatcattaacatactcacatacaattgtcattgttgctaagaagtgtttgcaccttttcaacacttagaaattaagtcacattttctgctttcaaagcccttaaccttaatca

SEQ ID NO: 181114 - DNA, 601 bp, Human
cccaaggtccaggtgccagcatggtcagggtccaacgagggccaccttctgggctgcagactgcctgctcttcattgcatcttcagatggcagaaagagggtgagagctcctccgtcctttttataagggcactaatcccatccatgaggctccatcctcatgacctaatcacctcccaaaggccctgcctcctaatagcaccaccttggggattaggattgcaacaaaaggcaggggatacaaacaatcaggtcataacagcatataatggaatattattcagccttaaaaaggaagacrgttctggcacatgctataacatggatgaaccttgaagaccttatgctatgtgatagaagactgttacaaaaggacaagcactggatgattccatttatgtgaggttcctggagaaggcaaattcatagagacagaaacattaagggtggtgtccgcaggaatggagagtgaggagttgtttaatgggtaacgggtttcagttttgtaaaatgaagtgagttcctcaggtgggtgatgatgatggttacacaacaatgtgaatgtacttaacgccattgaacttcacctttagaaagaact

SEQ ID NO: 181115 - DNA, 601 bp, Human
ctacttatccccctccccaactatcatcaaagtatgaaggtcagagctcttttgtcctttttaatagtttgttttcttaaaagtggttgagtgtgaattttctcttgcatgggaaaaggatcattgttttcactggcatcagtgaatgcgctcacacatgactgtttaaatatgtcttcattcgttagtcagtaggatcgcatcctgctggaagacagattgtgtaacctcagaggcttccagggaaactccagtcccagggagagagtgggacagtggcatgctctatagagaaagcacyccttgttctctctctctgcctccccaaccccgccccactgatctccctcctggtgcaggagggactgttggagcagaagaaaacatccagctcacctgtcactgaatagcccctgttgcaaaggaacacaggctctctggcctccagcccacatctgcggaagcttggttggagtgaggctgcttacggctgctcccctttcagtccatgtttggtttctgcatccaagaggcagagtgagaatcagaccctggtcgggggtgatccctgaaggcaacgcagtcatatgcagtctcttgg

SEQ ID NO: 181116 - DNA, 601 bp, Human
accctgtcttcaggcatgctgctctgtggccccgcttacaatggtgacgttgcctgattctggccctggttctgcctatcactggccagacagccctaaaccaagctcataccgctagggccttaggaagggagaggaatgcaggcaaaagtcgtctcccatacacagccacctaaggaggaacagagccttaggatgttaagtggaacaaaccaagtcacgacccacatgtaagaatgtgaccaagagcgagaaaacccacagacacacctttctaagggtggtggcctacaggattagyttctctttctcttccaagtgactgctctccccacaccttggcctccaccagaggggaatgtgggcagtgcacgcaggaccgcacggtgtcttctgcaggggtgaaaacagtatttaaagcccctgtgactgcaggtgcctgcaccttctgggggtgggagagggcatgaaatcctatcagcaggaaagtccatccttgctgctctgctccactcgcccaagccgggctgggaagagaggagagaggacttcagaggtacccaggctattcccagggggaggcctgtgtggtccccgtttg

SEQ ID NO: 181117 - DNA, 601 bp, Human
agggccttaggaagggagaggaatgcaggcaaaagtcgtctcccatacacagccacctaaggaggaacagagccttaggatgttaagtggaacaaaccaagtcacgacccacatgtaagaatgtgaccaagagcgagaaaacccacagacacacctttctaagggtggtggcctacaggattagcttctctttctcttccaagtgactgctctccccacaccttggcctccaccagaggggaatgtgggcagtgcacgcaggaccgcacggtgtcttctgcaggggtgaaaacagtatttraagcccctgtgactgcaggtgcctgcaccttctgggggtgggagagggcatgaaatcctatcagcaggaaagtccatccttgctgctctgctccactcgcccaagccgggctgggaagagaggagagaggacttcagaggtacccaggctattcccagggggaggcctgtgtggtccccgtttgttcggagatgataaggagtccattcgagggaggagctgccttctgaacatgggagtggctgacactacctctgagggtttcagtgcctctcccgtgtccagaattcttctgattct

SEQ ID NO: 181118 - DNA, 601 bp, Human
aagtcacgacccacatgtaagaatgtgaccaagagcgagaaaacccacagacacacctttctaagggtggtggcctacaggattagcttctctttctcttccaagtgactgctctccccacaccttggcctccaccagaggggaatgtgggcagtgcacgcaggaccgcacggtgtcttctgcaggggtgaaaacagtatttaaagcccctgtgactgcaggtgcctgcaccttctgggggtgggagagggcatgaaatcctatcagcaggaaagtccatccttgctgctctgctccactygcccaagccgggctgggaagagaggagagaggacttcagaggtacccaggctattcccagggggaggcctgtgtggtccccgtttgttcggagatgataaggagtccattcgagggaggagctgccttctgaacatgggagtggctgacactacctctgagggtttcagtgcctctcccgtgtccagaattcttctgattctgatgcagggggcaggatggcaggggtacagggtaagggtatgagggctcaggggctgctgaggatgggggtgtttgttttgttttagttcctgccacc

SEQ ID NO: 181119 - DNA, 601 bp, Human
aattcttctgattctgatgcagggggcaggatggcaggggtacagggtaagggtatgagggctcaggggctgctgaggatgggggtgtttgttttgttttagttcctgccaccccaccctgccctctgctccccatctctgcctgggtcacccatcactgaaagatgtcagttgcacaccaaggtggctaccagagggagaaaaacagcccctaggggtagggaaggtgggagttccgtggaggcagcacctggatcaggagagctgggcagccaggggcagaacaaccacctgccagggygggattaaaaagcaggcatcctcaccatagcctaggatacctttggattggagcattcccagctggaacgttgccctcttgcagccacgtacaggtggtgctgacactcaggccgctcccaaacgttctgtcgtgcggttatgtccaccctgggttgcagcccatgtgcaccctgggaggactgctgaacacaccgccaggccatggagattgtgcacaccactgccggtctgtgtccagactagcagcaataaggattctgattctgattaaagcccctgtgactgcaggtgcctgcgc

SEQ ID NO: 181120 - DNA, 601 bp, Human
cgtttgttcggagatgataaggagtccatctgagggaggagctgccttctggacatgggagtgtggctgacactacctctgcgggtttcagtgcagagataaggaatgccagtctggtggataatttgatgcgtgcctttttctgcagagtgatgtatttgagaaacagccctgtaacgagaaaaagccgcactacccctctttaagttcaaacaccactgtgccaggtgcttttatagaggcaggacaaggcacgatgctcagagcaacactctttattagcccagggtacagacaaggrggctgaggctcagagagggtggcaaccctcagattctgcagctaacaagaggttgagctggggttagaatctcggtccagcacaccctgaagtcactatcctttcctgtatggagaagacacaggtgtatcctgggaccatggctaggaaatgaatgtgaaactcgcatcctgtgaatgttatgaaaggacatagttcccaatatgtttaagggcgttggctatgggtttgggatgaaacctctccccgttgtagaaatgtgtcctttctactcttcataagggatgtgtgttatttgga

SEQ ID NO: 181121 - DNA, 601 bp, Human
gccttctggacatgggagtgtggctgacactacctctgcgggtttcagtgcagagataaggaatgccagtctggtggataatttgatgcgtgcctttttctgcagagtgatgtatttgagaaacagccctgtaacgagaaaaagccgcactacccctctttaagttcaaacaccactgtgccaggtgcttttatagaggcaggacaaggcacgatgctcagagcaacactctttattagcccagggtacagacaaggaggctgaggctcagagagggtggcaaccctcagattctgcagckaacaagaggttgagctggggttagaatctcggtccagcacaccctgaagtcactatcctttcctgtatggagaagacacaggtgtatcctgggaccatggctaggaaatgaatgtgaaactcgcatcctgtgaatgttatgaaaggacatagttcccaatatgtttaagggcgttggctatgggtttgggatgaaacctctccccgttgtagaaatgtgtcctttctactcttcataagggatgtgtgttatttggaaagtttcaaaactcagtcagggaggtccccctcccccctaacc

SEQ ID NO: 181122 - DNA, 601 bp, Human
cagtctggtggataatttgatgcgtgcctttttctgcagagtgatgtatttgagaaacagccctgtaacgagaaaaagccgcactacccctctttaagttcaaacaccactgtgccaggtgcttttatagaggcaggacaaggcacgatgctcagagcaacactctttattagcccagggtacagacaaggaggctgaggctcagagagggtggcaaccctcagattctgcagctaacaagaggttgagctggggttagaatctcggtccagcacaccctgaagtcactatcctttcctgyatggagaagacacaggtgtatcctgggaccatggctaggaaatgaatgtgaaactcgcatcctgtgaatgttatgaaaggacatagttcccaatatgtttaagggcgttggctatgggtttgggatgaaacctctccccgttgtagaaatgtgtcctttctactcttcataagggatgtgtgttatttggaaagtttcaaaactcagtcagggaggtccccctcccccctaaccaacctatcaccccaggaacgaggtttcagctgcagaggtagtgacagctcccaggtccagaagaat

SEQ ID NO: 181123 - DNA, 601 bp, Human
ctttctactcttcataagggatgtgtgttatttggaaagtttcaaaactcagtcagggaggtccccctcccccctaaccaacctatcaccccaggaacgaggtttcagctgcagaggtagtgacagctcccaggtccagaagaattaggatttggggacttggatttgagtgatctcttaggttcttaaaacgggcctcctacaccctaaatactgctccctcaacttcaacctccacagttggtatcaacctgctgtcaactaaaagtaagctcctaagccccccaccaactgaacagacccttctttttgccaaggagaccccccaaaaaaaccttaaaaacttagttctcagccatgatgggacaggagatcagacacaccttgttacactttctcccttttatggtttaggcacaacggctgaccagtactaatgttaaaatagagaatagaacagactgtttgtggcaacaagataccaacttataagcagcaacctcaggtcacgccaggcaagggttgagccgcgtactctacacttagagaacggattctgttctcatggcacagcgtcttctttttctccagcagctaaaac

SEQ ID NO: 181124 - DNA, 601 bp, Human
tatttggaaagtttcaaaactcagtcagggaggtccccctcccccctaaccaacctatcaccccaggaacgaggtttcagctgcagaggtagtgacagctcccaggtccagaagaattaggatttggggacttggatttgagtgatctcttaggttcttaaaacgggcctcctacaccctaaatactgctccctcaacttcaacctccacagttggtatcaacctgctgtcaactaaaagtaagctcctaagccccccaccaactgaacagacccttctttttgccaaggagaccccccaraaaaaccttaaaaacttagttctcagccatgatgggacaggagatcagacacaccttgttacactttctcccttttatggtttaggcacaacggctgaccagtactaatgttaaaatagagaatagaacagactgtttgtggcaacaagataccaacttataagcagcaacctcaggtcacgccaggcaagggttgagccgcgtactctacacttagagaacggattctgttctcatggcacagcgtcttctttttctccagcagctaaaacactcaccggcccggagatcagccagatt

SEQ ID NO: 181125 - DNA, 601 bp, Human
aacttcaacctccacagttggtatcaacctgctgtcaactaaaagtaagctcctaagccccccaccaactgaacagacccttctttttgccaaggagaccccccaaaaaaaccttaaaaacttagttctcagccatgatgggacaggagatcagacacaccttgttacactttctcccttttatggtttaggcacaacggctgaccagtactaatgttaaaatagagaatagaacagactgtttgtggcaacaagataccaacttataagcagcaacctcaggtcacgccaggcaagggtygagccgcgtactctacacttagagaacggattctgttctcatggcacagcgtcttctttttctccagcagctaaaacactcaccggcccggagatcagccagattcaaatgactgcagctcatccgcccacagacgcggactgaccccgttccacagccatgactgcagctcggattgggcaggagactgacttcaggaacctcctccagataagagacccctgacagtggactggctctggttgctttacagaggctgctcacttgagtgccttcaagtcctgaaaagacctttttgac

SEQ ID NO: 181126 - DNA, 601 bp, Human
aagtaagctcctaagccccccaccaactgaacagacccttctttttgccaaggagaccccccaaaaaaaccttaaaaacttagttctcagccatgatgggacaggagatcagacacaccttgttacactttctcccttttatggtttaggcacaacggctgaccagtactaatgttaaaatagagaatagaacagactgtttgtggcaacaagataccaacttataagcagcaacctcaggtcacgccaggcaagggttgagccgcgtactctacacttagagaacggattctgttctcayggcacagcgtcttctttttctccagcagctaaaacactcaccggcccggagatcagccagattcaaatgactgcagctcatccgcccacagacgcggactgaccccgttccacagccatgactgcagctcggattgggcaggagactgacttcaggaacctcctccagataagagacccctgacagtggactggctctggttgctttacagaggctgctcacttgagtgccttcaagtcctgaaaagacctttttgacatttagggcctaactgtgatacacttaaatgttaagactcca

SEQ ID NO: 181127 - DNA, 601 bp, Human
tgggacaggagatcagacacaccttgttacactttctcccttttatggtttaggcacaacggctgaccagtactaatgttaaaatagagaatagaacagactgtttgtggcaacaagataccaacttataagcagcaacctcaggtcacgccaggcaagggttgagccgcgtactctacacttagagaacggattctgttctcatggcacagcgtcttctttttctccagcagctaaaacactcaccggcccggagatcagccagattcaaatgactgcagctcatccgcccacagacgcrgactgaccccgttccacagccatgactgcagctcggattgggcaggagactgacttcaggaacctcctccagataagagacccctgacagtggactggctctggttgctttacagaggctgctcacttgagtgccttcaagtcctgaaaagacctttttgacatttagggcctaactgtgatacacttaaatgttaagactccagcccagagtgaacacaggaggcatgtcgcatggatgttcaatatgcgtgcatcaggaccaccttcatgaatattcatagttcctcctgtaaactgc

SEQ ID NO: 181128 - DNA, 601 bp, Human
gctaaaacactcaccggcccggagatcagccagattcaaatgactgcagctcatccgcccacagacgcggactgaccccgttccacagccatgactgcagctcggattgggcaggagactgacttcaggaacctcctccagataagagacccctgacagtggactggctctggttgctttacagaggctgctcacttgagtgccttcaagtcctgaaaagacctttttgacatttagggcctaactgtgatacacttaaatgttaagactccagcccagagtgaacacaggaggcatgtcrcatggatgttcaatatgcgtgcatcaggaccaccttcatgaatattcatagttcctcctgtaaactgctgaatatgtatgtttagccaacccattcagcgtaaagctccttccccaacccctcctccttcaaagtgcctgtctctgttcttgcacaaaggcacacttcccagactgcaggatggccgccttgcacctttataagaaggtattcttttcaccttcccaagtgtataaatattgtgttgattttttttttaagtgaacactgctaaatgctaagcatttggtggaaaaccac

SEQ ID NO: 181129 - DNA, 601 bp, Human
aaagctccttccccaacccctcctccttcaaagtgcctgtctctgttcttgcacaaaggcacacttcccagactgcaggatggccgccttgcacctttataagaaggtattcttttcaccttcccaagtgtataaatattgtgttgattttttttttaagtgaacactgctaaatgctaagcatttggtggaaaaccaccacattccagaatcaggcagccaagcccatccccattcccccctccccatccctctccccccttcactgccaccgtccacttggcagctgtggttttcccawgaggagcccaggtatccatgtgtctctcaacatgtgtctttctagtaggagcctgtacagcaatagtgaaatggctcacactctcacacatgcacacacagccagaataaattgtataatcaagctcctcttagctaagttctgtaacatctgtttgtgttaagtggtgctctttgaaaatgattcccccctccctttataaaaacaaccttaattttagattgtggagaaatggcgcatgacaattatttttgctttcttcaacaagatgtgtttaagtaaatgagattcatttctaga

SEQ ID NO: 181130 - DNA, 601 bp, Human
gctctttgaaaatgattcccccctccctttataaaaacaaccttaattttagattgtggagaaatggcgcatgacaattatttttgctttcttcaacaagatgtgtttaagtaaatgagattcatttctagaactgaagcgctgaaagagcctgattaacagaatcagtgcctacaatcatatgtaataactgtgggcaaacagccccgcgtggctgggctgcagaggccactgctgctgtgggttcggcttgccggcagacttcagcagatgggctgctaatataattaggaatcgttgygttaaatgagccattatttaaattatctgctaattttcctatctattaacctgctgaaatagagagagtaatatctgagaaatctcaggctgctaatcactaactagatgaatcgcccagtttttccctttaatgcaacattttaccttattgcagcaattagcaaatggctttctgtagggttattgcccagtgcatcaaccagagattaagaagggacagtgggagacgtccacagtctgtttaggtttcatccaggtggcagattggtggctagaccatggcttctagccgaggagg

SEQ ID NO: 181131 - DNA, 601 bp, Human
tgagattcatttctagaactgaagcgctgaaagagcctgattaacagaatcagtgcctacaatcatatgtaataactgtgggcaaacagccccgcgtggctgggctgcagaggccactgctgctgtgggttcggcttgccggcagacttcagcagatgggctgctaatataattaggaatcgttgtgttaaatgagccattatttaaattatctgctaattttcctatctattaacctgctgaaatagagagagtaatatctgagaaatctcaggctgctaatcactaactagatgaatcrcccagtttttccctttaatgcaacattttaccttattgcagcaattagcaaatggctttctgtagggttattgcccagtgcatcaaccagagattaagaagggacagtgggagacgtccacagtctgtttaggtttcatccaggtggcagattggtggctagaccatggcttctagccgaggaggctcttagctttctcgaccactgttttcttgtttatttcatagtctctgcattaaaggatatttggccttcagaaagcttctcttagtccatttgggctgctataacaaaatacct

SEQ ID NO: 181132 - DNA, 601 bp, Human
atgtaataactgtgggcaaacagccccgcgtggctgggctgcagaggccactgctgctgtgggttcggcttgccggcagacttcagcagatgggctgctaatataattaggaatcgttgtgttaaatgagccattatttaaattatctgctaattttcctatctattaacctgctgaaatagagagagtaatatctgagaaatctcaggctgctaatcactaactagatgaatcgcccagtttttccctttaatgcaacattttaccttattgcagcaattagcaaatggctttctgtagsgttattgcccagtgcatcaaccagagattaagaagggacagtgggagacgtccacagtctgtttaggtttcatccaggtggcagattggtggctagaccatggcttctagccgaggaggctcttagctttctcgaccactgttttcttgtttatttcatagtctctgcattaaaggatatttggccttcagaaagcttctcttagtccatttgggctgctataacaaaataccttagactgggtggcttattgatggcagacatgtatttcttacagttttgggagctggaagtccaaga

SEQ ID NO: 181133 - DNA, 601 bp, Human
gacagtgggagacgtccacagtctgtttaggtttcatccaggtggcagattggtggctagaccatggcttctagccgaggaggctcttagctttctcgaccactgttttcttgtttatttcatagtctctgcattaaaggatatttggccttcagaaagcttctcttagtccatttgggctgctataacaaaataccttagactgggtggcttattgatggcagacatgtatttcttacagttttgggagctggaagtccaagacccaggcactggcagattgaggtctagtgagggcttygtgcttcatagagtcagtgccttctctctgtctccttacatggcaaaagggatgagcgagcgctctcacgtacttttgtaagggcactaatcctatctcttagggccccacactcatgatctaattgcctcccaaaggccttgcctcctaatatcagtacgttgggaataagggttcatcatacaaagttaggggtcagggcacagacattcagagcacagcagagcataaggtgaggactgtgtgagtataacttctctcactctccctaccctgagacactggtagggggcaggaaag

SEQ ID NO: 181134 - DNA, 601 bp, Human
catacaaagttaggggtcagggcacagacattcagagcacagcagagcataaggtgaggactgtgtgagtataacttctctcactctccctaccctgagacactggtagggggcaggaaagtgaggtaggcgggaggaggaggtcaatacagggtgcactcagagtgggctattgcagtgcacatctggggctcaaccccaccaaggacttctgggggatgacacagagaccactccaaactgtttgcctggggagtaagggagcaacggtttggacccaccagctgtttatttttggtcragggctgctcccaggagcattcactccctggtacgtcagacctgacttggacactagataatctcactcctgaggttacagaagctgaagtgagtgcccaaggaatatgggtaggccaccagcaatctctgctgtcttctcgcttctagctttgcttatacttggacatttaagagacaagtttgtggttatttatatagcagctgggaagttgactaagtttagcctacccttgccatgtctagaaaatctaaattaattctttgcacacatgatttaggagtttggcctgttgaactt

SEQ ID NO: 181135 - DNA, 601 bp, Human
catttaagagacaagtttgtggttatttatatagcagctgggaagttgactaagtttagcctacccttgccatgtctagaaaatctaaattaattctttgcacacatgatttaggagtttggcctgttgaactttctccggctacttccaacttcttggcaggtttgttgacctaattggcattctctctgctcccaggtgggggctcatggacatgcttccccatctgaaggaacaagtgattagtgaattcctattagttgcaggcactgtggggaccatcaaaaagagactaagaagragagctttgtccttaaggaatttacaagctcattgagaggaaagaaaggaaaccgggaaacattagaggacaataaaagacacgagacaaccctagacaccaaaaatcagggcatgagctgtcagagaggagtaaatcagagctgcagctgggaggccttctggggaacgcaggacttagcatgggtctcaaaggcaacagcctttgtacggtttatcgtttactctcagccagcaggcagaaggggtgagaggtggtttctacttgcatcaaaacaaaataaggaatatcaaaccccac

SEQ ID NO: 181136 - DNA, 601 bp, Human
cattttccttgtccagaggttttagtgccatgggatgctgtggactgtgtgtccctggtcaccaggaggcaaactcagtttactcagttttcacaccttgctggctaaaattgcacgtggaaccggcgctagtgtttatttgctcactcaccgtgagccagcaccatgaggagcacgtgtcacagcatttacttctcacaagcaccccatgagaatggtcatcaccccctttcctagaagagggagggtgcagagagatctggggagaggaacccacctcttccaggtgccaggcactggyacatgaatggtggagggagattggaccccaagccctgcgtgcattcagtcattctgctcagtgaagtgtggacagaatttgtttgatgggagggtagaattgttctcaaagggcttgtgacacaggaggaagacgtccacgttcaggacatgtctagttcctacccatccgtgatgtgtgcataatggtcatccctcttttataattattttgtaaaatctgatgatgcggttttgggcagggctgctggaactggggcatattgtcaaggaagtctatgccaaagacgaacagttttca

SEQ ID NO: 181137 - DNA, 601 bp, Human
agtgtggacagaatttgtttgatgggagggtagaattgttctcaaagggcttgtgacacaggaggaagacgtccacgttcaggacatgtctagttcctacccatccgtgatgtgtgcataatggtcatccctcttttataattattttgtaaaatctgatgatgcggttttgggcagggctgctggaactggggcatattgtcaaggaagtctatgccaaagacgaacagttttcatcgtgggggcatagaattttcacacatcttctggaatagatcatctaaactcttttactctcagrttttctgtataattggtaggtgctcaagagatttgctttagaaatgaacaagccaccttccttttgcctggaatgtgcatttctgccacttgcccttcactgcatgaacgtctctctaaccttgactttcatttattcattcaacaactgtttagtgagcacctactaggctcccaggcactgtctgaggtactggtgacaaagagatgagccacatgtggccctactgtcagctgtcatggagggcgcactgtgctggggacattatctggagaagacaggctcctgtgtgacggtgat

SEQ ID NO: 181138 - DNA, 601 bp, Human
aagagatgagccacatgtggccctactgtcagctgtcatggagggcgcactgtgctggggacattatctggagaagacaggctcctgtgtgacggtgatgcacccaggacaggggcacagaagccttgggaacaccatgtaaagttagaggaagaggtatggggggagggcagagatcagaaggaaggactgtggggggcaaaccaggagggcgcatttccaaagcttcactgaggcctggtcacttgcggccagcactgcctgcaggctggacaggtcaggggagagctcagagatgacsgtgggcctggagcacgggaggtcactggtgagcttggccggccatggagagctgaggcagaagctccatctctgcaggtggaggagagaaagagagaaaggaattgagacgggaggtggcccactgctggatgcttgaccgcaaagggggaaggaacagtagctggagggagtgtgttttgggttttgccatttttaggaaggcgagaagaaattagccactgagttcctgcagttccacctccttaggtctctggcagcttggatcacagatggttttcaagggcaggtcctggtggac

SEQ ID NO: 181139 - DNA, 601 bp, Human
ttgaccgcaaagggggaaggaacagtagctggagggagtgtgttttgggttttgccatttttaggaaggcgagaagaaattagccactgagttcctgcagttccacctccttaggtctctggcagcttggatcacagatggttttcaagggcaggtcctggtggacaggccattctccctactagatgctgcactctgcaggggccaggacacaggcaccatcatctttgctgctctcaccccatgccccaggttcagcacagcaaagacccacatctgccctgcaaaggccctcgaggcygctgatgttggcggcagggttggagtagttaaaagccagtgattttcaaggtagaagactccatccagcttctgctggaaaaccggtttttgttagttgtgattgtgttctggaaaaatggaatgtgacttctatgggaggctccctagtatcaggaaggaagcagggaacaggggcggggacgtcgggacctccatgggctgtttcacatctccaaggcgtttctgttttcctcagatgtaaagtggggatctgtctatcgtatgagcttttgagtcattttaagttatgctttgcttg

SEQ ID NO: 181140 - DNA, 601 bp, Human
aagcaacttccaaattcatcttgcctccagaaagcatttaaatccccaacacagagacagtggtgaacactcagggccctgtgccttccctgtggcagctcatggcagctttggcgaggtatctgctggttgagcctcggtgctttccagcctgggtgctggacacgttgtactttggagccccctcccagtgatggtttaggtcccggcccttgctcttttcacatcagccatagaagtggcttttgctcttgtgataatcctaagctggatgcaaagaaggtgtcacagagccagctckgcaggcagcaaggaggcctggaggccggcaagccttgaagatggacggagcaagtaaaggcggcggccagcagcaagtgagtgggaggcctggggacacgcctccatgacacagcctgagggctgccagcccctaccagaaactgggagagacaagaagggccctcccctggagcttctgtgggaagcgcagccccgcccacacctagattttggacttctgacctccagaactgccagaaaataaatgtatattatctcatgccaaccagtttgtggctgtttgttaaggcagccataa

SEQ ID NO: 181141 - DNA, 601 bp, Human
tttctcctcaccaacaaacaatcgatcggttctgcgacagacaccagctgcgtatcctctaatttagttcagttcctacactgtctgcctggggatggcgtgggaccccagagtgagggcccagtcccccaagactgcccccagcttccatgccagttgcgagctccgggtcattgcctgtgcttctgatcgatcggctacaaatggaagatttccaggatcctatccttggtttgattaatttgctagatttactcacagaactcaggaagacatgtacactggtttattataaagggcrttacagaagatacagatgaagagatgtgtaggttgaggtatagggggacaggtacagaacttccgtgccccccctgtacacgccaccctccgggaacctcagctgtctggaaatttaatgaaccctgttcttttggggttttgtggaagcttcgttatgtagacatgattgattaagccattggccattggtgatcagcttaaccttcagctcctccccactccccaaggttgggggtggggctgaaagtcccagtcctctaatcccgccttgctctttctggtgaccagcccccatccc

SEQ ID NO: 181142 - DNA, 601 bp, Human
agcctcagctctgccacttacccttgtagagttgagcaagtcagactctctgcacctcagtgtttgcatctgtgacgtggagtgaggactgtgctgccctcagagctctgttatgaggttgaaataagctaatggatataggaagcacgtacagcagtgcccagcccactgcaggcggtgttcagtgtctgctgtcactgttatgtgaaaggtgtggtgttatgggagggaaagggatgcacaggccggcaggagactgggaacagcagttctcccaaagggccagccagggtcagcttcrtggagaaggtggcgttgaaggaagcctggaagggagcgatgggccgtgccacatggacctggacctgggtatcctggggaagagcccccaccccagcaaggtggccaggggaaaggccctgccactgggggatgtctggggctttcacggagtggcctggtggtcagcgtggctgggaggagtgatgtcagggcatggcgagtgactcagcaggccatgtgaggacttcgccagttactctgggtgacgtgagagccatgggaggtggagggctgactccctctgacttaactgtaatag

SEQ ID NO: 181143 - DNA, 601 bp, Human
gggtgggggcagctggagctcaattcgggacacgccaggcgtgagatgatgtcccatctcaagatgtttcctggacctgctgtaactaagtacacaaactgagagctgaaaacaacaggaatgggccaggtgcagtggctcatgcctgtaatcccagcactttaggaggccaagacgagaggatcacttgagcccgggagttcaagaccagcctgggcaacatagtgagaccccatctctacaaaaaataaaaataaattagccaggcatggtggtgcacgcctgtggtcccagctacttyggaggctgaggtgagaggatcccttgagcccaggagtttgaggctacagcaagtgatgattgtgctgctgtactccagcctgggtgacagagtgagacactgtcaaaaaaaaaaaaaaccccaggaatgtattctttcacagttctagaggcaagaagtctgaaatcaaggtgttggtggggccatgcatcctctgagactccaggtggagccgtcctttcctcttccagcccctggccatggttgtcagtcctttggcattcttgtgactccgtcactcccatccctgtctctgctgtt

SEQ ID NO: 181144 - DNA, 601 bp, Human
cgttttgatgtcacaactatttttacgattctgaaatttaaattcaacagacagccaggtaaatttaaattcaacggacagaacaggtaaatttaaattcaacggacagaacaggtaagctgacatgctggtttgttttttagggtcatgaaccttctagaggctcggaactgtcacattaggtttccctactgtaaattcttttcctgacttccctttctcgctttccttatcctcagtgttttgttccgggaaataaaggccagctctagttggggacaaaaggagggggaaagaatarctgaagtcttctgaaaatgccaggcaatttaataaagccagatgatttgctgtgtatgaaagaaagcatagaggaaaccctgtatatctatgctacctacaccacatcctgggctccactttggtgccataaatgatggggcctcctgcacgtatggctgcaggtgcttgctggggagagggctgtggtggccagtgctctatgaggcttcagaaaaatatggctggcccctccctcaaggaacctatagcttggtttatggcttcatgtgttggtaagctttcttcattgatattcccg

SEQ ID NO: 181145 - DNA, 601 bp, Human
ggtgccataaatgatggggcctcctgcacgtatggctgcaggtgcttgctggggagagggctgtggtggccagtgctctatgaggcttcagaaaaatatggctggcccctccctcaaggaacctatagcttggtttatggcttcatgtgttggtaagctttcttcattgatattcccggatacaactcctgcctatgatcactatgtgcccagctgttgctataaccacaaacgtgtgtagaagtcgtggtggtgtttctctctgtgtgtgcagcagaggtttggtttacgatggcttatsctgccccgtcccactcagatctgtgattcatccaagtcctcagtccccaaacagccctcacctccaactgttcactctggactgctcatcatggaacaggacttggagttggtccaaacccctcattttgattcctgcggcacaggagttcagagagacaggggacttgcccaagttcaagctttgaggccagcagtccccaaaccttcagccaacacctgctttttataacaagtgctttgtcattccctgaagtaaatgcaaaggtcatatgacttatctacatacacagctcaaagt

SEQ ID NO: 181146 - DNA, 601 bp, Human
taagccttccctcctgctaatctcacaagataattcaggatttcttgccaccattctgaccactcaaggttctgatctgtttcttcttttgtgggtaaataaaaagagaaagaacacaccagtgtctggggaaagcccctcaatggttggtttcaccccattgccacttccaccattcaaattcagtgtaccttccttatttgcgagtactgcagagactgacttattacatataacacatcacgcaccttttgggtgtctaccctggtaccgcctttcttttcaagagaccattcttcarcagaactgtaaggtttcttcttggctgaatcagatgtgacgcatcccacttctgcgtttgaggcgagttctattccttcagctgcatccctgctaccatgcttgctttgcagattaaattcttagattgatattaacttgtttccttttatctgctttttacatgctttattatggttgatatgctttatgattgaaagatatgaatattttctttcaatgtcaattatgtataattaatttgtctaatgctttcgtgtaactttagagctggcctaagttatactttcaaccattgtat

SEQ ID NO: 181147 - DNA, 601 bp, Human
atccctgattgattgctgtttctgagcacccagaatggacattgccaaggagaagcccatccaggtttcttgctccatgtatttaattattgtgcagagcaattgagagccaaagcattttagtcgcaagaggtgggacgttagaaaatgaagatgaaggcatgtttttcatttaaagtgctggaaactctacgctaataataacccctagagtcacttatgaatgattcttctctggggttttactcagaggtttagttcaaggaacccagagaatatgaatatgaactgagaattacctttttttttttttttttaacattatctaggactgtgctttctacaaggctagccacaagtcacatgtggctatttaaatttaaatgaatgttaaatagaagttcggtctttcagttgcactataatcgcatttcaagtgttcattagtcacaagcggccagcgtattgggcaggatatttctgtcgtcacaggaggttctgttggacagcgctggtgcagggcagagaggaactctgccgtttagacaccggttgcacaagagcttgaagcgtcaccacctcgccttgacctccttagctg

SEQ ID NO: 181148 - DNA, 601 bp, Human
ttttcaaaaggaagtcatagcattttagactgtttaggaaagatacaattactctaccagggctgggcaaggtggctcacgcctgtaatcccagcactttgggaggctgaagcaggtggatcacctgagttcaggagtttgagaccagcctgaccaacatagtgaaaccccatctctactaaaaatacaaaaattagctgggcatggtggcatgcgcctgtaatcccagctattagggaggctgaggcagcagaatcgcttgaacccaggaggcggaggttgcagtgagctgagatggcascattgcactccagccttggtgacatagcgagactccatctcagcaacaacaaacgattactctaccagaccaggtagtatggtttggctgtgaccccactcaaatctcatcttgaattgtagctcccataattaccatgtattgtgggagggacccagtgggagataattgaatcaagggggcggtttttccccatacactgtcttcgtggcagtgaataagttttacgagatctgatggttttataaggggaaatccctttcactggctttcatttctctcttcccttccccatgtaag

SEQ ID NO: 181149 - DNA, 601 bp, Human
aaggggaaatccctttcactggctttcatttctctcttcccttccccatgtaagacatgcctttcaccttccaccatgattgtgaggcctccccagccacgtagaattgtgagcccattaaacttctttctctttataaattacccagtcttaggtatgcctttatcacagtgtaaaaacagactaatacaccaggagttggcaaactctagcccatgagccaaatctgacctgctgcctgttttagtaaataaagttctatcagaacacagccatgcagctatgcaagtttacttacacrttgtctgtggctgcttccacattacgtttgagagctgagtagttatcacagagatcccatggcctacaaacctaaaacgtctattatttgtttctttatggaaagaaattgccaacctctgttctagatcgtattctccaagcatttcaagataattagtctttgtatatttctgaacttgaggaatgaacccaaattgtcaaaatggactgaataattcagtatttttattgctattcaacataagcgtgttcatctcctcccatgtggcaggcacatctgaatttatattggcactaa

SEQ ID NO: 181150 - DNA, 601 bp, Human
ttactaaggtgggattaaaagaaaacacatttattaaattcatacgtttgcgtgaagatggagcctgcagacggccctggaatgcaggcagggggtggtgccctccgccaggctgggacgtggcctgttttcctggctctgcaggggacacctccgaggagacacccagcatgggaatatgggcagcctgaaggcatgccctggggagagccagcccttcccagtggtggtgagccccagaggaattgtggaaccctgctcttgccatcaccagagcctccccacatggggaaagacagarttggatgttcaccaaatatttgtacttggggcctacccaaaggaaatatgtctgtatgcaggaggagggaggcaggcaggggaatttccacctggaggcattgccaaaggcaggcgggagtagacgctaggggtgtgtgcagggctcctggagtccacatgggtttgtatgtttattgcggcattattcacaatagcaaagacttggaaccaacccaaatgtccaacaatgatagactggattaagaaaatgtggcacctatacaccatggaatactatgcagccataaaaaatgatgag

SEQ ID NO: 181151 - DNA, 601 bp, Human
gcgtgaagatggagcctgcagacggccctggaatgcaggcagggggtggtgccctccgccaggctgggacgtggcctgttttcctggctctgcaggggacacctccgaggagacacccagcatgggaatatgggcagcctgaaggcatgccctggggagagccagcccttcccagtggtggtgagccccagaggaattgtggaaccctgctcttgccatcaccagagcctccccacatggggaaagacagaattggatgttcaccaaatatttgtacttggggcctacccaaaggaaataygtctgtatgcaggaggagggaggcaggcaggggaatttccacctggaggcattgccaaaggcaggcgggagtagacgctaggggtgtgtgcagggctcctggagtccacatgggtttgtatgtttattgcggcattattcacaatagcaaagacttggaaccaacccaaatgtccaacaatgatagactggattaagaaaatgtggcacctatacaccatggaatactatgcagccataaaaaatgatgagttcatgtcctttgtagggacatggatgaaattggaaatcatcattctca

SEQ ID NO: 181152 - DNA, 601 bp, Human
tacggaccttcccgcttccctttgagtctctctggagaaatgagggcatcctctgtatgtcttgctggatgtgagggagacacagagcacacgagggcttctgaaatctggccttgggggaataagaagccttttatgcttctggagtatagatttgtgcctttcctgcttctttcctgccagagttcatctggcagagctaagcctcaccccaggctctggggtccgggggatactgtcctcccaggtcagccacctctcatttgcatggtggacagctgcggctgacaggcaaacaaaratgtctgcggccatggcagctcctagagaaactcttctctccttactctcaaatgcctaagattaggatccaccacctgccacggtaacctacttccacggcttctcacaccccctcacaaggcagtcatgatgatagatgtgactgcgtcgaatggcttccagaaatatgatcttatttgtacaacagagccgtgcccaaaggaagaatgccaaccagtgggaagctctgctggggctttctgaattcctagacccaatcacaagctggtgtactgttgaaccatgaaaaaattgagta

SEQ ID NO: 181153 - DNA, 601 bp, Human
tacacctttcaccattcattcatcttggattgatggtccctaagctcagtttaagaggttgaaataaacagatttttaatcagtgtaggacagagaaggacgaaaattaagcaaaatgaaaccgaaaagatcatcagcttttatcctccattcacagctagcctggcccccagagtacccaattctccctaaaaaacggtcatgctgtatagatgtgtgtggcttggtagtgctaaagtggccacatacagagctctgacaccaaacctcaggaccatgttcatgccttctcactgagttytggcttgttcgtgacacattatgacattatgattatgatgacttgtgagagcctcagtcttctatagcacttttagaatgctttataaaaaccatggggatgtcattatattctaacctgttagcacttctgttcgtattacccatcacatcccaacatcaattctcatatatgcaggtacctcttgtcacgcgcgtccatgtaaggagaccacaaaacaggctttgtttgagcaacaaggtttttatttcacctgggtgcaggtgggctgagtctgaaaagagagtcagtgaagggaga

SEQ ID NO: 181154 - DNA, 601 bp, Human
ctggcagcgcctgtgtgtgtctcagtctatgatgcactgtggccctggttctgttcccagtgcaaatatgggatgtctgttgaaaaattgtccatccttctcttcgttagtgaggtcatagagaattgatttgtgtacagtttgtacaaatggcttttaatatatttcagcctcaaaagacaaataggtcttccctctgccctggggcaggagtgcaggtcctcaatgaaggaacttgggcacctctgagtaaggaaagagctgtgccttgggagggctattgatttgctaatttgggccrtgtcccctccctttcctgggtccatttccttgtctctgaagtgagcgtgttgggttggaagacccctggttccccagttctgagaacatgaatgaactacacagtccatgatgactggtgtggctgcctggatttgtgtgtaacagacagatggtgatggcggctagagccacgtggggcggggagcgccactgtcactcacgcacctttccctttctctcccggttcaagtataacgcagacaaggccatcgtggacagtggcaccacgctgctgcgcctgccccagaaggtgtttgat

SEQ ID NO: 181155 - DNA, 601 bp, Human
ttttcatattgtgtatttgtatattttatatgtaatagtataggtgtaatatgtaaatatattttatatgtatttaaaatctttatattttgaagggttttgtttcaactattacttgttaatttcacagtccctttctttgatgttagcaaatagtaccttcatgaacctcagaggacttggatctgaatgtgcaatgccctctagtatttcaaataatagttcagttggtatagtatttttttaatctgcaaaaaacaatacttgctaatatagctatgttagagtaaacaataaatcragaataaatttatagcctttgaaacaaaacaaaccaaaaattttactcctttttggctttcatccctgcactggtatcttaacttctgtttgtataaaagaataccattttttcacagaagacaaagaacaatcagccaatctaataattattttatggccatgctctgaaatacaattaaaattatgattgtggacaatatgccttttcgggacctggctgatggtatttctggtgtgaccccaactttccagtcagttcagggcaataaacattggatacaggacagctttggggatg

SEQ ID NO: 181156 - DNA, 601 bp, Human
tacttgctaatatagctatgttagagtaaacaataaatcgagaataaatttatagcctttgaaacaaaacaaaccaaaaattttactcctttttggctttcatccctgcactggtatcttaacttctgtttgtataaaagaataccattttttcacagaagacaaagaacaatcagccaatctaataattattttatggccatgctctgaaatacaattaaaattatgattgtggacaatatgccttttcgggacctggctgatggtatttctggtgtgaccccaactttccagtcagttyagggcaataaacattggatacaggacagctttggggatgaaatagaattaaatttagtgtagtttttgccacttttagctggatgcctggcgaggggttttgtgccctctgagagcctccgtcttctcaactgaggggtggttgtgagttttgggtcaaatgcttggtgtttagtagatgcttggagcttccatgaaacatgcaaccacggcgttgctgctatttgttcagatgcgagaggaacatgacttttggctgcctgagtgttctcatagcatctgggccttccttgtgagatcg

SEQ ID NO: 181157 - DNA, 601 bp, Human
ttgtgagatcgtcagaaagtgtttcctgcacaaagcctgtactgcggccctggcgtggggctgattgtcccgctactctgctgtgatggctgaattcaaagagtggccgataggagcacgtatggtgggtgccttgttaacagctcatagcagaaacgtgacaagcgggagagggctttgggttgtcctgaacttcaaacacctgtaactgctgcgggaagagcggcacgtggatgaaacggacacagagggggaataggcaggaaaggacgcgggctcttttcgaagcagcaggtctcarggcggccagccactggcgcagctgcagctgaagccacggcagagtctccatccttcccactatctgctgaatcagagaaagtggcaggcaacatttttagtgccttaaatttagaacgcttgctcaaaatcagaccctacttaaaataaggagcgataccctcatttcttaaatagtaaaaatgccctcagcagaattaacgggagtatcttccaacttcatatcctgaatggaaaagtctgtccaccatcccgaggacgtgtttgaagcgcagtgtgaaaatccagcacgtcgtggacc

SEQ ID NO: 181158 - DNA, 601 bp, Human
gcaggtctcaaggcggccagccactggcgcagctgcagctgaagccacggcagagtctccatccttcccactatctgctgaatcagagaaagtggcaggcaacatttttagtgccttaaatttagaacgcttgctcaaaatcagaccctacttaaaataaggagcgataccctcatttcttaaatagtaaaaatgccctcagcagaattaacgggagtatcttccaacttcatatcctgaatggaaaagtctgtccaccatcccgaggacgtgtttgaagcgcagtgtgaaaatccagcamgtcgtggaccggccagacccctgtgccgtgagaggcggggcggcggggccgtggggcgctcgcactcccgagctcatcgtggcatgcgctgagccgaaaaccacgaggtagagggaatgagatcacaacatttgtttgcgttgtctaaaattatcctctgatttcattcggtgcctgcgtcaggagggagaaacatgggaaggttgtttgtcttgggcagggaaagcatcacaagggcgcgttgtgtgtctggcttaccgtctctggaccaaagctgtgtttgtttttcttatctaccag

SEQ ID NO: 181159 - DNA, 601 bp, Human
tgctttggttgcctcatctgtaaagtggtgaggataatgctatcacactggttgagaattgaagtaattattgctgcaaagggcttataagggtgtctaatactagtactagtaggtacttcatgtgtcttgacaattttaatcattattattttgtcatcaccgtcactcttccaggggactaatgtccctgctgttctgtccaaattaaacattgtttatccctgtgggcatctggcgaggtggctaggaaagcctggagctgtttcctgttgacgtgccagactagtcatggtttctsatgtgatcttgttttgtctagattccagaattctctgatggtttctggactgggtcccagctggcgtgctggacgaattcggaaacaccttggtcttacttccctaaaatctccatctacctgagagacgagaactccagcaggtcattccgtatcacaatcctgcctcaggtatgaacttggatttgtgctttgctctttttatcatgcaaaagagaaagcactccatgcatgacacgtgtattagatgtcacacctgcattagatctctatcaccacaataatgctgcaaaagacagc

SEQ ID NO: 181160 - DNA, 601 bp, Human
ctccaggagaaattcaggccgacaggagataccacgctctcaggagaggcttgagtaacacgctcagcactgcccttccctcacaccgtaactttgagcaaagcatttagccctgcctgtgtctctttaactataaaggagaaacaataatacctaccaaagacattttcagaagaatgcagtatccttggatgaatggcactgcactgaatgatattacaatgctatgttttcagcatctttaaatcatctttaaaatcatgtgctcttggccgggcgcagtggctcatgcctgtaatcscagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctaaggcaggagagtcgcttgaacctgggaggcagaggttgcagtgagctgagatcgtggcactgcactccagcctggacgacagtgtgagactccatctcaaaaaaaaaaaaaaaaaatcacgtgctcttgatgattacattttggcta

SEQ ID NO: 181161 - DNA, 601 bp, Human
ctaccaaagacattttcagaagaatgcagtatccttggatgaatggcactgcactgaatgatattacaatgctatgttttcagcatctttaaatcatctttaaaatcatgtgctcttggccgggcgcagtggctcatgcctgtaatcccagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctraggcaggagagtcgcttgaacctgggaggcagaggttgcagtgagctgagatcgtggcactgcactccagcctggacgacagtgtgagactccatctcaaaaaaaaaaaaaaaaaatcacgtgctcttgatgattacattttggctagtagagcggcaaaatgtggacattatttcatcagtgtggtgtgtaataatgtcaaaacccagcttgaggacccaggtgtgcactgctgaataaatgtcaggcaccaaggactcgtaagaagcaggaggagaaggcaggcattagggggaaacc

SEQ ID NO: 181162 - DNA, 601 bp, Human
agacattttcagaagaatgcagtatccttggatgaatggcactgcactgaatgatattacaatgctatgttttcagcatctttaaatcatctttaaaatcatgtgctcttggccgggcgcagtggctcatgcctgtaatcccagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctaaggcagragagtcgcttgaacctgggaggcagaggttgcagtgagctgagatcgtggcactgcactccagcctggacgacagtgtgagactccatctcaaaaaaaaaaaaaaaaaatcacgtgctcttgatgattacattttggctagtagagcggcaaaatgtggacattatttcatcagtgtggtgtgtaataatgtcaaaacccagcttgaggacccaggtgtgcactgctgaataaatgtcaggcaccaaggactcgtaagaagcaggaggagaaggcaggcattagggggaaacctcagtcc

SEQ ID NO: 181163 - DNA, 601 bp, Human
ttaaaatcatgtgctcttggccgggcgcagtggctcatgcctgtaatcccagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctaaggcaggagagtcgcttgaacctgggaggcagaggttgcagtgagctgagatcgtggcactgcactccagcctggacgacagtgtgagactccatctcaaaaaaaaaaaaaaaaaatcacgtgctcttgatgattacattttggctagtagagcggcaaaatgtggacattatttcatcagtgtggtgtgtaataatgtcaaaacccagcttgaggacccaggtgtgcactgctgaataaatgtcaggcaccaaggactcgtaagaagcaggaggagaaggcaggcattagggggaaacctcagtccaggtgggtcacagccgggaaggcttgcttggcttcctcaatagcttttaggacccagcactgggcaagctcaggagcagaatgagaggggtt

SEQ ID NO: 181164 - DNA, 601 bp, Human
gggcgcagtggctcatgcctgtaatcccagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctaaggcaggagagtcgcttgaacctgggaggcagaggttgcagtgagctgagatcgtggcactgcactccagcctggacgacagtgtgagactccatctcaaaaaaaaaaaaaaaaaatcacrtgctcttgatgattacattttggctagtagagcggcaaaatgtggacattatttcatcagtgtggtgtgtaataatgtcaaaacccagcttgaggacccaggtgtgcactgctgaataaatgtcaggcaccaaggactcgtaagaagcaggaggagaaggcaggcattagggggaaacctcagtccaggtgggtcacagccgggaaggcttgcttggcttcctcaatagcttttaggacccagcactgggcaagctcaggagcagaatgagaggggtttgggagcatttcatctcatttg

SEQ ID NO: 181165 - DNA, 601 bp, Human
ctgtaatcccagctacctgggaggctaaggcaggagagtcgcttgaacctgggaggcagaggttgcagtgagctgagatcgtggcactgcactccagcctggacgacagtgtgagactccatctcaaaaaaaaaaaaaaaaaatcacgtgctcttgatgattacattttggctagtagagcggcaaaatgtggacattatttcatcagtgtggtgtgtaataatgtcaaaacccagcttgaggacccaggtgtgcactgctgaataaatgtcaggcaccaaggactcgtaagaagcaggargagaaggcaggcattagggggaaacctcagtccaggtgggtcacagccgggaaggcttgcttggcttcctcaatagcttttaggacccagcactgggcaagctcaggagcagaatgagaggggtttgggagcatttcatctcatttgcacatctctgcataagaattcattattgctttcacttataatggtagatattttttggttgtctttgacatgttcagattttttatttttaaaaatccactttgcctgctgttttcctgatttcttactcagcatcacattccacttgctttc

SEQ ID NO: 181166 - DNA, 601 bp, Human
cagaaaagagtcaattcgaaagcaattactttaaactttgtctatacccaacactattttccaaaagcccatgggctgaatcctatgtggcctgttaaaaaacagcagctggcagcccacaggggagctctaaggtttcttcacagcttctactttatccctacttgacctgctcttcagtgtggtcacatggcagcccctccctgctggtctcctctcagtcttttctgctccctccaaaatcacccctcacagtccctcaaaccccctacagccagaaggcccaggactctgtgtattmgtgtgtctgcctgtttcatccaagtctttcttcctgtctctgccctttaaggctaatcattactcacaggaaggttcgttttcttactcattttgcactcttgcttttctccaaacaggggcattttgtcatactcagctgctgtactctctaattgcctgcatttgaattatttgctatccaaaagccaagaaattgttactgctggtaggatattgatttgctcactgattgtgttcaggtttgacccatttccccacatactcttggctccagggatatcaatggccgactcatctt

SEQ ID NO: 181167 - DNA, 601 bp, Human
cctttaaggctaatcattactcacaggaaggttcgttttcttactcattttgcactcttgcttttctccaaacaggggcattttgtcatactcagctgctgtactctctaattgcctgcatttgaattatttgctatccaaaagccaagaaattgttactgctggtaggatattgatttgctcactgattgtgttcaggtttgacccatttccccacatactcttggctccagggatatcaatggccgactcatcttcatttaacactgcacagcacctgtgggaactggccctcctgaayagcagaactgctgacccacagatgctgtcttctctctgatgttgattacttcttcctcttttcactgaggaaattgtcctgcctccgtcaggctgcctacttttaaaactctgtctgcccgaggggcgcatgatgagctctgggccagctaggagccattgcagtggatcccaagagacgaggacagtgaggacttggcctgagttgggcgagggagtgatttgattccgcttcggtttcacaggaaggctcacaagggtctggttacagtctccatgcaggctaagagagaaaaggact

SEQ ID NO: 181168 - DNA, 601 bp, Human
caagaaattgttactgctggtaggatattgatttgctcactgattgtgttcaggtttgacccatttccccacatactcttggctccagggatatcaatggccgactcatcttcatttaacactgcacagcacctgtgggaactggccctcctgaatagcagaactgctgacccacagatgctgtcttctctctgatgttgattacttcttcctcttttcactgaggaaattgtcctgcctccgtcaggctgcctacttttaaaactctgtctgcccgaggggcgcatgatgagctctgggycagctaggagccattgcagtggatcccaagagacgaggacagtgaggacttggcctgagttgggcgagggagtgatttgattccgcttcggtttcacaggaaggctcacaagggtctggttacagtctccatgcaggctaagagagaaaaggactggcccagcactatagggcctgagtaactgggtgaatcatgaatttactgagacagagaactgtgggagaggtctgatttggggggaacagccagcattcaggttttacaggttacacgggaaatgccgattgagaggtgggcagg

SEQ ID NO: 181169 - DNA, 601 bp, Human
tttgctcactgattgtgttcaggtttgacccatttccccacatactcttggctccagggatatcaatggccgactcatcttcatttaacactgcacagcacctgtgggaactggccctcctgaatagcagaactgctgacccacagatgctgtcttctctctgatgttgattacttcttcctcttttcactgaggaaattgtcctgcctccgtcaggctgcctacttttaaaactctgtctgcccgaggggcgcatgatgagctctgggccagctaggagccattgcagtggatcccaagrgacgaggacagtgaggacttggcctgagttgggcgagggagtgatttgattccgcttcggtttcacaggaaggctcacaagggtctggttacagtctccatgcaggctaagagagaaaaggactggcccagcactatagggcctgagtaactgggtgaatcatgaatttactgagacagagaactgtgggagaggtctgatttggggggaacagccagcattcaggttttacaggttacacgggaaatgccgattgagaggtgggcaggcaggcggacacaagcatgtggcaatggtggc

SEQ ID NO: 181170 - DNA, 601 bp, Human
agaaaccaggatagcatgagaaagtcaagaggatagataaaccccataagcttgaaaatgtcttcagacttcacggtttgcttgaaacggagtgctcacaccacacacggcttaatgggaggattaggtatttctgactgagagtccaagcctgcaaggcagaggcaaatcacagaagtgggcatgagattgaattgccggagacaagtggaggaagagcctgaatcagaaaagtggtcaggagaacggcagcctttcaaaacaagatgtcaagagactgaaaaaaaaatggtacattggrtttgaagtcaggagcagaatggaattccaaagttgtgctggtgatatgtgaaaggagagaaaaattaagtgtgaggtcaaaaaagaatcgatgacaatgaggtagaatagaacaaaatttgggaatcgatagggaaatacaagatcaccatgtggttgaaggaaagggggttttgtaggaatttgatggatatgagacgctgttggaggacaggtgagattgctgggccatcctggaagcctcaactcagaccttcactctgatctcaacccaggtgaagagctgccaggatgaggtaca

SEQ ID NO: 181171 - DNA, 601 bp, Human
tgtaggagctggttccaagctcactgttgtggtggcaggagccctgcttccctcaccatttggacctcactccaggactgcctgatgtcctctggtcagccctgaacatgtgatccgagagagcatgacggggcacccaggatagaaaccccaggttttcatcacctaatcttggaagcagcatgttctcactgctgccccactccgttggtcgcacagaatgaccctgatatgatgtgggaggggacgacgcaggtaaatgccaggagtcatccgcagtcatcttggaaacatcctaccrtatacttatcacaaaacctaggttggttgatttgtttgtttggtttatttttttttatttttaaatttataggaatgctgtggtagtgtgtatcctttgtcaactcgactttattgtttgacattacattttatagattttccatattgatatgagtcctaggttatttgttttgactgcatactatctcactttatgaatgtacccagattacccatttttatcttaattaacatttggattatttctgtattggcaattataaaccgtactgcagtgaacgtctttgtgtagatgaat

SEQ ID NO: 181172 - DNA, 601 bp, Human
cacaagaggctgaggcaggaagatcacttgaggccaggaggtcaaggctgcagagagccatgatcatgtcactgcactccagcctgggagacagagcaagactctgactctaaataaataaataaatatgccagttaacttttctatagtgttgtgtaaaattttattgtgacttggattttctttatcttctttttagtttttatttaatttaaaaggctaggtaatatttagaaggtacgatatagcacatagtcccactccctcagaggtaatcatactaatgcctaaagtccttccttttttttttttttcaagcctcatagtttattatatgggtgcacctaatttatttaaccagttcattattgataggcatttaggttgttttaagtcttttgttgttacaaataacactgcagtgaacatcatttatatatatcatttgcatatatgaaagtatacatctaggttaaattattagaattgctgagttaaaaggtatacatatttgtaattttaatgaatatcacttcgttaccttccatagagcttatattcatcgatacctggccataccatctcttgtaatgtagatgat

SEQ ID NO: 181173 - DNA, 601 bp, Human
taaataaataaatatgccagttaacttttctatagtgttgtgtaaaattttattgtgacttggattttctttatcttctttttagtttttatttaatttaaaaggctaggtaatatttagaaggtacgatatagcacatagtcccactccctcagaggtaatcatactaatgcctaaagtccttccttttttttttttttcaagcctcatagtttattatatgggtgcacctaatttatttaaccagttcattattgataggcatttaggttgttttaagtcttttgttgttacaaataayactgcagtgaacatcatttatatatatcatttgcatatatgaaagtatacatctaggttaaattattagaattgctgagttaaaaggtatacatatttgtaattttaatgaatatcacttcgttaccttccatagagcttatattcatcgatacctggccataccatctcttgtaatgtagatgataacctacttggaaattttggtcatctgacaggtgaaaaatgatgatctcggtgtagttttaatttgtgtcactttctatgagtgagattgagtttcttttcaatgactaaggtc

SEQ ID NO: 181174 - DNA, 601 bp, Human
ataaatatgccagttaacttttctatagtgttgtgtaaaattttattgtgacttggattttctttatcttctttttagtttttatttaatttaaaaggctaggtaatatttagaaggtacgatatagcacatagtcccactccctcagaggtaatcatactaatgcctaaagtccttccttttttttttttttcaagcctcatagtttattatatgggtgcacctaatttatttaaccagttcattattgataggcatttaggttgttttaagtcttttgttgttacaaataacactgcaktgaacatcatttatatatatcatttgcatatatgaaagtatacatctaggttaaattattagaattgctgagttaaaaggtatacatatttgtaattttaatgaatatcacttcgttaccttccatagagcttatattcatcgatacctggccataccatctcttgtaatgtagatgataacctacttggaaattttggtcatctgacaggtgaaaaatgatgatctcggtgtagttttaatttgtgtcactttctatgagtgagattgagtttcttttcaatgactaaggtcactgttt

SEQ ID NO: 181175 - DNA, 601 bp, Human
ggcagaatttcccggctcctttcaccaatgggcaaggtttgcacaggcatcttgaccccagtgcctacttccttggtgcccagggtcaagtctctcacccctcctggtcgtgggaaccccagccttagggcccatttctggttgaggaatgtctcttacttctggactcagctatagagttaaaaagttatattttatcctcattcctctttgttgcagcaggaagaggttctaccttcacaccagtcactgtttgaggaccccacatctttggaagctgcccttctctcacagtgtttgggtgtgtgtgtgtgtgtgtgtgtgtgtgtgtgttcatggtcatttgtgtttgtccgatgacacttagcctaagggttggggtggggggagcagtgagtgggagctccttgattagaatctcctgggacactttttcaaaatacacctggtcaacatcctcacgcccttttccagcgaaggcacagcaggatggcggtgggtgggaaggtgatgggtattttggaaaaagttccccagatgcttctcttatgcttcccctgcctctcctcagcccactcccacccctgctgagaatcattac

SEQ ID NO: 181176 - DNA, 601 bp, Human
aaaaaatctggctctgggtccagaacccctatcctgaaactccagaatgtttttctaagtaaaccatgcctactcagaaagcatctcagtaccagataatcagtgtggcgggacagttctcattattttgtatgctatagggaaaaagacctgaccattataatttttatccttggtaaaattacagatcttccacaggcactcattatcaaccagatcctgacctttcagagaaaatacacaattaaaattgtaactcgagacattgatgaaagagttaaaagtaacagtttagtaacakcggacacttacgtagcaccgatcttagcccaggactgtactaagtgcttaacatctattaacttgattgttcttacaagactgactggtaggggctgttattaccttcattttatagatgacaaaactggggggcaaagaagttaagtaacttggcccagatcacacagcttgtatgtgggagctaggattggaaccccagaagtctggccccaggttcatgctctcacccactgcatacaatggcctctcataaatcaatccagtataaaacattagaatctgctttaaaaccatagaa

SEQ ID NO: 181177 - DNA, 601 bp, Human
agtccttggacatatattttgttttttatttctcctggataaacacctaggagtagaatcgttgagttacataacatgtatgttttactacttaaaaagctgccaaactcattttcaaagttggctttatcatgtcacattcctgccaacagtgtatgaaagttccagttgttaaacatcctcaccaacatttggtatggtcagtattttcattttaataggtattaatatttagcggtctcatcgtggctttaatttgcatttccctaatgactaataatcctgaatatcttttcatgtrcttttttgccattcatgcatctttttaaatgaaatgtcttttcaaatgttcttgcccatttttgtatagggttgtttgttttctcattgagtcctcagagttatttatatatgaagaatacaagtcctttatcagaaatttggctttcaaatatttttgccaagtctttttagtctgttaatattttctattaaagaggagcagttcttacttaattttgataaaatccattttttttccttttacaaattgtgcttttgggtactatagctaagaaatttttcgcctaaccccaggaca

SEQ ID NO: 181178 - DNA, 601 bp, Human
gtgtttaaccagtaacacaacaaagaaaactatttttctttttgtctcatttgttacattttttcccttttttccttttttgctgccttcttttggattattttctatttctttatatctccttggctagtttattagctataactctatatcgtgaaattttagtggttgctttagaatatgtagtgtaaattttttaactgaccacagtctaccacttcatatagtctaagagccttccaacaatagacttccatttcttgccttcggtcctttgtgctattgtcatccattttacctrtgcctatattataagccacccagcacattgttataatttttgatttaattgattatctttgtaaatatttaaaattaaaagtaaagattttataactactatatacttcccgcttctggtgttcatcattcttttgtgtagattcaagtttccttctgatgtcctttttcttctgcttgaagaactttctgtagtgaaaatctgtgatgtgttctctcagcttgtgtatgactgaaaatatttttatttcttcttcatttttaagatatttttgctgggtatagagttctcggttgacag

SEQ ID NO: 181179 - DNA, 601 bp, Human
gtctcatttgttacattttttcccttttttccttttttgctgccttcttttggattattttctatttctttatatctccttggctagtttattagctataactctatatcgtgaaattttagtggttgctttagaatatgtagtgtaaattttttaactgaccacagtctaccacttcatatagtctaagagccttccaacaatagacttccatttcttgccttcggtcctttgtgctattgtcatccattttacctatgcctatattataagccacccagcacattgttataatttttgmtttaattgattatctttgtaaatatttaaaattaaaagtaaagattttataactactatatacttcccgcttctggtgttcatcattcttttgtgtagattcaagtttccttctgatgtcctttttcttctgcttgaagaactttctgtagtgaaaatctgtgatgtgttctctcagcttgtgtatgactgaaaatatttttatttcttcttcatttttaagatatttttgctgggtatagagttctcggttgacagggcttcttctacccccagtactttaaagatgttactctattgt

SEQ ID NO: 181180 - DNA, 601 bp, Human
atctccttggctagtttattagctataactctatatcgtgaaattttagtggttgctttagaatatgtagtgtaaattttttaactgaccacagtctaccacttcatatagtctaagagccttccaacaatagacttccatttcttgccttcggtcctttgtgctattgtcatccattttacctatgcctatattataagccacccagcacattgttataatttttgatttaattgattatctttgtaaatatttaaaattaaaagtaaagattttataactactatatacttcccgcttytggtgttcatcattcttttgtgtagattcaagtttccttctgatgtcctttttcttctgcttgaagaactttctgtagtgaaaatctgtgatgtgttctctcagcttgtgtatgactgaaaatatttttatttcttcttcatttttaagatatttttgctgggtatagagttctcggttgacagggcttcttctacccccagtactttaaagatgttactctattgtcttctagtttgcattgcttccaacatgaaatcatctgtaatccttattattattcatttgtacataatatttc

SEQ ID NO: 181181 - DNA, 601 bp, Human
ccaacaatagacttccatttcttgccttcggtcctttgtgctattgtcatccattttacctatgcctatattataagccacccagcacattgttataatttttgatttaattgattatctttgtaaatatttaaaattaaaagtaaagattttataactactatatacttcccgcttctggtgttcatcattcttttgtgtagattcaagtttccttctgatgtcctttttcttctgcttgaagaactttctgtagtgaaaatctgtgatgtgttctctcagcttgtgtatgactgaaaayatttttatttcttcttcatttttaagatatttttgctgggtatagagttctcggttgacagggcttcttctacccccagtactttaaagatgttactctattgtcttctagtttgcattgcttccaacatgaaatcatctgtaatccttattattattcatttgtacataatatttcttttttctctctccttgcttttaggaaattttctctttatcactggttttcagcagtgcgctattataatctatgtcatgtttcttgtgtttggggtcctttgggcttcttgggtctgtgggt

SEQ ID NO: 181182 - DNA, 601 bp, Human
tgtctctatttaacatgtttaacattttctctggcatcctgagtagaatacagttataataaatatcttgatatcctgcctgctaattctatcatctgtgccatttcttactaagttccaattgattgattttgctccctattatgaactgtgttttcctgcttctttgcataattagtgctgtagaatcaatgtttatgtcctgccaaaattcttatgttgaaacctatcgggggaacctgcccccgataattcaacattatttcacgtaggttcttttctatttccttaagtgtcagcyggtctgagaaataaagggaaagagtacaaaagagagaaattttaaagctgggtgtccagggaagacatcacatgtcggcaggttcgtgatgccccctgagctgcaaaaccagcaagtttttattagtgattttcaaaggggagggagtgtacgaatagggtgtgggtcacagagatcacatacttcacaaggtaataaaatattacaaggcaaatggaggcagggcaagatcacaggaccagggcgaaatcaaaattgctaatgaagctttgggcacgcattgtcattgataacatctta

SEQ ID NO: 181183 - DNA, 601 bp, Human
gtgccatttcttactaagttccaattgattgattttgctccctattatgaactgtgttttcctgcttctttgcataattagtgctgtagaatcaatgtttatgtcctgccaaaattcttatgttgaaacctatcgggggaacctgcccccgataattcaacattatttcacgtaggttcttttctatttccttaagtgtcagccggtctgagaaataaagggaaagagtacaaaagagagaaattttaaagctgggtgtccagggaagacatcacatgtcggcaggttcgtgatgcccccygagctgcaaaaccagcaagtttttattagtgattttcaaaggggagggagtgtacgaatagggtgtgggtcacagagatcacatacttcacaaggtaataaaatattacaaggcaaatggaggcagggcaagatcacaggaccagggcgaaatcaaaattgctaatgaagctttgggcacgcattgtcattgataacatcttatcaggagacagggtttgagagcagacaactggtctgaccaaaatttattaggcggaaatttccttgtcctgataggcctgggagcgctatgggagac

SEQ ID NO: 181184 - DNA, 601 bp, Human
ctgttttcctctgattttaaaaccattcttttcaggtcattatcgcattgttattttgactttttctttcctcagtcaaaaagggtattatttggcagctctgaagatcttgaggctttagttacagaaaaatcaaattcttagcagtgttattttctggtgccaaaatattcatttctgtgattaaatataggaaaaatgggtaatgaggcctatttcttttccgtattgcaagtaaagcttaagatcccatattcctgaaaggggcagagaagcctagtgtaggcaaaggaagtctacrgataatccacaaaccggctttaagaaatcatctcaacttccttcttggtttgaagttattcaagagtctctagcagaagtcaccgggtgaattttaactgtttctctttgtcaccagtgatgtcatgaattaggtgttgcattcacttactgctcctggctgttgatgagacctaggataagagtggggcagggagggtctctcaagccagcctgacccccggaggtctcacaacccactaagactatgagtcaggttgatatgaggtccctatctgttgtagaatccatggtagggagt

SEQ ID NO: 181185 - DNA, 601 bp, Human; identical to SEQ ID NO: 39603

SEQ ID NO: 181186 - DNA, 601 bp, Human
caagaacattctccctacctctcaaattatgcacagacgacaaccgacccaccgaatttaacacgggcggctctgcgtccttcccattcgtctttgttaccttgaacactcctgctaggtaggtacaggcaggttccattctgacttttggactgggaaactggggtgcaggagggccccatggcacggccacagaacttgaatgcaaggcccttccctagcgggtcggtctcgaaattaagtcagctaaaacgagagtgtgcggcgaggaagcgctgggcggacggatcaacaccccggrccccgtgccggaccccactgccaggcccgagccccggagctccaccgcgcaagcgccgggcgcccgggaagcctcgcccgagccaagccgaagcttccgaccgaaataattacagtcttacaccaatttgtgttccaacgtaaattactaagtaagtcgaacggaggctaactccactcacaaagcccagaggcccacatggcaatttttctaagccctgcgcagaccgcagcgccccggtgggtcccgggcgggccggacgcgcctcccaagggcgcgggtccgaggcgcaaggcgagc

SEQ ID NO: 181187 - DNA, 601 bp, Human
aggtaaaatacaagcatagcttccatgtagaaggtaagcttcattaaaggataaataattaaaacgtgctaaattgagccttacatatgaaccatcaaaatcaactgtaaacagtgaaatctacaacaacaaagaggtactgttcaagaacattctccctacctctcaaattatgcacagacgacaaccgacccaccgaatttaacacgggcggctctgcgtccttcccattcgtctttgttaccttgaacactcctgctaggtaggtacaggcaggttccattctgacttttggactgggaaactggggtgcaggagggccccatggcacggccacagaacttgaatgcaaggcccttccctagcgggtcggtctcgaaattaagtcagctaaaacgagagtgtgcggcgaggaagcgctgggcggacggatcaacaccccgggccccgtgccggaccccactgccaggcccgagccccggagctccaccgcgcaagcgccgggcgcccgggaagcctcgcccgagccaagccgaagcttccgaccgaaataattacagtcttacaccaatttgtgttccaacgtaaattactaagtaag

SEQ ID NO: 181188 - DNA, 601 bp, Human
tgcaaagggagaggacaggcctctcatccacagaggcgtcacagtcacggtatggggctgcagcacgcactgccaccccagacaccggcatcacaacgattctgcagaaaagctggggcttagcggccccatcactcaatcagccgagcattcgaaaccaggtctgccaggcagcaaaggctaaatggtattttaaaaaggtgtcgcttctgagtgtatgtgttcaaggaatctctaggtaaaatacaagcatagcttccatgtagaaggtaagcttcattaaaggataaataattaaaaygtgctaaattgagccttacatatgaaccatcaaaatcaactgtaaacagtgaaatctacaacaacaaagaggtactgttcaagaacattctccctacctctcaaattatgcacagacgacaaccgacccaccgaatttaacacgggcggctctgcgtccttcccattcgtctttgttaccttgaacactcctgctaggtaggtacaggcaggttccattctgacttttggactgggaaactggggtgcaggagggccccatggcacggccacagaacttgaatgcaaggcccttccctag

SEQ ID NO: 181189 - DNA, 601 bp, Human
aaagtggtgtgaaaattttcgctgatgattaaagctcacacacatccccaagagataaaacgaatgcccctatggagagggttccctttcagaacctaaccactggctggtattcaaagtggtttggatttcatcaaaataaccacagcacccctcctggcctgagaagttcccagaatctgaggcaggggagaaaaagtgcacagcctgggccagcatctcacctttgaactagtggtgatttgatgacactcgtcaccactctactggtgtttccaagaaacactggatttgagggttwcggcaaaaagccaccactatctctgctgtgtagtctcctagccaaggacgaaaatgcaaagggagaggacaggcctctcatccacagaggcgtcacagtcacggtatggggctgcagcacgcactgccaccccagacaccggcatcacaacgattctgcagaaaagctggggcttagcggccccatcactcaatcagccgagcattcgaaaccaggtctgccaggcagcaaaggctaaatggtattttaaaaaggtgtcgcttctgagtgtatgtgttcaaggaatctctaggtaaaata

SEQ ID NO: 181190 - DNA, 601 bp, Human
cgctaagtgtctgggggctgggcggccccccaacctttcctgcacagaaaagcaagctcacatggcctggcgcagcctgctcatcaaacaagccccgagcaggtgctgtggccaagggccggctgaaggcctggcccaggggagctgcagggagccaggagaccccagaccaccttgagaggcaagcagcgttggccagtgaaaatcagcctcacctgcacctgtacctgtggtggctcctatgtaacaagtggactagaccatcactgacccccagcagcctggaagaggcccagacccrtgtgtcaggggtgagaggggctgtccctccgagaagagaagcaagacttaggcagaaggggtacagggccgggggctgcacacaaagaccctaggagaatcctatgccccaattcagggaacatcttgcaaatatgaggggctggggtgggaggcagctcgtcagaaaagcactgagaaatgtggcagggcaagtggcacagcgactacttcaaggcctaggtacaaccttgtgagactgcaatgcaaccagctcctggagcacagtgggactgatgtacattcctaacaagaacctcag

SEQ ID NO: 181191 - DNA, 601 bp, Human
taggccctgtgacccccacaatgagggtcagccagggaggccagctgcctctccaaagccaccccacaggaccctccgaggcaccgagccccatgatgaaggtaatctcagatcaatggggtgtcacctgtgaactcccaggagggccccctggcaggcacttcctgtccctgggagcctcgctaagtgtctgggggctgggcggccccccaacctttcctgcacagaaaagcaagctcacatggcctggcgcagcctgctcatcaaacaagccccgagcaggtgctgtggccaagggccrgctgaaggcctggcccaggggagctgcagggagccaggagaccccagaccaccttgagaggcaagcagcgttggccagtgaaaatcagcctcacctgcacctgtacctgtggtggctcctatgtaacaagtggactagaccatcactgacccccagcagcctggaagaggcccagacccgtgtgtcaggggtgagaggggctgtccctccgagaagagaagcaagacttaggcagaaggggtacagggccgggggctgcacacaaagaccctaggagaatcctatgccccaattcaggga

SEQ ID NO: 181192 - DNA, 601 bp, Human
atccccttagctgggggctggtaggggaggaacggggcctttgggatcactttattctctccaaactggtcacggcacccatccctacaccccaccctaggccctgtgacccccacaatgagggtcagccagggaggccagctgcctctccaaagccaccccacaggaccctccgaggcaccgagccccatgatgaaggtaatctcagatcaatggggtgtcacctgtgaactcccaggagggccccctggcaggcacttcctgtccctgggagcctcgctaagtgtctgggggctgggcrgccccccaacctttcctgcacagaaaagcaagctcacatggcctggcgcagcctgctcatcaaacaagccccgagcaggtgctgtggccaagggccggctgaaggcctggcccaggggagctgcagggagccaggagaccccagaccaccttgagaggcaagcagcgttggccagtgaaaatcagcctcacctgcacctgtacctgtggtggctcctatgtaacaagtggactagaccatcactgacccccagcagcctggaagaggcccagacccgtgtgtcaggggtgagaggggctg

SEQ ID NO: 181193 - DNA, 601 bp, Human
agctccgaaggagaaacctagcaactaccttcgggaaaacgcagccggaaaatgtgtttcatcatctgttagctgatgcctctcagcgaggccttctgcacaccaatccaattatgttcccagggagcctcggaggggttcccacacggctatttttaaaactgacaagaaacgggcttgtccaatcgtcagctctgttgttacaaacctggggtttgctcaggctcgccccgaccagccagggctgaatgtggcaggagcgtctcccagccggcgccccgcaggcactggcttcttctgrgcatccccttagctgggggctggtaggggaggaacggggcctttgggatcactttattctctccaaactggtcacggcacccatccctacaccccaccctaggccctgtgacccccacaatgagggtcagccagggaggccagctgcctctccaaagccaccccacaggaccctccgaggcaccgagccccatgatgaaggtaatctcagatcaatggggtgtcacctgtgaactcccaggagggccccctggcaggcacttcctgtccctgggagcctcgctaagtgtctgggggctgg

SEQ ID NO: 181194 - DNA, 601 bp, Human
gctgcggtttcccctgcaagcacgcatcctggaaagggggaaagaacggccccgggacatggtcttgtgcaagcggagaagcaataaacgaagggaaaagtgagaagcagggaggtgggggagacggtgagaccgctcaggtaacaaagagctccgaaggagaaacctagcaactaccttcgggaaaacgcagccggaaaatgtgtttcatcatctgttagctgatgcctctcagcgaggccttctgcacaccaatccaattatgttcccagggagcctcggaggggttcccacacggctrtttttaaaactgacaagaaacgggcttgtccaatcgtcagctctgttgttacaaacctggggtttgctcaggctcgccccgaccagccagggctgaatgtggcaggagcgtctcccagccggcgccccgcaggcactggcttcttctgagcatccccttagctgggggctggtaggggaggaacggggcctttgggatcactttattctctccaaactggtcacggcacccatccctacaccccaccctaggccctgtgacccccacaatgagggtcagccagggaggccagctgcctct

SEQ ID NO: 181195 - DNA, 601 bp, Human
gcgagaaatacgagaaatatcatcacaccaatcatctctaaaaggaacttctaaagaagtcccaaggttcttctccaggctcagaaattccaaagacctgtggaccaggccagctgcggtttcccctgcaagcacgcatcctggaaagggggaaagaacggccccgggacatggtcttgtgcaagcggagaagcaataaacgaagggaaaagtgagaagcagggaggtgggggagacggtgagaccgctcaggtaacaaagagctccgaaggagaaacctagcaactaccttcgggaaaaygcagccggaaaatgtgtttcatcatctgttagctgatgcctctcagcgaggccttctgcacaccaatccaattatgttcccagggagcctcggaggggttcccacacggctatttttaaaactgacaagaaacgggcttgtccaatcgtcagctctgttgttacaaacctggggtttgctcaggctcgccccgaccagccagggctgaatgtggcaggagcgtctcccagccggcgccccgcaggcactggcttcttctgagcatccccttagctgggggctggtaggggaggaacgggg

SEQ ID NO: 181196 - DNA, 601 bp, Human
tgtagatttattactattatcattattttaacacgtggagagatgccgaatccagcctaggtgctggggtggcggccagggagcacagaacatcacacagtcacattcgcaccgtctccaaatcgcatttcttactgttgacagtgaagtcaacgtttctgggttgaccagaagcccctctcgtcggtgttaattaaaacacaacctaaaaactgtgccttgctccaagcgcagctacgcttaggcacagttcagagggggtggcatcctattcccctctccttcgctgctggtgaaagcrttgctaattctgcttccacgcaggaacgggaaaagccccccctcccccgcaaaagtgtcctgggtcctgttttgggttccacatgaaaaatctctgggcattaattaggattaacttggggttcaactttttaaagatacggtgagtagcacttagatgaattcggttttctcctcatttagggctagccaaagtgtatttcgccctcccagggaggccaatggagtagcgagaaatacgagaaatatcatcacaccaatcatctctaaaaggaacttctaaagaagtcccaaggttctt

SEQ ID NO: 181197 - DNA, 601 bp, Human
cagcctggatttcgctcagaagcaccagcatgtcctcagaaactttccacactgtttaccatccagtaaccactgggccaaaacccacacgaccccgccttccagcccctctccaggtgctccctaggcgcacatctgggaaactccagcggctttaggaagctccagcccttctggggtcgggtgtcgcccggcggcatttgcaattcaataagcctgaaagggcctctttgcaacaagctgcaagaagaggcttttctgatcagggaggttaagaagtgctcaggtactcgaagcacaraaagaacccaccaattgcttttgagcaatggcactattttttttaatacatttttttctcctaagcagtgtttctggcttattttaatgattctggcttattctgatgaccacacaaaaggaactgtagatttattactattatcattattttaacacgtggagagatgccgaatccagcctaggtgctggggtggcggccagggagcacagaacatcacacagtcacattcgcaccgtctccaaatcgcatttcttactgttgacagtgaagtcaacgtttctgggttgaccagaagcc

SEQ ID NO: 181198 - DNA, 601 bp, Human
tggcttggggtagacaggattccagctgaggaagggggtcccgggaccgccctgtgggagatctgaggcccaggagtgggggtggggcggctcccttgcctaccagcctggatttcgctcagaagcaccagcatgtcctcagaaactttccacactgtttaccatccagtaaccactgggccaaaacccacacgaccccgccttccagcccctctccaggtgctccctaggcgcacatctgggaaactccagcggctttaggaagctccagcccttctggggtcgggtgtcgcccggcggyatttgcaattcaataagcctgaaagggcctctttgcaacaagctgcaagaagaggcttttctgatcagggaggttaagaagtgctcaggtactcgaagcacagaaagaacccaccaattgcttttgagcaatggcactattttttttaatacatttttttctcctaagcagtgtttctggcttattttaatgattctggcttattctgatgaccacacaaaaggaactgtagatttattactattatcattattttaacacgtggagagatgccgaatccagcctaggtgctggggtggc

SEQ ID NO: 181199 - DNA, 601 bp, Human
actctccctgccccgggctctttctgcagaacggagaccccatttaccttactttaaaagaaacaacaaacaaacaaaaaagggccactgctgctagttggctcctgaaagcggatcccggctagaatctcctaacggagtccaccccagctttgcgcaactgcctgaagggagcccggcacgacttcccccttccatgggccacacatttgagggcattttctcgaggaaaatcagctgtcctggaaaaaaaaagtcattgtttccgtggacaaaagtgttgtgacagcatgatccaaamtggcttggggtagacaggattccagctgaggaagggggtcccgggaccgccctgtgggagatctgaggcccaggagtgggggtggggcggctcccttgcctaccagcctggatttcgctcagaagcaccagcatgtcctcagaaactttccacactgtttaccatccagtaaccactgggccaaaacccacacgaccccgccttccagcccctctccaggtgctccctaggcgcacatctgggaaactccagcggctttaggaagctccagcccttctggggtcgggtgtcgcccggcgg

SEQ ID NO: 181200 - DNA, 601 bp, Human
cgtgtgaggcacaccctcctcgccggagggttttgaggaaatgacaattcgggtgtttagaggccagccattcgcaagggtcatttttccacattaagtagacattctgagagtgaactctctaagccaaagctgactgataataaacacgtattctgagaacaatgtcaatcaaaggaaggctgagtagcttattaagtggaagctctgagccactccacaaatagtgttttcttttatttgcccaaagggcttaatacataaaaccccggtgacttctgattgcagagtgagctcattrgcgactctaacagctacgggctggcagcagtgcacacccctccccagcgcaccgagttcagcaagtactttactctccctgccccgggctctttctgcagaacggagaccccatttaccttactttaaaagaaacaacaaacaaacaaaaaagggccactgctgctagttggctcctgaaagcggatcccggctagaatctcctaacggagtccaccccagctttgcgcaactgcctgaagggagcccggcacgacttcccccttccatgggccacacatttgagggcattttctcgagg

SEQ ID NO: 181201 - DNA, 601 bp, Human
gacatggtaccagctgctgcttctcttttatgtcttgttaagaatcagagttatgatttgtctgtttccgattgctcaaatgtggccagcttgccgcccctcccctaccagtgtggcctccctcctccggacactctgccccggggcgctggcgaaagtccttccgtaggactcagacccacatccactgtgcaaccgtgtgaggcacaccctcctcgccggagggttttgaggaaatgacaattcgggtgtttagaggccagccattcgcaagggtcatttttccacattaagtagacaktctgagagtgaactctctaagccaaagctgactgataataaacacgtattctgagaacaatgtcaatcaaaggaaggctgagtagcttattaagtggaagctctgagccactccacaaatagtgttttcttttatttgcccaaagggcttaatacataaaaccccggtgacttctgattgcagagtgagctcattggcgactctaacagctacgggctggcagcagtgcacacccctccccagcgcaccgagttcagcaagtactttactctccctgccccgggctctttctgcagaacg

SEQ ID NO: 181202 - DNA, 601 bp, Human
gtccagggagctatggagaatcaagagagatccaaagtcagaagtcagcataggaaagggcccctgagagaatcgggaaggctgagacctgcgcagagtccaggggcacccgggaggccagcagagcggagcagtcgctgtggatccccttgggcttggcaaagcagagaggggaagccagcagagcacacacactctgttggaagaatctgcaggatgggtccattgactgcatgtggaggggagaagcttgcaggacctctctggagctgcaccaggggtcactaggcagctctctacrgtggacgcgggagcaccccaggaggagcagctggggggtgtggggggtgggcaggtcgagtgtgtctgaatacactcaaggagcaaagaatcccactggccttgggaacaagtgaagcaagtatcaggaatgaacgtgaaattattatgagacaaaacttaggggagcacggcctgctttcctagcgctctggttaaatgaccaactaatggaaaacaagatgcccaccagtgtgcagtgctagcctgtgggggtccctgggctgagctgaaagctgccccatcaccagcataccatcgg

SEQ ID NO: 181203 - DNA, 601 bp, Human
caggccacgcaaggcagctggctggggtggcctccagacaattcccccagaatccagcgtccagcccaagtccctgcctataacccagtgtccgctgccacagcagggggctcttctggagctcggacacaggcctgctcctcccagtgacaaacccgggagcaggtgctgggaaatcactcagtggctcccatttcctcgcctgctggtgaatccaaaacagtgccaacagaacgcatccatttcttaatgatctgaccgcccctgcgagagttcagcccctcctaggcttcccttaccrtagtgaaaacactttccctgcaggaaaggccagcaggaacccctggatcctactgtttagctcttgctgtggaaattcccatacatcggacaggtaccaaaggctcggagatctcagcctgtctgccccccaacaatgcaagccctgcagctagggctctgcgtctcaggacatagcccactggttctcaattagaggcaacttcaccccccaagaaacactgggcaatgtctggagagattctggttgtcacaactaaaggatgctactgaacatcctacaatgcataagacagcccca

SEQ ID NO: 181204 - DNA, 601 bp, Human
acactggctgtggctgcttttgcacttcaaaggggagaggagtccttgcaacagaggccctgcggcctgcaaagcctaaaatgttgcctctctaggccttcgtggagaaagctgaccaacctctggtctaaggtcacttccctggtgcagcctgtgttttcacagactagaatcccagtgcaatggtctgtattggcatcatgggtcaaaagtctcagaatgcgttcagagtaagaggctgaatcccacggacgcacgctggccatgcaggatcgagatcagcagccccaaacacagacayggtagaaagcacccaggaagctggctggaatgctggttcccaggcctcactccttgagaatgcattccaggttggggctggaaaatctgtttttttgtttgtttttcttttttgaaacagagtctcgctctgttgcccaggctggagtgcagtggcatgatcctagctcactgcaacctctacctcccaggttcaagtgagtctcatgcctcagcctccagggtagctgggattacaggtgtgccacactcagctaattttttgtatttttagtaaagatgggattttgctgtttgccag

SEQ ID NO: 181205 - DNA, 601 bp, Human
acccaaaacttttccatcatcctcaacaaaaattctgcacccattaaccaataactccttccctcatccccatcctcagtaacctcttttctacattctaggcaaattcatataagcataagcatataaaatttgcccttctgtgtctggcttatttcattaagcatgttttcagggtctattcacactgtaacatatatcaaaacttccttttcatggctgaataatattctgctgcacgaatgtactgcgttttgttcatctgttcgtgggtgcaggccatttccaccttttggctctygtggataatgctgcacatctgcacacattgggggacaaacgcctggagtcgtggctttcaattcttttcgatacatacctaggagcagaattgcttggtcacagtctatgtgtcacattttgagaaactgccaaatggttgcccacagcgtgccaccaccttgtttgtataaataaacttttactggaagaaagtctcactcattcatttaaacactggctgtggctgcttttgcacttcaaaggggagaggagtccttgcaacagaggccctgcggcctgcaaagcctaaaatgttgcc

SEQ ID NO: 181206 - DNA, 601 bp, Human
tccagcaggatgttcgcgggcttgaggtccaggtgcaggagtggcggggccatgcagtgcaggaagttcatgcccaccgccgtctcgtggatgatgcggaaccggagatcccatggcaatggctccgaggccagcagcttttccagggagcccgtctccatgtactccatgaccaggccgacaggttcgcggcagatgccatacacaggcaggatgtagcgaaacttggccatctccatcttcttggcttcttccaaaagctccatgcgctccctgaaaaagttcaaaggcatgaagaatmcgcaatggtcactcagccacaaacatggaacagcaccctggccagaagacgaccagctccagagggctgagcaaatgcctcaagtgcacacacatggggcacacttcaatgtcacatcacgaatgcagggctttccagagtctcagtcctgaggctgctgaaatgtacctatgcatcacagggttatcacaagtgaggaggagggaaattctaatcgttttacaggtagcactgataacacatgtggggggtccacgtgtgtgaataattccacaggcagccatgagccaaggcttgggg

SEQ ID NO: 181207 - DNA, 601 bp, Human; identical to SEQ ID NO: 39604

SEQ ID NO: 181208 - DNA, 601 bp, Human; identical to SEQ ID NO: 39605

SEQ ID NO: 181209 - DNA, 601 bp, Human; identical to SEQ ID NO: 39606

SEQ ID NO: 181210 - DNA, 601 bp, Human; identical to SEQ ID NO: 39607

SEQ ID NO: 181211 - DNA, 601 bp, Human; identical to SEQ ID NO: 39608

SEQ ID NO: 181212 - DNA, 601 bp, Human; identical to SEQ ID NO: 39609

SEQ ID NO: 181213 - DNA, 601 bp, Human; identical to SEQ ID NO: 39610

SEQ ID NO: 181214 - DNA, 601 bp, Human; identical to SEQ ID NO: 39611

SEQ ID NO: 181215 - DNA, 601 bp, Human; identical to SEQ ID NO: 39612

SEQ ID NO: 181216 - DNA, 601 bp, Human; identical to SEQ ID NO: 39613

SEQ ID NO: 181217 - DNA, 601 bp, Human; identical to SEQ ID NO: 39614

SEQ ID NO: 181218 - DNA, 601 bp, Human; identical to SEQ ID NO: 39615

SEQ ID NO: 181219 - DNA, 601 bp, Human; identical to SEQ ID NO: 39616

SEQ ID NO: 181220 - DNA, 601 bp, Human; identical to SEQ ID NO: 39617

SEQ ID NO: 181221 - DNA, 601 bp, Human; identical to SEQ ID NO: 39618

SEQ ID NO: 181222 - DNA, 601 bp, Human; identical to SEQ ID NO: 39619

SEQ ID NO: 181223 - DNA, 601 bp, Human; identical to SEQ ID NO: 39620

SEQ ID NO: 181224 - DNA, 601 bp, Human; identical to SEQ ID NO: 39621

SEQ ID NO: 181225 - DNA, 601 bp, Human; identical to SEQ ID NO: 39622

SEQ ID NO: 181226 - DNA, 601 bp, Human; identical to SEQ ID NO: 39623

SEQ ID NO: 181227 - DNA, 601 bp, Human; identical to SEQ ID NO: 39624

SEQ ID NO: 181228 - DNA, 601 bp, Human; identical to SEQ ID NO: 39625

SEQ ID NO: 181229 - DNA, 601 bp, Human; identical to SEQ ID NO: 39626

SEQ ID NO: 181230 - DNA, 601 bp, Human; identical to SEQ ID NO: 39627

SEQ ID NO: 181231 - DNA, 601 bp, Human; identical to SEQ ID NO: 39628

SEQ ID NO: 181232 - DNA, 601 bp, Human; identical to SEQ ID NO: 39629

SEQ ID NO: 181233 - DNA, 601 bp, Human; identical to SEQ ID NO: 39630

SEQ ID NO: 181234 - DNA, 601 bp, Human; identical to SEQ ID NO: 39631

SEQ ID NO: 181235 - DNA, 601 bp, Human; identical to SEQ ID NO: 29079

SEQ ID NO: 181236 - DNA, 601 bp, Human; identical to SEQ ID NO: 29080

SEQ ID NO: 181237 - DNA, 601 bp, Human; identical to SEQ ID NO: 29081

SEQ ID NO: 181238 - DNA, 601 bp, Human; identical to SEQ ID NO: 29082

SEQ ID NO: 181239 - DNA, 601 bp, Human; identical to SEQ ID NO: 29083

SEQ ID NO: 181240 - DNA, 601 bp, Human; identical to SEQ ID NO: 29084

SEQ ID NO: 181241 - DNA, 601 bp, Human; identical to SEQ ID NO: 29085

SEQ ID NO: 181242 - DNA, 601 bp, Human; identical to SEQ ID NO: 29086

SEQ ID NO: 181243 - DNA, 601 bp, Human; identical to SEQ ID NO: 29087

SEQ ID NO: 181244 - DNA, 601 bp, Human; identical to SEQ ID NO: 29088

SEQ ID NO: 181245 - DNA, 601 bp, Human; identical to SEQ ID NO: 29089

SEQ ID NO: 181246 - DNA, 601 bp, Human; identical to SEQ ID NO: 29090

SEQ ID NO: 181247 - DNA, 601 bp, Human; identical to SEQ ID NO: 29091

SEQ ID NO: 181248 - DNA, 601 bp, Human; identical to SEQ ID NO: 29092

SEQ ID NO: 181249 - DNA, 601 bp, Human; identical to SEQ ID NO: 29093

SEQ ID NO: 181250 - DNA, 601 bp, Human; identical to SEQ ID NO: 29094

SEQ ID NO: 181251 - DNA, 601 bp, Human; identical to SEQ ID NO: 29095

SEQ ID NO: 181252 - DNA, 601 bp, Human; identical to SEQ ID NO: 29096

SEQ ID NO: 181253 - DNA, 601 bp, Human; identical to SEQ ID NO: 29097

SEQ ID NO: 181254 - DNA, 601 bp, Human; identical to SEQ ID NO: 29098

SEQ ID NO: 181255 - DNA, 601 bp, Human; identical to SEQ ID NO: 29099

SEQ ID NO: 181256 - DNA, 601 bp, Human; identical to SEQ ID NO: 29100

SEQ ID NO: 181257 - DNA, 601 bp, Human; identical to SEQ ID NO: 29101

SEQ ID NO: 181258 - DNA, 601 bp, Human
caaatgtgttattagtattgttgaaatctctatatcttttctgattttttttgccatcttctatcagttactaaaaattctccactatgattgtagatatatctatttttccttttggttctatcactttttgctttgtatattttgagtccctgttattgggtgtatatatttagtataggttttgttttctagattaattgaccttattttttataaaacatctgtctttttacctgttaataaatacttcttttcttgcgtgtaccttttttttaatgctaatatagctgtaccagctttttttttttatcattagtgcttacataaagtgtgtgtgtgtgtgtgtttgtgtgtgtgtgtgtgtgtattttttttccctcaacttaagtccttatatttaaagcgtttttctcgtaaagagctagttgggtctagctcttaggtctgtttttttgtttctctgttaaacacaatttctgcctcttaattggagtatttagtctattaacacttcatgttatgacgaatgtgatgaagtgtaacattttgctgtttgttttatgtttgtcacatttctttttcctgcatgtctccattc

SEQ ID NO: 181259 - DNA, 601 bp, Human
ctatcgagtctttttttatgaagtaaaataaatagtcttttttatgtttccccacatattatttgccttttttgaggtctttccctttttcttgcattctgtgttttcatgtaggatcatttcccttcaacctgacaactttatgtttatatttactagtgtgagtctgctgtgtcaaactatgaaatgtgttttgcctacatttttttttttttttttttttgagacggagtctcgctctgtcgcccaggctggagtgcagtgatgcgatctcggctcactgcaagctccgcctcctggrttcacaccattctcctgcctcagcctcccgagtagctgggactacaggtgaccaccaccacgcccggctaattttttgtatttttagtagagacggggtttcaccatcttggccaggctggtctcaaacttctgatctcaggtgatctgcccaccttggccttgatggttttttttttttaattttggaaaaatctccaccattatctcttcatttatttttttctgcctcatcttctgtcttcttttttggggtctccatgtaaacataagttagaatttttgctgctgtttgacatgt

SEQ ID NO: 181260 - DNA, 601 bp, Human
gctgtttgacatgtctcatgctctattcttattttttttttcattttgtgcttcagtttggaaaatttctgttgacctgactcttgaggcgctgatcataaacaagataactgggaaaacaatatgtttgtaaaacaatttcttgagatgtgaaatagtatctatattgtaccaagagtagtcccagctacttgagaggctgaggtaggaggattgctttagcttgggaggtggaggttgccatgagccaggatcatgccactgcactctagcctgggtgacagagggtgacctcatctcaaaaaaaaaaaaaaaaagcgtattcttcaaccctggcattctatcctgcagaaataaaatgtcatcacataagcttgtctgtgcacagacttcttttattgcagcatcggttatggtggtagaaaactggataccaagacaaagtctatcaaagggggatggctgaagaatcaagcggaattcctgctatggaatatcgtatagccattgaaggtagtaaatcagggttctaacagttggagagtttttccagaaggtattgtgtaagaaaagcaaagtgcaggtcaggcgtggtggccca

SEQ ID NO: 181261 - DNA, 601 bp, Human
ctgactcttgaggcgctgatcataaacaagataactgggaaaacaatatgtttgtaaaacaatttcttgagatgtgaaatagtatctatattgtaccaagagtagtcccagctacttgagaggctgaggtaggaggattgctttagcttgggaggtggaggttgccatgagccaggatcatgccactgcactctagcctgggtgacagagggtgacctcatctcaaaaaaaaaaaaaaaaagcgtattcttcaaccctggcattctatcctgcagaaataaaatgtcatcacataagcttrtctgtgcacagacttcttttattgcagcatcggttatggtggtagaaaactggataccaagacaaagtctatcaaagggggatggctgaagaatcaagcggaattcctgctatggaatatcgtatagccattgaaggtagtaaatcagggttctaacagttggagagtttttccagaaggtattgtgtaagaaaagcaaagtgcaggtcaggcgtggtggcccacgcctgtgatgccagcactttgggaagctcaggtgggcagatcacttgaagtggggagttcgagaccagcctggcc

SEQ ID NO: 181262 - DNA, 601 bp, Human
gagtagtcccagctacttgagaggctgaggtaggaggattgctttagcttgggaggtggaggttgccatgagccaggatcatgccactgcactctagcctgggtgacagagggtgacctcatctcaaaaaaaaaaaaaaaaagcgtattcttcaaccctggcattctatcctgcagaaataaaatgtcatcacataagcttgtctgtgcacagacttcttttattgcagcatcggttatggtggtagaaaactggataccaagacaaagtctatcaaagggggatggctgaagaatcaagyggaattcctgctatggaatatcgtatagccattgaaggtagtaaatcagggttctaacagttggagagtttttccagaaggtattgtgtaagaaaagcaaagtgcaggtcaggcgtggtggcccacgcctgtgatgccagcactttgggaagctcaggtgggcagatcacttgaagtggggagttcgagaccagcctggccaacatgatgaaaccccatccatttctaccaaaaatgcaaaaattagccgggcgtagtgacacacgcctgtagtcccagcctctcgggaggctgaggcat

SEQ ID NO: 181263 - DNA, 601 bp, Human
cgggcgtagtgacacacgcctgtagtcccagcctctcgggaggctgaggcatgcgaattgcttgaactggggaggtggaggttgcagtgagccgagattgtgccactgcactccagcctaggcgacagagcgagactccatcctaaaaaaaaagccaaacaaagaaacagcctgtgtgtgtgtgtgtgtgtgtgtgtgtgtatacgtgtacacagggctttgtgtgtgacatgggcatggtggaggtgtggaaggccgcacaccggggggttagtaagggttgcctgggctgggtggatcrgggatggggtggagagcaagcagagggcagtgctgccttagagtgagtcatgctcctggcatagggaaaagcacgaagggtacaaatagacagtaaggtaaaaaaagatgccagcaagtattttaaaaacgcctaaccacacaaagagagggaaatggaagtaacaacagtgatttttacccatgaaattgacagagactaaagtgattggtatctattgagtgagagtgtgggaagattggtggttccctctcagcaagcggtccagggaacacctttctggagagcactgggtggtaa

SEQ ID NO: 181264 - DNA, 601 bp, Human
gcagagggcagtgctgccttagagtgagtcatgctcctggcatagggaaaagcacgaagggtacaaatagacagtaaggtaaaaaaagatgccagcaagtattttaaaaacgcctaaccacacaaagagagggaaatggaagtaacaacagtgatttttacccatgaaattgacagagactaaagtgattggtatctattgagtgagagtgtgggaagattggtggttccctctcagcaagcggtccagggaacacctttctggagagcactgggtggtaaaaccaaaagccacatagtcycagtccatcaggttcacattcagagacttaccctaagaagattaaggtacatacagaatgatttatgttgaaagaagttcatcttaacatgatttagaatagtaaaaactgaaaagtctaaatgtacaagactaggaaactggataggtaagtcctgataattcatagactggatattaaatagtgttagaagtatatttaataagaaaaatgttcagagtttataaagtgaaaaccataggccacaggcttattgtgtgaacccagtgaatgctttgtacttatgttacgtgtccactt

SEQ ID NO: 181265 - DNA, 601 bp, Human
tgctgccttagagtgagtcatgctcctggcatagggaaaagcacgaagggtacaaatagacagtaaggtaaaaaaagatgccagcaagtattttaaaaacgcctaaccacacaaagagagggaaatggaagtaacaacagtgatttttacccatgaaattgacagagactaaagtgattggtatctattgagtgagagtgtgggaagattggtggttccctctcagcaagcggtccagggaacacctttctggagagcactgggtggtaaaaccaaaagccacatagtctcagtccatcargttcacattcagagacttaccctaagaagattaaggtacatacagaatgatttatgttgaaagaagttcatcttaacatgatttagaatagtaaaaactgaaaagtctaaatgtacaagactaggaaactggataggtaagtcctgataattcatagactggatattaaatagtgttagaagtatatttaataagaaaaatgttcagagtttataaagtgaaaaccataggccacaggcttattgtgtgaacccagtgaatgctttgtacttatgttacgtgtccacttttttaaaagtc

SEQ ID NO: 181266 - DNA, 601 bp, Human
aaaaatggaggggttgggggaggctccaaggacctgtgtgggtccaagctgggctctgctgcctcgtggaggtttgtgccatgccatcagctctttccacaggcccctggctgtgcctgcctggggcgctgggcccctggctctgtcctcacactggtttctcttcatggggttgatgatcaccttcaggaagcaaagctgatgaaggacaagggctcctcaccaaatagacactagtggtgcctgtttctgacttcttgctttgatgttctcttttagggtccagataattttttttttyagaaaagaaatgtagagtgaaggtgacagcctttgattatagtagtaaagatgatccaaatagtttgtataataaatacttggacacatgaatctgtatttgaaatttgaaaccatcctaataatatagccaaaaaaaaaaaaaaaaagctccagcgtcctctcctcacgctttccttggctttgagcagggagaagagcctgctgagtgcagtgaggcgggtctcctgcaggagggagtacagccagaggagtttgtggccatcgcggactacgctgccaccgatgagacccaggtagc

SEQ ID NO: 181267 - DNA, 601 bp, Human
gcccctggctctgtcctcacactggtttctcttcatggggttgatgatcaccttcaggaagcaaagctgatgaaggacaagggctcctcaccaaatagacactagtggtgcctgtttctgacttcttgctttgatgttctcttttagggtccagataatttttttttttagaaaagaaatgtagagtgaaggtgacagcctttgattatagtagtaaagatgatccaaatagtttgtataataaatacttggacacatgaatctgtatttgaaatttgaaaccatcctaataatatagccaaaaaaaaaaaaaaaaagctccagcgtcctctcctcacgctttccttggctttgagcagggagaagagcctgctgagtgcagtgaggcgggtctcctgcaggagggagtacagccagaggagtttgtggccatcgcggactacgctgccaccgatgagacccaggtagccacacgtggtggttaatgctttatggctttcagcatgttcagtgtcaaaaggagataaattttgcagacgtcacaccaaagttaaatgaagaggtattcagatgcgtagggccacacaagacctgtgtgtga

SEQ ID NO: 181268 - DNA, 601 bp, Human
ggctttgagcagggagaagagcctgctgagtgcagtgaggcgggtctcctgcaggagggagtacagccagaggagtttgtggccatcgcggactacgctgccaccgatgagacccaggtagccacacgtggtggttaatgctttatggctttcagcatgttcagtgtcaaaaggagataaattttgcagacgtcacaccaaagttaaatgaagaggtattcagatgcgtagggccacacaagacctgtgtgtgaagctcacagcccagccagttctgcctcaagcatgatgtaaagatacsaggcatggagtggggaccctcagccaggggcagaagcacctgttctggtttctacttggaatgtagaacccacccagttaatgaaaagtaaggctaccaaatatatcaagctatatctgcttggacatagctttgtttactttgtgacaggaatttcttagagtcagcctccagtaactcagttggcatagttgagttacaatgaagaggctgttgagaaattctctcctaagccatttgaaaatgtttactccttcttttaaaaaatatctgttaagctgtgccctcctttcaggtaga

SEQ ID NO: 181269 - DNA, 601 bp, Human
gtggtggttaatgctttatggctttcagcatgttcagtgtcaaaaggagataaattttgcagacgtcacaccaaagttaaatgaagaggtattcagatgcgtagggccacacaagacctgtgtgtgaagctcacagcccagccagttctgcctcaagcatgatgtaaagataccaggcatggagtggggaccctcagccaggggcagaagcacctgttctggtttctacttggaatgtagaacccacccagttaatgaaaagtaaggctaccaaatatatcaagctatatctgcttggacrtagctttgtttactttgtgacaggaatttcttagagtcagcctccagtaactcagttggcatagttgagttacaatgaagaggctgttgagaaattctctcctaagccatttgaaaatgtttactccttcttttaaaaaatatctgttaagctgtgccctcctttcaggtagatgttccagaggcatcgctaagtcatggtgtcacttgcaaacattctcagttgctgtcattacccactgactcctgtttgaaatctctgtgattttgtcaccattgatgggatttatcactgagccac

SEQ ID NO: 181270 - DNA, 601 bp, Human
ctggttcaatatttgaaaatcaatcagtgtaatctaccatattaacagtctgaagaagaaaaatcatgattatatcaatacagaaaaaaattgacaaaattcaacatcagttcatgataaaattctcagcaaactagaaagggaaggaaatttaacatgacataggacatctacaaaaaaacctacagaaaatcctaaggagtctatgagaaaatttcctaaaactagtgagtgagtttaacaagatcacagagtgcaaggtcatcatacagaagtcatttttatatcttagcaatgtacwattagaaattaaagaatatcacagtagcttcaaaaatatgaaaggcttagaaatctaacaaaatgtgatctggatgctgaaaatgatgagatgataatgaaagaaaccccagaaaacctaaataaatggagagataagaaggctcaacctagtaaagacgtatgttctttttaaattgatctgtagacttaataaaattccaattagaatccaagcaggatttgttcttatagataagctcattatgaaatgtatatggaatgtaaaggaactagtgctatggtttgtccccaccaaatc

SEQ ID NO: 181271 - DNA, 601 bp, Human
tggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagatattcctttttggcaacacaaaaatggactaagagaactagagtagctgatagaattttttaaaagaagggtaaagttggaggaactatactacttgattytgaagctacagtaatcaggacaatgtggtgaagggacagacacgtaagtcaatggaatggagacgagagatttctacaaatatggtcaatgggttttttttaacaaaggtacaaaaatcaatttaatggagaaaagacagtcttttcagcaaatgttactggaatagttgtcatccatatctaaaaaacaacacctcaacctcacatctcatacacagctgaacttaaaattgatcatagatctaagtgtgtgaaatgtaaaactataaacctccttgaaaaaatcatagaaaatcttca

SEQ ID NO: 181272 - DNA, 601 bp, Human
ggaaatgcacattaaagccacagtgagatatcacttacacccattgaaaaatgactacaataaaaaaaaaatctgatagtaataccaactgtcatcgaggatgaggaacagctgaaagtcatgcattgctggagggaacatgccactgtggaaacaggtgggtgctttcttatagacttgtatgtgcactcaccttatgcccaggagtccctctcctgtgtgttcaacccagagatatgcaagctgtgttcacacaaaaacctgtatgtgaatgattatactagctctctttataattgcaaaaaaaaaaaaaacaaaacctggaaacaacccaagtgtccttcatctggataatccttaaggataaactggtgcgtccacacagtggaataccactgagcagtgaagaggagccagttattgaaacaggtaatttggaggaaccccagaaacggtacagtgagtgaaagaaacttgtcttgaaaggttatgtactgtttggttccatttgtatgatattctcaaaaagacacaagaccatggggatggagaccagatcggtggctggagaggctggggtcggggagggcatgaccaccag

SEQ ID NO: 181273 - DNA, 601 bp, Human
aaaaagacacaagaccatggggatggagaccagatcggtggctggagaggctggggtcggggagggcatgaccaccagagaaaagggtgaagagtgttttgggtggcagagctgtgtgtatgctggctgtggttgtgaggacaaaatccacacaagcgctcaagttcgtaggctgtacgccagaaaagctgtttcactacataactgaaaaaataagattgaaaaataagatgtatatattttttgtgtgcgtgtgtagaaaaatacttgaaggtaaactgcagagtgataacagtggttycttctaggtactgggttaatatgtgatttttatgtttgtttgagcttttctaagttttctacattttccgtacaaaacatgtattacttctgtaataaaagcagcttgagattatttaaggaagcaaaacacttctgttgtttctcatcaactacaggatgaagtgcaggctccctgggtggtttgcaggggccacaggccttggccccacctcgctggtgctccctctactcctttctgtgtttgaagcaagttctggttcagacagaaagcctggcctttgagggcgttgggtcccca

SEQ ID NO: 181274 - DNA, 601 bp, Human
cccggcaacacttcagggctctttcaaaatctggtagctacgagctcttccgtgactgagatgggacaagagtgaagatttgtccttgcttttagctctgctccagttcatagttctaatgggaaattatgtgacttaaacccaggctgtgagatgcatcagtgacgtgtgggcataaaataaaccctcgagatgttctcttgcatggtacactggcctaggcaggaatattcttgaggctaaaactgtagaactgtcagactagtgttacgaatgtggtggtgagaggcctgtgcagccrcggggcctgtgatgtgtctcctgtgtgtctttcactcctatgcagtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctggg

SEQ ID NO: 181275 - DNA, 601 bp, Human
tagacaccgcagcctgtgtgcccccttccgggtctcgccaccactctgggcccagcctgggcgtccctccgacaacagccccaacgggaggagctccctgtcttccaccccgcgaggagcaccacagctcttcatggtctgacccaaagcgcctccacggggcgtcggggttcacctgacgtttttggaggtgcctgttttttgggacacatttccccgccagcaccctgggcatgtgtggcagtggagctgccttcagggccctgcaggccttccctttgggtggggttggctaccccgstctggcacctgccccgctgacttcccagcgtggtggccccgcgaggggaccccggctccagggaggtcgcagaggtgcggggttgatggcctggcctggcatgtggtccccatcacaagagtcctgtggtggcccctccagtgccatcaccgggtggaggtgggcagcttggaggccagttatacccatccccgagtctgggggcgtggagggggcagtgacctggggcacaggctggggtgaggggtgtgaccagagtcagggaaaaactggagacctgaggagccccccacttcactg

SEQ ID NO: 181276 - DNA, 601 bp, Human
catagagaaacacaaagtcttatcttgcccatatttaagcaatgcggtttcctcctgagaagccgatagggctttgctgaaattgttatattagtttaaaaggaaaaaaaaaaaaaagccaggcatggtggctcatacctataatcccagcactttaggaagccgaggcgggcagattgcttgagctcaggagttcaagaccatcctgggcaacatgtcgaaaccccatctctacaaacaatacaaaaaaaaaaattggccgggcatgatggtccacaactgtggtttcagctactcaggmggctgaggtgggaggatcacttgagcctgggaggcagaggttgcagtgagccaagatcacaccactgcactcctgcctgggcggcaaagccagatcctgtctcggaaaaaaacaaaaacaaaaccctcctagaggagggtgaacagatggacccaaggccaagatccaggcgagaggtgagtgctctgggactccaaggacccttggtgggaatgccctcctggcccgacacggggcccgctgacacctgccgtcactcagcctttccctaggagggaggcccttcttggagccaccctc

SEQ ID NO: 181277 - DNA, 601 bp, Human
agattaccttgctttgggagggggtggaaacaccaggggaccccagtgacactggagtcgaaacagcatccattgtcaaaacactggtcactggtgattccagggaagccgcagttcgtcctgttatgggggctcagcctggagcactggcagggggctgtggaaagaccctcagtcggccccaccctggtaccccagaccacactgctccttctctcagaggttctaggggatgcctctactgtcttgttgccacatagagaaacacaaagtcttatcttgcccatatttaagcaatgcrgtttcctcctgagaagccgatagggctttgctgaaattgttatattagtttaaaaggaaaaaaaaaaaaaagccaggcatggtggctcatacctataatcccagcactttaggaagccgaggcgggcagattgcttgagctcaggagttcaagaccatcctgggcaacatgtcgaaaccccatctctacaaacaatacaaaaaaaaaaattggccgggcatgatggtccacaactgtggtttcagctactcaggcggctgaggtgggaggatcacttgagcctgggaggcagaggttgca

SEQ ID NO: 181278 - DNA, 601 bp, Human
ctctggagtcccccgccttggggaaatcattttgcctctcgggactcagtgttctcagtaaatggggtggtcccccgggccaagatgagaaaaggtttgtgggcaccttggtaagatggaaagcgtttggacatggtattgattcccaaagacactgccattcagtgggcgctcgtgaacaatccaccatctgcctggtttccctgcggggcccagcaagcctcccagcaacaatcttggggatgaatcctccttctccagaggacgtgcctggttccacgcacacaggtgcacgacacayacacaaccttcctttgagcactcgtcggcgttacaacttgggtcctgatcccgtgcactaacataaaactcactcccaaagaaccctagaaggcttcacttccttccctaacatttgagggctgtcagcccttatgttactgctgtcctattaaataccttcatttccccatggaagcttcttcagaagtcacacttcaaaaactagaggagacctactatatatatatatatttttttctcaactaaagtaaaactgatggctccacacacacatgtctgttgaaagaactaacagtgt

SEQ ID NO: 181279 - DNA, 601 bp, Human
cgccaacacttcctctttgaaacatgacacttgggaggattgtatagtcttcctaacacaggaaaacagccccgactgaaggcagccccctcctcgtcgcacttctcgaaggtctccgggggccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctgtggccccacagagcaggaagaagcaygccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgagacaataatctccactgatttttatcaaaggtgtttcctagacatggtcaagctacatggaaggatttgctg

SEQ ID NO: 181280 - DNA, 601 bp, Human
gcattcgggcctgtgggagagggtctcccaggtggccatcactgggaccggcatttgggcctatctggatgggccttgggagggtctgcccctgggggagatgttggcatgaacagtcaaaagcactattctgagaccccacgccaacacttcctctttgaaacatgacacttgggaggattgtatagtcttcctaacacaggaaaacagccccgactgaaggcagccccctcctcgtcgcacttctcgaaggtctccgggggccctgccaccctgagttactctccacctgcttttgccsatcctgtaaattggatatacttttaagggcctagaacagcacctggcacaaaacaggtgctcaaaaatatgtatgtaaaacagtggctcctggcggaggctgccagagctggctgtggccccacagagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggatttta

SEQ ID NO: 181281 - DNA, 601 bp, Human
gtaggagagggtctcccagttggccaccactgggacgggcattcgggcctgtgggagagggtctcccaggtggccatcactgggaccggcatttgggcctatctggatgggccttgggagggtctgcccctgggggagatgttggcatgaacagtcaaaagcactattctgagaccccacgccaacacttcctctttgaaacatgacacttgggaggattgtatagtcttcctaacacaggaaaacagccccgactgaaggcagccccctcctcgtcgcacttctcgaaggtctccggggrccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctgtggccccacagagcaggaagaagcacgccttacctgtctgggcctcggccagggtgccgagggccagcatggacaccaggaccagggcgcagatcaccttgttctccatggtggccattgcctcctctctgctccaaaggcgacccc

SEQ ID NO: 181282 - DNA, 601 bp, Human
ccaggggagcccaggaacctgtaggagagggtctcccagttggccaccactgggacgggcattcgggcctgtgggagagggtctcccaggtggccatcactgggaccggcatttgggcctatctggatgggccttgggagggtctgcccctgggggagatgttggcatgaacagtcaaaagcactattctgagaccccacgccaacacttcctctttgaaacatgacacttgggaggattgtatagtcttcctaacacaggaaaacagccccgactgaaggcagccccctcctcgtcgcayttctcgaaggtctccgggggccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctgtggccccacagagcaggaagaagcacgccttacctgtctgggcctcggccagggtgccgagggccagcatggacaccaggaccagggcgcagatcaccttgttctccatggtggccattgcctcctc

SEQ ID NO: 181283 - DNA, 601 bp, Human
agaatggcctcctcctccactccctagaaggacccagggcaaccgatccacttgacaacaccagggaatatgggttgccagccacgcactcatgagagaggtggctttgactcccagagcatggatcccaggggagcccaggaacctgtaggagagggtctcccagttggccaccactgggacgggcattcgggcctgtgggagagggtctcccaggtggccatcactgggaccggcatttgggcctatctggatgggccttgggagggtctgcccctgggggagatgttggcatgaacastcaaaagcactattctgagaccccacgccaacacttcctctttgaaacatgacacttgggaggattgtatagtcttcctaacacaggaaaacagccccgactgaaggcagccccctcctcgtcgcacttctcgaaggtctccgggggccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctg

SEQ ID NO: 181284 - DNA, 601 bp, Human
ctccagcctgagtgacagagcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccattgcaggtaaggtragaggaccgggtggggtggtctaggaggagccgacagagggtacaagctgtgaaacagcttgaagcagggcagtgaggaaagggatctagaggaggaagacacgtggacagatggggctggctgggggctgccgcaggatcttatgcaagaggttctaacaccagagcttcaggctctgagctccgcggaatcaaaggtctcagaaagcaacctattaggatctggtggttgacagcctgcagcagggggtgaaagaggagcccagagcaccctccggtccctgtccctgccttggggca

SEQ ID NO: 181285 - DNA, 601 bp, Human
cgcaccattgcactccagcctgagtgacagagcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccatygcaggtaaggtgagaggaccgggtggggtggtctaggaggagccgacagagggtacaagctgtgaaacagcttgaagcagggcagtgaggaaagggatctagaggaggaagacacgtggacagatggggctggctgggggctgccgcaggatcttatgcaagaggttctaacaccagagcttcaggctctgagctccgcggaatcaaaggtctcagaaagcaacctattaggatctggtggttgacagcctgcagcagggggtgaaagaggagcccagagcaccctccggtccctgtccc

SEQ ID NO: 181286 - DNA, 601 bp, Human
taaaaccagagaagtcattaataagagtctaaatatctgggcccaggctcatgcctgtaatcccagcactttgggaggctgaaggaggtgaatcacttgaggtcaggagttcaagaccagcctgaccaaaatggtgaagccccatctctactaaaaatacaaaaaattaggcgggcattgtggcacacgtctgtaatcccagctacttgggaggctgaggcaggagaatcacttgaacccaggaggcagaggttgtagtgagccaagatcgcaccattgcactccagcctgagtgacagarcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccattgcaggtaaggtgagaggaccgggtggggtgg

SEQ ID NO: 181287 - DNA, 601 bp, Human
cgcctgtaatcccagctctctgggaggctgaggcgggcagatcacctgaggtcaagagttcaagaccggtctggccaacatggtgaaaccccgtctatactaaaaatacaaaaaaaatttagctgggcgtagtggcacacacctgtaatctcagctactaggaagctgaggttgaactcaggaggcagagattgcagtgagccaagatcgcaccattgcactccagctcaggggcaacggagcgagactccatttcaaaaaaaaaaaaaaaaaagaatacatgaaatgtcttcagatttcstcatgccttccccctctatcctaggcaagctagaaagcgttaccaacagtggctcttcccaggcttttggttagagatgtgaagagaagccggggggaaatcaggtttcttcccaagtcccttagccctgcctttctattcctggacctgaatgcagcctgactcaggctaccccattgcaccaccactggcggccgtgactctgtgtaaaggcatagctggtgatgctgatcagagcctctgtagtcttaaatgacttttctaactaattctaaatcttcagaacccatcgtataaaaa

SEQ ID NO: 181288 - DNA, 601 bp, Human
cattctttagaaaacatgaactgtcagccgggcacggtggctcacgcctgtaatcccagctctctgggaggctgaggcgggcagatcacctgaggtcaagagttcaagaccggtctggccaacatggtgaaaccccgtctatactaaaaatacaaaaaaaatttagctgggcgtagtggcacacacctgtaatctcagctactaggaagctgaggttgaactcaggaggcagagattgcagtgagccaagatcgcaccattgcactccagctcaggggcaacggagcgagactccatttcaaaaaaaaaaaaaaaaaagaatacatgaaatgtcttcagatttcgtcatgccttccccctctatcctaggcaagctagaaagcgttaccaacagtggctcttcccaggcttttggttagagatgtgaagagaagccggggggaaatcaggtttcttcccaagtcccttagccctgcctttctattcctggacctgaatgcagcctgactcaggctaccccattgcaccaccactggcggccgtgactctgtgtaaaggcatagctggtgatgctgatcagagcctctgtagtcttaaatga

SEQ ID NO: 181289 - DNA, 601 bp, Human
tccttagccgaggaagaacagaaagcatttgttcccctatttatacttgtagcatcaggtgcatcttggtcatacggtaaatctttgaaattcgacagtccacacaaagcgcattcagtatcgattaaccaaaaacagtcatctggtgagaatgcattttcgtctgagctacagcagataacagaaaagcttctagaattagcaaaaaaaaaaaaaaaaaaaaagtatgaacttaattctgctaagacaatgactttcccattgtttgtccaaccaatcttcaaatcgattgctttagagrgactccctctcaccatttagaagttgccatattgctattgttcagaagataaattactctcaaagccctttccattgcttttttgcgattgttttcacctgtcccacataaacgcaattctttccctgtgcgtgtggtacacctaccataagcataagtagtttcggtactcacataattcccgagtcccaaaaatgtagatggcaccacggaagagatagtaggccacagtgttactggcttcccataaacacagccctttcctggctcacacgggcatgacctaattaagaacgaaag

SEQ ID NO: 181290 - DNA, 601 bp, Human
tcggaatgagaagggggcttcaacagcaggcggatcattttcccccatggtgactatttcaggacctctgacatccggctccgcctccacctctacctccttagccgaggaagaacagaaagcatttgttcccctatttatacttgtagcatcaggtgcatcttggtcatacggtaaatctttgaaattcgacagtccacacaaagcgcattcagtatcgattaaccaaaaacagtcatctggtgagaatgcattttcgtctgagctacagcagataacagaaaagcttctagaattagcaaaaaaaaaaaaaaaaaaaaagtatgaacttaattctgctaagacaatgactttcccattgtttgtccaaccaatcttcaaatcgattgctttagagggactccctctcaccatttagaagttgccatattgctattgttcagaagataaattactctcaaagccctttccattgcttttttgcgattgttttcacctgtcccacataaacgcaattctttccctgtgcgtgtggtacacctaccataagcataagtagtttcggtactcacataattcccgagtcccaaaaatgtagatg

SEQ ID NO: 181291 - DNA, 601 bp, Human
aagcgatcggaatgagaagggggcttcaacagcaggcggatcattttcccccatggtgactatttcaggacctctgacatccggctccgcctccacctctacctccttagccgaggaagaacagaaagcatttgttcccctatttatacttgtagcatcaggtgcatcttggtcatacggtaaatctttgaaattcgacagtccacacaaagcgcattcagtatcgattaaccaaaaacagtcatctggtgagaatgcattttcgtctgagctacagcagataacagaaaagcttctagarttagcaaaaaaaaaaaaaaaaaaaaagtatgaacttaattctgctaagacaatgactttcccattgtttgtccaaccaatcttcaaatcgattgctttagagggactccctctcaccatttagaagttgccatattgctattgttcagaagataaattactctcaaagccctttccattgcttttttgcgattgttttcacctgtcccacataaacgcaattctttccctgtgcgtgtggtacacctaccataagcataagtagtttcggtactcacataattcccgagtcccaaaaatg

SEQ ID NO: 181292 - DNA, 601 bp, Human
tagggtgacccccactcccactttctggaacctcaggcagagctcctgtggttcctccctagcaccaatgtgtcaggaatctgcctgcgtccaagccctgacttccagaaccggcaaccccacagctccctttgaccagtcctgactatctctggtcaaaaagatcctagccgtataggttgctagagagtccactgttttatcaggcatttgtgacttatttacgaaaccaacttttttccttcagttgttaggagccactccgtcatctgctgctggattttaatctaggcctctaatrtctttggcgacatccagtttatcctgagttttcggagggactggtggccactgcttctcaggacttcctggaggactcagagatttcctggccaggatctgacctccttcaggattgacaggacaattgtggagccccagtctctgaaaacctccaacaagagaagaaaacaccggtctccagggagagagcaaagggcttaacgaaacgatcccctctccaatgccccttctccctgagattctgcagatctagggaagtgcaggtgtccagcctgtgggtgtcagaatggctggggag

SEQ ID NO: 181293 - DNA, 601 bp, Human
tccccactacttagtcatagcaaaataatcaaaaaataagagaaaggaatattatagtgctattaatattcatattatttatattataaaagattaggaacaactataggtcaaactatgatcaaatggctgtgtaaattgcatatctacttgatggaatactgtgattccataagaaaaaatttataaaaaccttttatggaaaaaacccacctgcctatatctgtactgtgcatgaaaccacacatacgggcaaaagcaggaagagactttgcagacataaaaaccaggtaagttttgrgagtcaggtgattgcaagatttttttttctttcattgacacttagctaattttgagccatatttttaaatgtgtgtcttttcagttacttgaaacctcttctcccacctcccatcctttccaaacctcctccaagccaattttccagttggtttaaaagaaatcattagggtgacccccactcccactttctggaacctcaggcagagctcctgtggttcctccctagcaccaatgtgtcaggaatctgcctgcgtccaagccctgacttccagaaccggcaaccccacagctccctttg

SEQ ID NO: 181294 - DNA, 601 bp, Human
tttacaaaagaagggggtgggccagatttgacccatcagccatagtttgtcaacatctagaaaatatttaattatttaatgccatagaaaggtgaaggtgatattgttaaaattttttaaaagcttcaaaataatacaaatagtacatgttacttccaaaggaaatatagatatatagatagaaaaaggcaagaaattcaataataaattgctaataggattatctctgagtaatgatgccgtcgtgggtaatttttaaaaatcttttcaatgaactgtattttctaaactgttcttctartgaacaatacattactctatttacgaggaaaagtttttgttcctccccactacttagtcatagcaaaataatcaaaaaataagagaaaggaatattatagtgctattaatattcatattatttatattataaaagattaggaacaactataggtcaaactatgatcaaatggctgtgtaaattgcatatctacttgatggaatactgtgattccataagaaaaaatttataaaaaccttttatggaaaaaacccacctgcctatatctgtactgtgcatgaaaccacacatacgggcaaa

SEQ ID NO: 181295 - DNA, 601 bp, Human
ttcgcagatgtggaggctgtgaggaacgcagagtgagggaggatgagagaccgtggcaagttctgtgttttaggcctggacaagctcagtggtttgttgaagctgcattatccatacctagaacagcaggggacacacagtagtccttgataaaaatgtgctagatgaatgaatgaatgacatcatgataatgaaggccgttttaactcagggtctgagaccaagtccttccaggacagcccatctgcggtggtgagctggcagaaaggatcctctctccaccctcacacctcgatccccygcacactaacaattctcctctataaggatgcccacccttcgtcttatacttagaaatctgcaggaaccccaggaatgacatcttcacattccagctgctctgtatttaagttggatttagaaaatgaccccaaattgtcaaatcaaagattgacatttaatcgaaaggctgtgtcagttcccgtttgccctgcttctctgtcaggctgccctgagggcactgcaggggccccacgcctcctctgtgcttggtccttgaggacattgcctggaataaacaatgaaatgtacagcatttctc

SEQ ID NO: 181296 - DNA, 601 bp, Human
ttggccactcctaaccgggcaggttccttggtgacaaagccatgagcatggccagcagcccttgcggcaccccagactgactttacattcatgtgggcaaataaaacttcaagtcagcaaaccaaaaggatgtttgcctccagtaattaaggctgggcagcagcaaaatgctgggatgagagggggcgctcatgaaagtttaactacttggctaggtatttgagatcctactaaataatgaattgtactcactgcccagaccaatggccagtgctaatatcaatgcaatgatcccaatgaygatgattggaaaaaacttcaatggcagcagtgacaggatctgtgcagcaacagcatctgcatctgaaaaccagaaaaaggaagagcagaaagccacagaacctgacttggagtgccatgaaacttacaaatttaactatcctttccccctcccctctttgcagagaagtctcagcccaaagaaaggtgccttaattagggaaagggccacccaccaaggggcacattctctagttcagtcctacctgctccacctctgacccggttattccatgggggatgaggggatgtgctatgggtt

SEQ ID NO: 181297 - DNA, 601 bp, Human
agaaagtgaacgaagtgtggaccacacagtggggcaggtggcgaattgaactgacctgtgattcaggtatttgaaagaaaaattgttccctattagagaccctccatccaaatgacccactttctcaaaagccacatgcaccttattgtaaaaacagctggtgcgcctgcattgcatgaataggtctctttgtcttctccccgctgccccggtcagtgcctccctcccacctgcaggattctatttcatcagctgcctttggccactcctaaccgggcaggttccttggtgacaaagccaygagcatggccagcagcccttgcggcaccccagactgactttacattcatgtgggcaaataaaacttcaagtcagcaaaccaaaaggatgtttgcctccagtaattaaggctgggcagcagcaaaatgctgggatgagagggggcgctcatgaaagtttaactacttggctaggtatttgagatcctactaaataatgaattgtactcactgcccagaccaatggccagtgctaatatcaatgcaatgatcccaatgacgatgattggaaaaaacttcaatggcagcagtgacaggatctg

SEQ ID NO: 181298 - DNA, 601 bp, Human
tttcagagtgcaacactaacaactgtccccctgccacacagtgcggagctggcccgtgaataatgaaacctgtattgaaattgcgtccctgtcagcagcctgtttcctgcagcccagtttctgttttgaattccaaggggtggggctgctgtgccccactttatctcgctatgtggcctggcccaggaaccacagtgcaaggtgaatttagactctggaggtctcaaggtcaagagagaaactgcatggcggggggccgacctgctgagccagccgagcaaggagtcctgactgagaactsctcggccttcctggtttctcttaccgaaggcagaaagtgaacgaagtgtggaccacacagtggggcaggtggcgaattgaactgacctgtgattcaggtatttgaaagaaaaattgttccctattagagaccctccatccaaatgacccactttctcaaaagccacatgcaccttattgtaaaaacagctggtgcgcctgcattgcatgaataggtctctttgtcttctccccgctgccccggtcagtgcctccctcccacctgcaggattctatttcatcagctgcctttggccactcc

SEQ ID NO: 181299 - DNA, 601 bp, Human
gagcgacatctgtacttccctgagcagtcgaagtggactgggaaaagggaggaaggcaggaattaaccaacagctctttcagagtgcaacactaacaactgtccccctgccacacagtgcggagctggcccgtgaataatgaaacctgtattgaaattgcgtccctgtcagcagcctgtttcctgcagcccagtttctgttttgaattccaaggggtggggctgctgtgccccactttatctcgctatgtggcctggcccaggaaccacagtgcaaggtgaatttagactctggaggtctsaaggtcaagagagaaactgcatggcggggggccgacctgctgagccagccgagcaaggagtcctgactgagaactgctcggccttcctggtttctcttaccgaaggcagaaagtgaacgaagtgtggaccacacagtggggcaggtggcgaattgaactgacctgtgattcaggtatttgaaagaaaaattgttccctattagagaccctccatccaaatgacccactttctcaaaagccacatgcaccttattgtaaaaacagctggtgcgcctgcattgcatgaataggtctctttgt

SEQ ID NO: 181300 - DNA, 601 bp, Human
ttagtggccagtggaaccctgagaccataggcaggggtttctccacagccagctcaaacccctcctctgccaaatctgacccacttcttgtccacggcagcctccccatcacagagcagtgactctggatccctgagacttctcgctggtctcatcttattgcttatgtggtctccccaagagagccagagctccatggaaggccctccctgaccccccagcccaacatgtctttgggcaaacgccagttcaatcccagctgaggacatgacctaaaaatggcaatgacttggacccattwtacagatgggaagggtcagggttggcttctgctgcttccttctgtttccccaggggaagagccatgaccttaccacagcggtactcgtcctccccgtctttgcaatccgagactccgtcacatcgagctatcagctcgatacacttaaaggatgagcgacatctgtacttccctgagcagtcgaagtggactgggaaaagggaggaaggcaggaattaaccaacagctctttcagagtgcaacactaacaactgtccccctgccacacagtgcggagctggcccgtgaataatgaaacct

SEQ ID NO: 181301 - DNA, 601 bp, Human
cttccacgaagcagctgtgaacacctggagcacggcattctgaccacccacccggactggccgatgtgcagaaagaaaggcttattagtggccagtggaaccctgagaccataggcaggggtttctccacagccagctcaaacccctcctctgccaaatctgacccacttcttgtccacggcagcctccccatcacagagcagtgactctggatccctgagacttctcgctggtctcatcttattgcttatgtggtctccccaagagagccagagctccatggaaggccctccctgacccyccagcccaacatgtctttgggcaaacgccagttcaatcccagctgaggacatgacctaaaaatggcaatgacttggacccattttacagatgggaagggtcagggttggcttctgctgcttccttctgtttccccaggggaagagccatgaccttaccacagcggtactcgtcctccccgtctttgcaatccgagactccgtcacatcgagctatcagctcgatacacttaaaggatgagcgacatctgtacttccctgagcagtcgaagtggactgggaaaagggaggaaggcaggaat

SEQ ID NO: 181302 - DNA, 601 bp, Human
taccttgggaaacccagttgggcacaggcaacatttgcgtagtgacccttccagtcatcggagcacatggtcttccacgaagcagctgtgaacacctggagcacggcattctgaccacccacccggactggccgatgtgcagaaagaaaggcttattagtggccagtggaaccctgagaccataggcaggggtttctccacagccagctcaaacccctcctctgccaaatctgacccacttcttgtccacggcagcctccccatcacagagcagtgactctggatccctgagacttctcgstggtctcatcttattgcttatgtggtctccccaagagagccagagctccatggaaggccctccctgaccccccagcccaacatgtctttgggcaaacgccagttcaatcccagctgaggacatgacctaaaaatggcaatgacttggacccattttacagatgggaagggtcagggttggcttctgctgcttccttctgtttccccaggggaagagccatgaccttaccacagcggtactcgtcctccccgtctttgcaatccgagactccgtcacatcgagctatcagctcgatacact

SEQ ID NO: 181303 - DNA, 601 bp, Human
gagaaggaggcccatgcctaggccaaaactgtgtcactccaatgcaaaaaatcatgtaggcaacacaaacactaaaaagtgaatagtcaactgttatagttctttgttctacatgttgctaaacaagtgttttggatgattgtgtcttcactaaatttctgactttcaacaattggttctgtggggttcttggggaagcgtgcatggacattgatgtgaccgccaggaccaagcaggaaagtgtccaggaagctactctaggagctgcaagctgaggagctggagggttttttggttttgkttttgttttctactttgaaactttttattgcatgttcgtatctccgatcctggcctggccctgggaacccccaaacatgccacttcccatgtgccttgagcaagtcacttagcctgtctggccttggtttgcttgcctgtgaagtgaggatgatatcgggcatcctaaggtggatgtgaggatgtaatctgagagcgttaaagcacccaatagtgcccaactaaatggtagttgtctttctttattgttatcctctctgtgttttgcccatgggttggaaatgctctttaacttaccttg

SEQ ID NO: 181304 - DNA, 601 bp, Human
agaatatgattcatggaatttgaaaactgagactctgtggaggactcagggcagtgtggctttaacgaccccatctacttgagtgcaaagcagaatgcagcctgcctgctttgagtgctgagacttgagagcaaaggggagtaaggaggctgctaggggaacccgtggaagtacagcggccgcaggaagtcagaaggaaggggccaggggagagaaggaggcccatgcctaggccaaaactgtgtcactccaatgcaaaaaatcatgtaggcaacacaaacactaaaaagtgaatagtcamctgttatagttctttgttctacatgttgctaaacaagtgttttggatgattgtgtcttcactaaatttctgactttcaacaattggttctgtggggttcttggggaagcgtgcatggacattgatgtgaccgccaggaccaagcaggaaagtgtccaggaagctactctaggagctgcaagctgaggagctggagggttttttggttttgtttttgttttctactttgaaactttttattgcatgttcgtatctccgatcctggcctggccctgggaacccccaaacatgccacttccca

SEQ ID NO: 181305 - DNA, 601 bp, Human
atttttgaatcacagatctctgacataggatgtagtagagcagagaagattaaagaaggattttaaggagaatttaagaaaatagaacaaaatgcagaaataaatcttagaaactgaagcaatggatagagaacaaaagaacaagcctatagagaagaaagtaggcaatattggggtgagagatgggggacatcgcattccctggatttccttgtagagggagcatattaaggatgagaaggaatattttaccaaacgggctggggtggaagagagacgggaaggctacccccaccatgagtggcctctacctgatgcctgggacagctggggctcctgacttgggtctgctgggtggggaaggagagggattgagctgagtttttctgcataacagagcagagaggccttggggtttgctcagacagagcggtggtcctccaggacagaggaggagggcagagagaagagaaaaggaggccccccaacaccccccacccaatgagtcagaggaagaggctcagcggggaagagaaatgcccaatggggaagctctcagctgtgtgcagtgtgtgtgtgtgtgtgtgtgtgtgtacctctt

SEQ ID NO: 181306 - DNA, 601 bp, Human
acagccatgttctccttcccttgtgaaatgaacaaaacacagtacagtaggcttgttttcatagtgaacacaccagcttatcaacaggatttcttcagcttactgtaaatgctatgggggtgtgtatgtagaatacaaagttcagtcaactttgagttttgaggaaaatgtaatcaaggcggcgggcacgaccttcgcagcccttccagggattgctcaatgcacggattccgctggcactggcatgaaagagccgatggttgctgggatggcttggccccagtgcaggtggcggggcttstgccaggcaaggggaccccagtgctgcaactggagccccatgaactgtccaagtctcaaaatggtaacaatgacagccacaaccacacactcgcccagtgtgctcttgcccaccaagcccttccacactcacagcgtcagcggaacttcagttcccctccaagtacgtgctattatcatccctcttttctaagaaaggaaactgaggcatgaactgtgtgtggaacttgcctgagtctacactgggatttgaacccaagcaatctagcttgaccgtcctttgattatttatttatttatt

SEQ ID NO: 181307 - DNA, 601 bp, Human
cattccagtgaaatgccttttgcttggcctgaagcaagtccagaggggaggtgagcacaaaactaggtgcagtattgtcggggggcacccaagcagggacaccaagttctccaagaacagtgagttggaggaacaggagagacatccctcacctgcccaggaccagcgcagagccccactggaaagagatgaacacaaacaagaaagcgattccacgaacaccagagcccagctcatttttacagtgccaggacacaggtcttctggagaacagtggtgaaagtgatgcaactttttaaaraagaatcacatgtttggagagtcacaagatggaagatggtgaataaacagccatgttctccttcccttgtgaaatgaacaaaacacagtacagtaggcttgttttcatagtgaacacaccagcttatcaacaggatttcttcagcttactgtaaatgctatgggggtgtgtatgtagaatacaaagttcagtcaactttgagttttgaggaaaatgtaatcaaggcggcgggcacgaccttcgcagcccttccagggattgctcaatgcacggattccgctggcactggcatgaaagagc

SEQ ID NO: 181308 - DNA, 601 bp, Human
cctgggctgcagccacacagtgagtgaccatctcctatgtccttggttgagtcactctttgcgcattccagtgaaatgccttttgcttggcctgaagcaagtccagaggggaggtgagcacaaaactaggtgcagtattgtcggggggcacccaagcagggacaccaagttctccaagaacagtgagttggaggaacaggagagacatccctcacctgcccaggaccagcgcagagccccactggaaagagatgaacacaaacaagaaagcgattccacgaacaccagagcccagctcatktttacagtgccaggacacaggtcttctggagaacagtggtgaaagtgatgcaactttttaaagaagaatcacatgtttggagagtcacaagatggaagatggtgaataaacagccatgttctccttcccttgtgaaatgaacaaaacacagtacagtaggcttgttttcatagtgaacacaccagcttatcaacaggatttcttcagcttactgtaaatgctatgggggtgtgtatgtagaatacaaagttcagtcaactttgagttttgaggaaaatgtaatcaaggcggcgggcacga

SEQ ID NO: 181309 - DNA, 601 bp, Human
agacccgacgtggtaactttacactttgaagcattcaaccgatgtgcgagtcacaatattacagggattgtacatgggggatgtcattttgtccccccaaacccatcaaaggcttcctttgccaagagaatgaagttcactcaccctggcaaggcattcagtccaggcctgctgtgttctgggatgacccccgcttctggcctgtacctgacagccccgtccacccaccctgggctgcagccacacagtgagtgaccatctcctatgtccttggttgagtcactctttgcgcattccagtraaatgccttttgcttggcctgaagcaagtccagaggggaggtgagcacaaaactaggtgcagtattgtcggggggcacccaagcagggacaccaagttctccaagaacagtgagttggaggaacaggagagacatccctcacctgcccaggaccagcgcagagccccactggaaagagatgaacacaaacaagaaagcgattccacgaacaccagagcccagctcatttttacagtgccaggacacaggtcttctggagaacagtggtgaaagtgatgcaactttttaaagaagaatcac

SEQ ID NO: 181310 - DNA, 601 bp, Human
ggctggcctgccagggccactgcgagagcaaggacatgtttccacccacgatgcgtgagctgtagccccttctatgaccacaggctatggaggggaacaaaggcttgtgggtccaccctgcagacttctttgggggacatggtgtcaccaccatgcacctgctcctctctccccaccctcactgcccctgctcccagagctcacagcagctctaagacaagtgctgcaagggggagctcagcaggggaggtggtcaggctcttggggagacctgaggatggtgggtgctgtggaggatgcrgtgggaaaagcacctgccctgcttggtcagtgcccagcattggcagcaccactccccatcctattcccccagtgatgacaacaccctgggatgtcaggagcaggcaggaaccttctgcagccccctcctcactgccgctggtgcacgcacctccctgactgctccagaccccacccttgtggtgtgaacactcccctctgccaggaacgaggggcactgcccgaggcctggagtgggcactgtgcacgtgtaaggaggaagtgggaactgagtcagggactcaaggctcttcagagtgat

SEQ ID NO: 181311 - DNA, 601 bp, Human
gggtctgggaagatggtcagcagcactcactcataaacacagtgtgcagcagtgatgatccacaggggcgtgatgacagagcccccgcacaggtggtagccctggaactgaaggctggcctgccagggccactgcgagagcaaggacatgtttccacccacgatgcgtgagctgtagccccttctatgaccacaggctatggaggggaacaaaggcttgtgggtccaccctgcagacttctttgggggacatggtgtcaccaccatgcacctgctcctctctccccaccctcactgccccygctcccagagctcacagcagctctaagacaagtgctgcaagggggagctcagcaggggaggtggtcaggctcttggggagacctgaggatggtgggtgctgtggaggatgcggtgggaaaagcacctgccctgcttggtcagtgcccagcattggcagcaccactccccatcctattcccccagtgatgacaacaccctgggatgtcaggagcaggcaggaaccttctgcagccccctcctcactgccgctggtgcacgcacctccctgactgctccagaccccacccttgtggtgtgaa

SEQ ID NO: 181312 - DNA, 601 bp, Human
tggccccccatcctgacgtccagcacacttttccatcggggaagttctcttcagagttgggcaggcacacaggctggatcatttctgcttgaagggaaacaatagttcacaactcaattgaagcaggagtccgagaaaacaatctcatctatgcttctgcctctgaggagcccaaactatctcccaagggaaggaaggtcaagcccttggttacttgaaaacgatcagctcacagcaggagccccttaccccatccaccacacccagagcacttaaaactgtaaaagagccctccaccgtsgcagcgtgagggaacctagaccagggtcagcacaccttttgtggaaagggctgaatagtcaatgttgtaggcttcgtgggctgtgcggtctctggctgccattggagcatgaagacagccccaggtaacaggtacccacataggtgtggctgtgtccagtaaaatgtctatttaccaaaacacgatggggcagaccaggctctcaggccaacgcgtgcccactcctggctagatcacagtgtgggtgttgcctatagaacacggctccatgaatattgctatggttcctgggatatctgg

SEQ ID NO: 181313 - DNA, 601 bp, Human
caccatgcctggctaatttttgtattttttgtagagacggtgtctctctatgttgcccaggctggtctcaaactaatggcctcaagggatcccatagactcggcctcccaaaatgctgggactacaggtgtgagggaacacacctggccaatttccatcgttttaagccacgcagactgtgataatttgtcacggcagccacggaaaatgaatcctcttcctactaacaaagaaagtgattgatggaaaaacctaagactcatgaccagctctgtacccacactaaggaaagggtggcccrggcttcatttgcatggactatggttactgccactcctacttcccttattattacagcgatctcatctgctgctgcttccacttgctctttgtaggatgaaagaacacatcttccaaagtcccacaagacaaagagtcttcacaaatacgaatctttgagttctgaatgaagcctgggagggttgtctaggtgggctctgtatgtcctcagttaacaaggccgggggtccgggcagggaaagggaaacacctgctgtgttcgagaaggtctaactctctcctgagaaggtctgcagggtca

SEQ ID NO: 181314 - DNA, 601 bp, Human
caggagagggaagtttgagatacagagacacagggggcaaagccacgggaggaaggaggctgaggctggagatccagctacaagcccaggaatgccagtgcagctgcagccgccgccaccagaacccaaaggaaaggggtcagagcctccaggaaaaccaccctacagacacctcaactgcgtgtggaaataaatctccactttttttttgttttgttttgtttttttaaacgcaaagtctcactctgtcacccaggatggagtatgatggcatgatcacggctcactgcagcttagaatycctgggctcaagcaatcccaccccagcctcctgagtagctgggaccaccatgtcaggctaatttttgtttgtttgtttgtttgtttgtttgttttgagatggagccttgctctgtcacccaagctggagtggagtggcatgatctcggctcactgcaacctccgcctcctaggttcaagtgattctacagcctcagtctcctgaatagctgggattacaggtgtgcgccaccatgcctggctaatttttgtatttttagtagagacagggtctcaccacattggccaagctggtctcaaa

SEQ ID NO: 181315 - DNA, 601 bp, Human
gtaattaaggtaagaatctcaacataagatctcccagcgtttagggtggaccctaaatccaacgacttgctgtccttataagacacaggagagggaagtttgagatacagagacacagggggcaaagccacgggaggaaggaggctgaggctggagatccagctacaagcccaggaatgccagtgcagctgcagccgccgccaccagaacccaaaggaaaggggtcagagcctccaggaaaaccaccctacagacacctcaactgcgtgtggaaataaatctccactttttttttgttttrttttgtttttttaaacgcaaagtctcactctgtcacccaggatggagtatgatggcatgatcacggctcactgcagcttagaattcctgggctcaagcaatcccaccccagcctcctgagtagctgggaccaccatgtcaggctaatttttgtttgtttgtttgtttgtttgtttgttttgagatggagccttgctctgtcacccaagctggagtggagtggcatgatctcggctcactgcaacctccgcctcctaggttcaagtgattctacagcctcagtctcctgaatagctgggat

SEQ ID NO: 181316 - DNA, 601 bp, Human
gcaacagtcacaggagacttaatccacgtgcagtgggccaagcacgcccccgacaccgagggatggacccctccaactcagctggtttgtgacccaggcatcttggtgttttaaagactccatagattccatggagacaacaaaatcacacaatgacaggaccctgaggggctgctctgaggagcacatggtatcacaagacactcagcttcctgcccggaacgtggcgaaacagctcaatgcattatgggagaagattccaggacaggctggagctgaagctacatcaggacaggggctygtcggaccttttgcactggacagagcagattgacagcgagaagaaaatcggcagcgggatggagaatctcctgggaggatgaagctgttgcacagcctcctcttcagagcccagtgtcatcagaatgactctggtgggctggttggtccggaatgagagcccaccatgagaggaaggggagcgtagattggtgtcccagctcccaccacacaccaggggtgctggttctgatgaagctagaaaggccctggaccagccacactggcacagaactgggcctgggccatgtgggtgggttgg

SEQ ID NO: 181317 - DNA, 601 bp, Human
tccctgtggttgcagatcttgttggaaatcaaagggacggccgcgtggttcaggacaggggaggcgtcacctgcttcaaagtgagtgaggggatgtgtgtgagaaggaagcccggcccaaaacacagaaggcgcatgctgagaccaggggggtgagggaacgagggacgagggggatgctctctggtgtgacgcaacagcggaaaaggacagggccctgcgggtgggacgagcagactcccactgtctcgaagcacctcaagcccgagcttgccctcctacgagtggccgcaaggggccastctgcttcaaggcagggccaccgactcccctaaggtgtccaaagaggaggaggagtaggggcaacagtggccaagacacctccccagggcaccagcccaatcagccatcagaacaccccaggttatgggagggaaactgaggctcaggagggtcactcactcagcgtctttgtgaactctgggatggtcagcagaaaaatgaccccaaagacattctcaccccaatccccagaacctgtgactgtgtcaccttacagggcaaatgggacattgcaggtgcattgagggacaggccttgag

SEQ ID NO: 181318 - DNA, 601 bp, Human
gtccctgtggttgcagatcttgttggaaatcaaagggacggccgcgtggttcaggacaggggaggcgtcacctgcttcaaagtgagtgaggggatgtgtgtgagaaggaagcccggcccaaaacacagaaggcgcatgctgagaccaggggggtgagggaacgagggacgagggggatgctctctggtgtgacgcaacagcggaaaaggacagggccctgcgggtgggacgagcagactcccactgtctcgaagcacctcaagcccgagcttgccctcctacgagtggccgcaaggggccrgtctgcttcaaggcagggccaccgactcccctaaggtgtccaaagaggaggaggagtaggggcaacagtggccaagacacctccccagggcaccagcccaatcagccatcagaacaccccaggttatgggagggaaactgaggctcaggagggtcactcactcagcgtctttgtgaactctgggatggtcagcagaaaaatgaccccaaagacattctcaccccaatccccagaacctgtgactgtgtcaccttacagggcaaatgggacattgcaggtgcattgagggacaggccttga

SEQ ID NO: 181319 - DNA, 601 bp, Human
cctccagctgtgtgtcccttccagaatgcagaccctgaccctctgaagctcaagggcagctggtgagagggagggtccacctggccagggccctcaggtgacctgtgatccacctagtagaactggagtcccagccactgcagctttcggagggccagattcactggttccccgccacctgcctccccaccacctgcctcccctgtggtcccccacaaagtcagaattggaggggagcagcatgagtcccctcccaccacccagcacccacgcagagccagatcactgggtaaacacaggsctggcagccaggaaaaggagtgatatcttgagcaaatttcttctccacgccctgtaaatttactttttgtcctgtcacagggaaacgctggcaacgacctgtcccaagggctgggtcaccctgccacggcctcgcccaccgctgcggccccgtacctggcagctgtccacgccacccgtcaggtagcccgcgcagagcatggagggggagatgatgccaccgtacacgtccctgtggttgcagatcttgttggaaatcaaagggacggccgcgtggttcaggacaggggaggcgtcacct

SEQ ID NO: 181320 - DNA, 601 bp, Human
gcccctggggatctgtgtcccgtgaaggcctccatgtactgcagacccgtgtggaggaccggcttctcctttcctgccctttgccctctgtgcccacgcgacccttctgtgccccccaggctcccacagcaccctgaacagtgaggaggtctcccattcagttgtccatcctggtcctttctacagtgcgggcgggctgggctgagctttatactgaagagcatagcaggccactcagtgcctagtatggggccaggctgcctctcccagcaaggtgagcaggagcaagcactttccaccsagcccgagcacagccctcaccacgccccgagggggtgctcagggctgcagggcggcagtgctggaggtgaagctagcccaggtctcagtcccaggcctcaccctgtgcccgtgggcaccattctttagtttctcatttaaagcacaaaatcagtgagagcaaaacgggaattaacgcctgaggcacattcagcatttgatgtcctttcttggccaattgtttcaaattaaatgagctttttaaaaaggtctttgagccttggagacagaaagctgactggtgggtgccagaggctgggga

SEQ ID NO: 181321 - DNA, 601 bp, Human
agcccctggggatctgtgtcccgtgaaggcctccatgtactgcagacccgtgtggaggaccggcttctcctttcctgccctttgccctctgtgcccacgcgacccttctgtgccccccaggctcccacagcaccctgaacagtgaggaggtctcccattcagttgtccatcctggtcctttctacagtgcgggcgggctgggctgagctttatactgaagagcatagcaggccactcagtgcctagtatggggccaggctgcctctcccagcaaggtgagcaggagcaagcactttccacscagcccgagcacagccctcaccacgccccgagggggtgctcagggctgcagggcggcagtgctggaggtgaagctagcccaggtctcagtcccaggcctcaccctgtgcccgtgggcaccattctttagtttctcatttaaagcacaaaatcagtgagagcaaaacgggaattaacgcctgaggcacattcagcatttgatgtcctttcttggccaattgtttcaaattaaatgagctttttaaaaaggtctttgagccttggagacagaaagctgactggtgggtgccagaggctgggg

SEQ ID NO: 181322 - DNA, 601 bp, Human
caattttgttttaaacccccaactagatagagaaaagtgctggatgaaaatgaagatgaggccatgggcatgccaccaactagcacacgggacacttccccgcaagacagtgagtcttccaaaggccctcacgttgactttcctcacaatggacaactgaaacgcacagcgggcctgctggaaagcctcccaggaaaggaagtctcttctgggtctcccctaggacgtctgaagagggacttgggaaagggcgtgtctgaggctgcgcatctctcgcatgcactggtgggttggaggcagyggatgactaaggcgttgtgcagggagcaggggccccaggcatcgccggagccagcgtcacagacgagctcctccaccacagcttcaccacaacaggggaaactgcctccaagaccctcccagggtttctcagtgtgccctgaagcccccatgcaacacattcaccagggtcttcaccccagacctcccaatcagactccagataaacgccctgcaatcttcacatttaacaaacatcctgagagaggcttctgcacccctaagtttgagatctgttgattctgctgtgcagtcacactgg

SEQ ID NO: 181323 - DNA, 601 bp, Human
tgaggcaagagaatcgcttgaaccagggaagcggaggctgcagtgagcagggatttcgccactgcactccagcctgggcaacagagcgagactccatctcaaaaaaacaaaaaacaaaaagcagcttgaaggttgtgctggaatcagatggaagggtgcctctttcgggcctgctactggtgccggaactcagagctccaagggtgtctgctcgtgtgcaggttcctacacgggagtccaggggaggatcgggctgtcttcatcacctcaggaactcaggtggctacttgtccccttcctyttcaggtttttaggtctctctataaatgaaaacaaaggcgttattgtttttagcacttccagccatccgtccaacatgatgacggagcgggcacctgcattttgccctgtgggaattgtggggctgttctccacgatgaagacaaggttggcctccccctggggctgccagctctgagtggatcccaggcaggcatgaaaagctccaaccagcaatgcatccgcaggtcccatctccgccctgcgacagttccgtcacttccgtaggaaacttccaggtctcggcactatgttcctgagt

SEQ ID NO: 181324 - DNA, 601 bp, Human
agacaatgagggaaggaaacatattatttggaatcaaaggacaataatacgtcaagcaccaaatgctacaaagaaatcatgaaaataggccttaaacgagtcattcctagattaacctccccacatgtgaaaataagtcttggaagtagaaagggtgggtttggttctggtccctagagatgaaaacgtgcagtgactgcagttctgcacttctgggctggtgcgtcttttctgagtggctgttggtggctttgcacgtgaggtcacataactgcttatctcgtcaggaattttgcaagacccctggagagaaaaccagatggaccagtgggaaaggccgcccttgcaagttgctgcttcttttgttcttagtgaagatcagaaaggagcgtgaggctaggcgtggtggcccatgcctgtaatcccagcactgtgggaggctgaagcaggcacatcatttgaggtcaggggtttgagagcagcctggccaacatggtgaaaccctgtctctactaaaaatacaaaaattagttgggtgtggtggcgggcacctgtggtcccagctactggggaagctgaggcaagagaatcgcttgaacca

SEQ ID NO: 181325 - DNA, 601 bp, Human
gctcacacccactactttgcctggccttgctctacttttgagttctgtgtatgacacgagctgatgctgatctgctgagcaacctgttccgacagaagaatgccaagtccacaacgcacacaggagagatgacagtaatggagcccctggaattcagtggatgattttgattcacgtcaccagtccacgcagacacgccagacaatgagggaaggaaacatattatttggaatcaaaggacaataatacgtcaagcaccaaatgctacaaagaaatcatgaaaataggccttaaacgagtmattcctagattaacctccccacatgtgaaaataagtcttggaagtagaaagggtgggtttggttctggtccctagagatgaaaacgtgcagtgactgcagttctgcacttctgggctggtgcgtcttttctgagtggctgttggtggctttgcacgtgaggtcacataactgcttatctcgtcaggaattttgcaagacccctggagagaaaaccagatggaccagtgggaaaggccgcccttgcaagttgctgcttcttttgttcttagtgaagatcagaaaggagcgtgaggctaggc

SEQ ID NO: 181326 - DNA, 601 bp, Human; identical to SEQ ID NO: 181289

SEQ ID NO: 181327 - DNA, 601 bp, Human; identical to SEQ ID NO: 181290

SEQ ID NO: 181328 - DNA, 601 bp, Human; identical to SEQ ID NO: 181291

SEQ ID NO: 181329 - DNA, 601 bp, Human; identical to SEQ ID NO: 181292

SEQ ID NO: 181330 - DNA, 601 bp, Human; identical to SEQ ID NO: 181293

SEQ ID NO: 181331 - DNA, 601 bp, Human; identical to SEQ ID NO: 181294

SEQ ID NO: 181332 - DNA, 601 bp, Human; identical to SEQ ID NO: 181295

SEQ ID NO: 181333 - DNA, 601 bp, Human; identical to SEQ ID NO: 181296

SEQ ID NO: 181334 - DNA, 601 bp, Human; identical to SEQ ID NO: 181297

SEQ ID NO: 181335 - DNA, 601 bp, Human; identical to SEQ ID NO: 181298

SEQ ID NO: 181336 - DNA, 601 bp, Human; identical to SEQ ID NO: 181299

SEQ ID NO: 181337 - DNA, 601 bp, Human; identical to SEQ ID NO: 181300

SEQ ID NO: 181338 - DNA, 601 bp, Human; identical to SEQ ID NO: 181301

SEQ ID NO: 181339 - DNA, 601 bp, Human; identical to SEQ ID NO: 181302

SEQ ID NO: 181340 - DNA, 601 bp, Human; identical to SEQ ID NO: 181303

SEQ ID NO: 181341 - DNA, 601 bp, Human; identical to SEQ ID NO: 181304

SEQ ID NO: 181342 - DNA, 601 bp, Human; identical to SEQ ID NO: 181305

SEQ ID NO: 181343 - DNA, 601 bp, Human; identical to SEQ ID NO: 181306

SEQ ID NO: 181344 - DNA, 601 bp, Human; identical to SEQ ID NO: 181307

SEQ ID NO: 181345 - DNA, 601 bp, Human; identical to SEQ ID NO: 181308

SEQ ID NO: 181346 - DNA, 601 bp, Human; identical to SEQ ID NO: 181309

SEQ ID NO: 181347 - DNA, 601 bp, Human; identical to SEQ ID NO: 181310

SEQ ID NO: 181348 - DNA, 601 bp, Human; identical to SEQ ID NO: 181311

SEQ ID NO: 181349 - DNA, 601 bp, Human; identical to SEQ ID NO: 181312

SEQ ID NO: 181350 - DNA, 601 bp, Human; identical to SEQ ID NO: 181313

SEQ ID NO: 181351 - DNA, 601 bp, Human; identical to SEQ ID NO: 181314

SEQ ID NO: 181352 - DNA, 601 bp, Human; identical to SEQ ID NO: 181315

SEQ ID NO: 181353 - DNA, 601 bp, Human; identical to SEQ ID NO: 181316

SEQ ID NO: 181354 - DNA, 601 bp, Human; identical to SEQ ID NO: 181317

SEQ ID NO: 181355 - DNA, 601 bp, Human; identical to SEQ ID NO: 181318

SEQ ID NO: 181356 - DNA, 601 bp, Human; identical to SEQ ID NO: 181319

SEQ ID NO: 181357 - DNA, 601 bp, Human; identical to SEQ ID NO: 181320

SEQ ID NO: 181358 - DNA, 601 bp, Human; identical to SEQ ID NO: 181321

SEQ ID NO: 181359 - DNA, 601 bp, Human; identical to SEQ ID NO: 181322

SEQ ID NO: 181360 - DNA, 601 bp, Human; identical to SEQ ID NO: 181323

SEQ ID NO: 181361 - DNA, 601 bp, Human; identical to SEQ ID NO: 181324

SEQ ID NO: 181362 - DNA, 601 bp, Human; identical to SEQ ID NO: 181325

SEQ ID NO: 181363 - DNA, 601 bp, Human; identical to SEQ ID NO: 181289

SEQ ID NO: 181364 - DNA, 601 bp, Human; identical to SEQ ID NO: 181290

SEQ ID NO: 181365 - DNA, 601 bp, Human; identical to SEQ ID NO: 181291

SEQ ID NO: 181366 - DNA, 601 bp, Human; identical to SEQ ID NO: 181292

SEQ ID NO: 181367 - DNA, 601 bp, Human; identical to SEQ ID NO: 181293

SEQ ID NO: 181368 - DNA, 601 bp, Human; identical to SEQ ID NO: 181294

SEQ ID NO: 181369 - DNA, 601 bp, Human; identical to SEQ ID NO: 181295

SEQ ID NO: 181370 - DNA, 601 bp, Human; identical to SEQ ID NO: 181296

SEQ ID NO: 181371 - DNA, 601 bp, Human; identical to SEQ ID NO: 181297

SEQ ID NO: 181372 - DNA, 601 bp, Human; identical to SEQ ID NO: 181298

SEQ ID NO: 181373 - DNA, 601 bp, Human; identical to SEQ ID NO: 181299

SEQ ID NO: 181374 - DNA, 601 bp, Human; identical to SEQ ID NO: 181300

SEQ ID NO: 181375 - DNA, 601 bp, Human; identical to SEQ ID NO: 181301

SEQ ID NO: 181376 - DNA, 601 bp, Human; identical to SEQ ID NO: 181302

SEQ ID NO: 181377 - DNA, 601 bp, Human; identical to SEQ ID NO: 181303

SEQ ID NO: 181378 - DNA, 601 bp, Human; identical to SEQ ID NO: 181304

SEQ ID NO: 181379 - DNA, 601 bp, Human; identical to SEQ ID NO: 181305

SEQ ID NO: 181380 - DNA, 601 bp, Human; identical to SEQ ID NO: 181306

SEQ ID NO: 181381 - DNA, 601 bp, Human; identical to SEQ ID NO: 181307

SEQ ID NO: 181382 - DNA, 601 bp, Human; identical to SEQ ID NO: 181308

SEQ ID NO: 181383 - DNA, 601 bp, Human; identical to SEQ ID NO: 181309

SEQ ID NO: 181384 - DNA, 601 bp, Human; identical to SEQ ID NO: 181310

SEQ ID NO: 181385 - DNA, 601 bp, Human; identical to SEQ ID NO: 181311

SEQ ID NO: 181386 - DNA, 601 bp, Human; identical to SEQ ID NO: 181312

SEQ ID NO: 181387 - DNA, 601 bp, Human; identical to SEQ ID NO: 181313

SEQ ID NO: 181388 - DNA, 601 bp, Human; identical to SEQ ID NO: 181314

SEQ ID NO: 181389 - DNA, 601 bp, Human; identical to SEQ ID NO: 181315

SEQ ID NO: 181390 - DNA, 601 bp, Human; identical to SEQ ID NO: 181316

SEQ ID NO: 181391 - DNA, 601 bp, Human; identical to SEQ ID NO: 181317

SEQ ID NO: 181392 - DNA, 601 bp, Human; identical to SEQ ID NO: 181318

SEQ ID NO: 181393 - DNA, 601 bp, Human; identical to SEQ ID NO: 181319

SEQ ID NO: 181394 - DNA, 601 bp, Human; identical to SEQ ID NO: 181320

SEQ ID NO: 181395 - DNA, 601 bp, Human; identical to SEQ ID NO: 181321

SEQ ID NO: 181396 - DNA, 601 bp, Human; identical to SEQ ID NO: 181322

SEQ ID NO: 181397 - DNA, 601 bp, Human; identical to SEQ ID NO: 181323

SEQ ID NO: 181398 - DNA, 601 bp, Human; identical to SEQ ID NO: 181324

SEQ ID NO: 181399 - DNA, 601 bp, Human; identical to SEQ ID NO: 181325

SEQ ID NO: 181400 - DNA, 601 bp, Human; identical to SEQ ID NO: 38798

SEQ ID NO: 181401 - DNA, 601 bp, Human; identical to SEQ ID NO: 38799

SEQ ID NO: 181402 - DNA, 601 bp, Human; identical to SEQ ID NO: 38800

SEQ ID NO: 181403 - DNA, 601 bp, Human; identical to SEQ ID NO: 38801

SEQ ID NO: 181404 - DNA, 601 bp, Human; identical to SEQ ID NO: 38802

SEQ ID NO: 181405 - DNA, 601 bp, Human; identical to SEQ ID NO: 38803

SEQ ID NO: 181406 - DNA, 601 bp, Human; identical to SEQ ID NO: 38804

SEQ ID NO: 181407 - DNA, 601 bp, Human; identical to SEQ ID NO: 38805

SEQ ID NO: 181408 - DNA, 601 bp, Human; identical to SEQ ID NO: 38806

SEQ ID NO: 181409 - DNA, 601 bp, Human; identical to SEQ ID NO: 38807

SEQ ID NO: 181410 - DNA, 601 bp, Human; identical to SEQ ID NO: 38808

SEQ ID NO: 181411 - DNA, 601 bp, Human; identical to SEQ ID NO: 38809

SEQ ID NO: 181412 - DNA, 601 bp, Human; identical to SEQ ID NO: 38810

SEQ ID NO: 181413 - DNA, 601 bp, Human; identical to SEQ ID NO: 38811

SEQ ID NO: 181414 - DNA, 601 bp, Human; identical to SEQ ID NO: 38812

SEQ ID NO: 181415 - DNA, 601 bp, Human; identical to SEQ ID NO: 38813

SEQ ID NO: 181416 - DNA, 601 bp, Human; identical to SEQ ID NO: 38814

SEQ ID NO: 181417 - DNA, 601 bp, Human; identical to SEQ ID NO: 38815

SEQ ID NO: 181418 - DNA, 601 bp, Human; identical to SEQ ID NO: 38816

SEQ ID NO: 181419 - DNA, 601 bp, Human; identical to SEQ ID NO: 38817

SEQ ID NO: 181420 - DNA, 601 bp, Human; identical to SEQ ID NO: 38818

SEQ ID NO: 181421 - DNA, 601 bp, Human; identical to SEQ ID NO: 38819

SEQ ID NO: 181422 - DNA, 601 bp, Human; identical to SEQ ID NO: 38820

SEQ ID NO: 181423 - DNA, 601 bp, Human; identical to SEQ ID NO: 38821

SEQ ID NO: 181424 - DNA, 601 bp, Human; identical to SEQ ID NO: 38822

SEQ ID NO: 181425 - DNA, 601 bp, Human; identical to SEQ ID NO: 38823

SEQ ID NO: 181426 - DNA, 601 bp, Human; identical to SEQ ID NO: 38824

SEQ ID NO: 181427 - DNA, 601 bp, Human; identical to SEQ ID NO: 38825

SEQ ID NO: 181428 - DNA, 601 bp, Human; identical to SEQ ID NO: 38826

SEQ ID NO: 181429 - DNA, 601 bp, Human; identical to SEQ ID NO: 38827

SEQ ID NO: 181430 - DNA, 601 bp, Human; identical to SEQ ID NO: 38828

SEQ ID NO: 181431 - DNA, 601 bp, Human; identical to SEQ ID NO: 38829

SEQ ID NO: 181432 - DNA, 601 bp, Human; identical to SEQ ID NO: 38830

SEQ ID NO: 181433 - DNA, 601 bp, Human; identical to SEQ ID NO: 38831

SEQ ID NO: 181434 - DNA, 601 bp, Human; identical to SEQ ID NO: 38832

SEQ ID NO: 181435 - DNA, 601 bp, Human; identical to SEQ ID NO: 38833

SEQ ID NO: 181436 - DNA, 601 bp, Human; identical to SEQ ID NO: 38834

SEQ ID NO: 181437 - DNA, 601 bp, Human; identical to SEQ ID NO: 38835

SEQ ID NO: 181438 - DNA, 601 bp, Human; identical to SEQ ID NO: 38836

SEQ ID NO: 181439 - DNA, 601 bp, Human; identical to SEQ ID NO: 38837

SEQ ID NO: 181440 - DNA, 601 bp, Human; identical to SEQ ID NO: 38838

SEQ ID NO: 181441 - DNA, 601 bp, Human; identical to SEQ ID NO: 38839

SEQ ID NO: 181442 - DNA, 601 bp, Human; identical to SEQ ID NO: 38840

SEQ ID NO: 181443 - DNA, 601 bp, Human; identical to SEQ ID NO: 38841

SEQ ID NO: 181444 - DNA, 601 bp, Human; identical to SEQ ID NO: 38842

SEQ ID NO: 181445 - DNA, 601 bp, Human; identical to SEQ ID NO: 38843

SEQ ID NO: 181446 - DNA, 601 bp, Human; identical to SEQ ID NO: 38844

SEQ ID NO: 181447 - DNA, 601 bp, Human; identical to SEQ ID NO: 38845

SEQ ID NO: 181448 - DNA, 601 bp, Human; identical to SEQ ID NO: 38846

SEQ ID NO: 181449 - DNA, 601 bp, Human; identical to SEQ ID NO: 38847

SEQ ID NO: 181450 - DNA, 601 bp, Human; identical to SEQ ID NO: 38848

SEQ ID NO: 181451 - DNA, 601 bp, Human; identical to SEQ ID NO: 38849

SEQ ID NO: 181452 - DNA, 601 bp, Human; identical to SEQ ID NO: 38850

SEQ ID NO: 181453 - DNA, 601 bp, Human; identical to SEQ ID NO: 38851

SEQ ID NO: 181454 - DNA, 601 bp, Human; identical to SEQ ID NO: 38852

SEQ ID NO: 181455 - DNA, 601 bp, Human; identical to SEQ ID NO: 38853

SEQ ID NO: 181456 - DNA, 601 bp, Human; identical to SEQ ID NO: 38854

SEQ ID NO: 181457 - DNA, 601 bp, Human; identical to SEQ ID NO: 38855

SEQ ID NO: 181458 - DNA, 601 bp, Human; identical to SEQ ID NO: 38856

SEQ ID NO: 181459 - DNA, 601 bp, Human; identical to SEQ ID NO: 38857

SEQ ID NO: 181460 - DNA, 601 bp, Human; identical to SEQ ID NO: 38858

SEQ ID NO: 181461 - DNA, 601 bp, Human; identical to SEQ ID NO: 38859

SEQ ID NO: 181462 - DNA, 601 bp, Human; identical to SEQ ID NO: 38860

SEQ ID NO: 181463 - DNA, 601 bp, Human
aatgctcacacatccactcacaaacacacacacgcacacacgtgcatacacacacgtgcacatgagcacacagacatgcacaccacataggcacatgcacacacactttttctgcccgatagatgagaatgtatcaaagacctgcctttaaaagcaaaagtctttttaaagtgagttgtcaccagatcaacagtagcaggtccgtcctaagaacttcctaaagatgtcccgggagcagctctcttggaagcaggtgaaaagtggaggagagcttcaggaggggtgggaggaggacgctggkcatggcaggccaggctgttattgtgggcagggtagcttttcacagtggacacgctgaggttggggtgatctccagaaaagcagcctgcaggtgggccctggggaagacatggcatgtggcacctttgcgggggagaggcggattgactgccagctctaccacttcctgtaccacgagcaagcccctgggctccccaagctggcatccccgtccataaagaagggataataaaatctgctttatagactggaatgagaagggaatgagtgaatgtaaacactgcctggaacactgcagaac

SEQ ID NO: 181464 - DNA, 601 bp, Human
ctgcagaacacgatgagcattattcttccctcagttccttccataaacgtccttttgtggtgcaaacagggaggcgccagacgggtctccaacccccaccccgccccccatctccacgaggtctgttgcttgctcctgagctgcccccgccctctgccccttgctgtgaaccccgttggaagctcctagctggactgtgagtcctggttgaagctgaatcgtttgcccaagccatgtgccgggcaaagcatgataacttctcgctcacctcccaggctgcacacccagcagtgctgtcacrgatgggttgcaccgggctcagctgagagcactttcagtgccgctgccatcagccgccattccttctcttaaagtaccaggcactgggtaaatcctggaatttccagcgtgaatctgtctccctgccatccgccccatctcctctccatcaaaggtcatggaaacaaacccatgttgcttcctaggagggagccctgggggtcactgggtgcaggagataagggatgtgttgctttccgtcactgtgttcgtcggcaccacctggccatgagtcctggcgatgggcacacccgccccttcg

SEQ ID NO: 181465 - DNA, 601 bp, Human
gctcctgagctgcccccgccctctgccccttgctgtgaaccccgttggaagctcctagctggactgtgagtcctggttgaagctgaatcgtttgcccaagccatgtgccgggcaaagcatgataacttctcgctcacctcccaggctgcacacccagcagtgctgtcacggatgggttgcaccgggctcagctgagagcactttcagtgccgctgccatcagccgccattccttctcttaaagtaccaggcactgggtaaatcctggaatttccagcgtgaatctgtctccctgccatccrccccatctcctctccatcaaaggtcatggaaacaaacccatgttgcttcctaggagggagccctgggggtcactgggtgcaggagataagggatgtgttgctttccgtcactgtgttcgtcggcaccacctggccatgagtcctggcgatgggcacacccgccccttcgttatctctgctctttgtccctctggttacctgacccctggccatctcagtttccccctgagaccgcagagacggggaggaaggagggaacattagaaactgggggttctgccgagttctgtgctccggcaa

SEQ ID NO: 181466 - DNA, 601 bp, Human
tttccccctgagaccgcagagacggggaggaaggagggaacattagaaactgggggttctgccgagttctgtgctccggcaaagctccaggttgacaatctgaagttgtctgagggaggccccgggcagcaagtgccggtgtctcctggcttggccttacctgtgcaggtaaccctgcagacatgcccagtgattcagaggagccgctgcagccacttggcgccaggccaatgctttatttatatgaagaaaactccagacacgcacaggtgtcacatcaccagagtgacacagtgggagwcagcaacaggaatttgggggattgtcttccctcctcaggagcttttccttcagaggttgtgcagaggaagctgggcgtgtgaagtgagtcggaggttgcctcctgagccctacacgaaggcaggactctgtgccctggagtccaactgaggctccgttttcagtgctcccctctcatctcgagaaccttgggtcagttacttcactctgtgcccctgtgctgctgtgctaataattaaatgggataaggcagattgcctggtcaatgagcccgccgtgtttattgagcatctactatgtg

SEQ ID NO: 181467 - DNA, 601 bp, Human
gttgacaatctgaagttgtctgagggaggccccgggcagcaagtgccggtgtctcctggcttggccttacctgtgcaggtaaccctgcagacatgcccagtgattcagaggagccgctgcagccacttggcgccaggccaatgctttatttatatgaagaaaactccagacacgcacaggtgtcacatcaccagagtgacacagtgggagtcagcaacaggaatttgggggattgtcttccctcctcaggagcttttccttcagaggttgtgcagaggaagctgggcgtgtgaagtgagtyggaggttgcctcctgagccctacacgaaggcaggactctgtgccctggagtccaactgaggctccgttttcagtgctcccctctcatctcgagaaccttgggtcagttacttcactctgtgcccctgtgctgctgtgctaataattaaatgggataaggcagattgcctggtcaatgagcccgccgtgtttattgagcatctactatgtgctgagtgctggggtccatgggaagctgagtgctggcggaatgggaaggcaactacaaatgataaacagcagcagacgttgcaggctgggt

SEQ ID NO: 181468 - DNA, 601 bp, Human
tttcagtgctcccctctcatctcgagaaccttgggtcagttacttcactctgtgcccctgtgctgctgtgctaataattaaatgggataaggcagattgcctggtcaatgagcccgccgtgtttattgagcatctactatgtgctgagtgctggggtccatgggaagctgagtgctggcggaatgggaaggcaactacaaatgataaacagcagcagacgttgcaggctgggtgggccagccccgtgtggggcctgatgaacaggtttttttccctgacgatcggctttgcaggctttgtrggctttgtggggaaggagccctttgtgcagaactggtagccatgaggatggcctggtgagaagctgctgaagggctggggacagcctccacccagccagcagcatctgcaccggcctgttcccgtcatctgttccttggcttgccagggtgcacagatcaggacttggcacttccccagcaccaggtgaagccctcctgtcacccccaaccccgtgtctagaccctcaggtgggctgttaaagaaggggagaggtggaagccaggtccccaaacctagggtgctgaggtccttgcttcag

SEQ ID NO: 181469 - DNA, 601 bp, Human
agcagtgaatgcgcacagcccaaagggaggagccgcgctagaaagtgttcaagcgtccgcagaagtcggctcccagttcttaatagtttgccacccaccgtggctacgccacacctacgcttgcctccacccgacctatgcctgcccccttcacatgcgggagcccagggctccgtgccctgggcagctggtggggtctgcccaggccttctcgtgatgcttccacccagcctggtcctggcacccaaggccaacctctgcgggccccagagctgtgcctttttggctcaggtcctccccrcagtgcttggagtccaggcctctgcaccctgctggggtggtctgtggtcctggcccaagggaatgtcgctccctgctgcctggttctactgatctgtcctgttcaggcccctctgccttcatttcttgctttggcacaagcatgagctgctgtttcccccagctcctcaggggagaggagtgcactgccccaaccttgtctggtgtggttagcatggtggggccttaagccctacccggctcctgcgtgcctttcccctctcctgcccacgacatggtcaaatgcaaacctcctttcatt

SEQ ID NO: 181470 - DNA, 601 bp, Human
gggaagtggaggctcactgtgcagtccacgcggagcaatggggtgaagtttccagagcagggcagggcatgtggggaggctcaggaatgccacccttgccctcaggcctgggcacagcatagcccccatgacgcttctctcatcctggacccatcagcccggaagactctggaagcagcagtggcagcaccttcctgtcacttgtcttgtcactccccgagtccactgtgagctagaaccacaggctcccatgaagaaggagccagaaccacaggccccatgagcccaggtcccacagccmgcaccttcgtcttccagccagcctctccggagctcagtgtgggtggaggggctgtctggcctcagaaatgggcaaaagacagctctcgttgtcagcgaggtaaatctagcgcagaggaagggcacactgtccccgtcagacgcctcagatgaactgacatgcaaatgagagatgaaacggggacgagccgggcagctgatctcagtgcagcaactgggacacctcggggcataagccgggcagggaggcggcaggaactgggccccagggggccaagacttcctgagaggctgggcccgg

SEQ ID NO: 181471 - DNA, 601 bp, Human
ttctctcatcctggacccatcagcccggaagactctggaagcagcagtggcagcaccttcctgtcacttgtcttgtcactccccgagtccactgtgagctagaaccacaggctcccatgaagaaggagccagaaccacaggccccatgagcccaggtcccacagcccgcaccttcgtcttccagccagcctctccggagctcagtgtgggtggaggggctgtctggcctcagaaatgggcaaaagacagctctcgttgtcagcgaggtaaatctagcgcagaggaagggcacactgtcccygtcagacgcctcagatgaactgacatgcaaatgagagatgaaacggggacgagccgggcagctgatctcagtgcagcaactgggacacctcggggcataagccgggcagggaggcggcaggaactgggccccagggggccaagacttcctgagaggctgggcccggtagcccagtcctgggcttgcttcccagggggtggtgggcaaccctgaaccctctctcacccaatcacctgctcccctgggtgcaggtgacccagcaagccgcactcctgggaaatttcagaaggttttgggcaa

SEQ ID NO: 181472 - DNA, 601 bp, Human
acattttcaagctcaaaaagaaatattttcacttgagggtgcaacttatttgtcttgaacccatccctgactgcctgtctcccccctcaccctgaccacatctccccaaatcccgaagctggtcacgcaacgggagcattggccctgaacagaaacccgcagtacccctgaaaactcggtctagaaacaactaaaagaagaaccacagcattttattccgtttgctttagattctctgccaatttttttttttttttgagatggagtctcgctctgtcgcccaggctagagtgcagtggcrtgatctcggctcactgcaacctccgcctcccaggttcaaggaattctcctgcctcagcctccggagtagctgggactacaggcgcctgccaccaggcccggctaattttttatttttagtagagacggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatcc

SEQ ID NO: 181473 - DNA, 601 bp, Human
ccctgaccacatctccccaaatcccgaagctggtcacgcaacgggagcattggccctgaacagaaacccgcagtacccctgaaaactcggtctagaaacaactaaaagaagaaccacagcattttattccgtttgctttagattctctgccaatttttttttttttttgagatggagtctcgctctgtcgcccaggctagagtgcagtggcgtgatctcggctcactgcaacctccgcctcccaggttcaaggaattctcctgcctcagcctccggagtagctgggactacaggcgcctgycaccaggcccggctaattttttatttttagtagagacggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatccccctcccccagcccctgacccccactgtacattccgctttctatctccatgaaactgctgagtgcggggacctcacagaagtggaatca

SEQ ID NO: 181474 - DNA, 601 bp, Human
atctccccaaatcccgaagctggtcacgcaacgggagcattggccctgaacagaaacccgcagtacccctgaaaactcggtctagaaacaactaaaagaagaaccacagcattttattccgtttgctttagattctctgccaatttttttttttttttgagatggagtctcgctctgtcgcccaggctagagtgcagtggcgtgatctcggctcactgcaacctccgcctcccaggttcaaggaattctcctgcctcagcctccggagtagctgggactacaggcgcctgccaccaggccyggctaattttttatttttagtagagacggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatccccctcccccagcccctgacccccactgtacattccgctttctatctccatgaaactgctgagtgcggggacctcacagaagtggaatcacacaggatcg

SEQ ID NO: 181475 - DNA, 601 bp, Human
tgccaatttttttttttttttgagatggagtctcgctctgtcgcccaggctagagtgcagtggcgtgatctcggctcactgcaacctccgcctcccaggttcaaggaattctcctgcctcagcctccggagtagctgggactacaggcgcctgccaccaggcccggctaattttttatttttagtagagacggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatccccctcccccagcccctgacccccactgtacattccgctttctatctccatgaaactgctgagtgcggggacctcacagaagtggaatcacacaggatcgccctgctgtgcctggcctccttcactcggatcatgccctcaggtgcatccatgttgtagcacgtgtccgaatttcctgcctttttaaggccgagcggtattccattgtgtgcgtggaccacattttgtgtttccatt

SEQ ID NO: 181476 - DNA, 601 bp, Human
catggctgtgctgctttgcgaagctgtgtgcatgtctgtggtgtagcctgtgtacagcctgtgatgcgtcgcagcggaagggtagggggctgcccagggaagacagatgcgccaggttccgctccacggagctcagctaccagccctggtggagagcgcagatggggccgatttgtcatttgtctgcgcttgagcccagcagctgtgtggcctccctggggcaagtcattcaccctctctgtgcctcagtgtctctgtgaagtggggggaagtttttggaagattaagtgggctaatacgygtcaaatgctagaacacactggcacttggtaaatgctatataagtgttatcatttttgtttgtttattatttatttatccatgtcatggatttaaggcagtctaatctcagtgcctggtggagacccgggcgccacccccccaggttgtcaagtggtccctgtgcctcccactatcgtccccagcacggtgccgtgtccgggcgtgcgtgaagggccagctcacctcacagctctgcttcccaggttagctcccatccaccctccccctacctgtttcctcaccgaaggaaggggcagaa

SEQ ID NO: 181477 - DNA, 601 bp, Human
aggtcatcagctggatgccaggacacccaggatgctccaggtccttgctggggtctggagtttgtgattcagcctcagtccctgtggtgagtccaccatgtgtcctcagacaatggatcagagagcccccagaggacggcccggggccgagtcgggtccagatgccaaaggggcttctcgaggcatctccagctcccacctgcccctcggagtgccaggcttggcttctggaagagaaagctgggggtttagtgactccagccaactgctgtgagcccaaggcatcaaactaaaaatagcraggccaagagggagtctttgtgttcggctcagtgggcaatggtgcctcacctcgcagcatgacacagggctgatgacacggggcacgttggtcacaaagtgccagtctcagcctggcacagggacgtgccacctgcaggtgatgacacatcacagtggcagccgctcctgatggtgctgctgcattgagtaggagcccagatccagggagacagttgcagcagatgaggcaggaggccagcgaggggttctacctgctttccgggctggcctctgcatggacacaaagcagaaagggcat

SEQ ID NO: 181478 - DNA, 601 bp, Human
aaaggggcttctcgaggcatctccagctcccacctgcccctcggagtgccaggcttggcttctggaagagaaagctgggggtttagtgactccagccaactgctgtgagcccaaggcatcaaactaaaaatagcgaggccaagagggagtctttgtgttcggctcagtgggcaatggtgcctcacctcgcagcatgacacagggctgatgacacggggcacgttggtcacaaagtgccagtctcagcctggcacagggacgtgccacctgcaggtgatgacacatcacagtggcagccgcycctgatggtgctgctgcattgagtaggagcccagatccagggagacagttgcagcagatgaggcaggaggccagcgaggggttctacctgctttccgggctggcctctgcatggacacaaagcagaaagggcataaaggtgaccctggccaccaaagcagacctggagcaaactggaccagcgcaaggccccggtgccagcactcagagacatttcttttctggcaggaaatttgtgcttcattttctaatgaaattccaaggcaatcaaaaggcaaggaaagaggagggaaaggaaggg

SEQ ID NO: 181479 - DNA, 601 bp, Human
cagccaactgctgtgagcccaaggcatcaaactaaaaatagcgaggccaagagggagtctttgtgttcggctcagtgggcaatggtgcctcacctcgcagcatgacacagggctgatgacacggggcacgttggtcacaaagtgccagtctcagcctggcacagggacgtgccacctgcaggtgatgacacatcacagtggcagccgctcctgatggtgctgctgcattgagtaggagcccagatccagggagacagttgcagcagatgaggcaggaggccagcgaggggttctacctgcyttccgggctggcctctgcatggacacaaagcagaaagggcataaaggtgaccctggccaccaaagcagacctggagcaaactggaccagcgcaaggccccggtgccagcactcagagacatttcttttctggcaggaaatttgtgcttcattttctaatgaaattccaaggcaatcaaaaggcaaggaaagaggagggaaaggaagggagggagggagggggttccattcccatccgaatggaagcccccaaggcttctgtagctccccccatcaccaacttcactcaccactcttatct

SEQ ID NO: 181480 - DNA, 601 bp, Human
catgacacagggctgatgacacggggcacgttggtcacaaagtgccagtctcagcctggcacagggacgtgccacctgcaggtgatgacacatcacagtggcagccgctcctgatggtgctgctgcattgagtaggagcccagatccagggagacagttgcagcagatgaggcaggaggccagcgaggggttctacctgctttccgggctggcctctgcatggacacaaagcagaaagggcataaaggtgaccctggccaccaaagcagacctggagcaaactggaccagcgcaaggcccyggtgccagcactcagagacatttcttttctggcaggaaatttgtgcttcattttctaatgaaattccaaggcaatcaaaaggcaaggaaagaggagggaaaggaagggagggagggagggggttccattcccatccgaatggaagcccccaaggcttctgtagctccccccatcaccaacttcactcaccactcttatctgatgcctcctatttgggtacacacggccgggtcggccttgcgagagactcagtttcctctcgacttccgcccgcctgcactgtcaccacgtcctgccatt

SEQ ID NO: 181481 - DNA, 601 bp, Human
gtcaggctgcagcagggctggttcctgaggcctctcctgggctggcacctcctccccgtgtccatgcagggccgagcctctgcatgtctgtgtcctcggcgcctcgttttacaaggacatctcattttaaaggcccggtctccaaataaggtcatatcgtgaagtgctggggtcagaactacagcatgaattttgacgggacacagttcagtccatagcacccgctttgggaagtgggaatgacctctcccttccccatcttctggcctttgtaaccctaatgtgggaaagcaggagggayccagaacgacattgggtcaccaaagagagcatcgcagcccaaaaggttgaaaggcggcaccaaggtcccgcgcctggtgaccgccgactcgccctcccgggctccaggctgtccccactcccccccgccccaaccccagcatgttgaggcgcctggtcccaactgcccattcactccctgtacacagactgcttctttgtcctccagccaggggtgaagggccatgctggcgaaacagcaaacaaccccaacatgctttgcagcctggccaaccacatgaccagtttgaggaggttggct

SEQ ID NO: 181482 - DNA, 601 bp, Human
aagtgggaatgacctctcccttccccatcttctggcctttgtaaccctaatgtgggaaagcaggagggatccagaacgacattgggtcaccaaagagagcatcgcagcccaaaaggttgaaaggcggcaccaaggtcccgcgcctggtgaccgccgactcgccctcccgggctccaggctgtccccactcccccccgccccaaccccagcatgttgaggcgcctggtcccaactgcccattcactccctgtacacagactgcttctttgtcctccagccaggggtgaagggccatgctggygaaacagcaaacaaccccaacatgctttgcagcctggccaaccacatgaccagtttgaggaggttggctggagatcacaatgaggaagttggatgagggggtccaacttctagcagcccataagcctatccattcagacaccaaatccatggaaaacagagagacaatatactgattttcaaaagggagacataccccagcaagtacagaccagggaacagggtgctgacgtggccacagttcttaaactactcgacttcatggatggggcacagttttttttaaaggaggatttagaat

SEQ ID NO: 181483 - DNA, 601 bp, Human
gcattacctttattccaaaagccttgctgggccttcttgaaaggactggcagccaccacttccctagaaacccgtggcaagttccctcctcccgaccccctgctgtttggtccaggaccccctgcagtcctgactgggacccacttggcccttctcaagggacccagcacaggacgtgtgtttctgctttgatgaaccgccctttcccccctgcagttctagtggaatctcccctcccttatcccattcccacttggaaatgatgatgatggaatgggcgatgccggcttaccaagacatccaagctctctgggtcgaagttggagagaggggtgcacaaaaaggattccactcctgtctgccttcccctgcctccccgctggggtgtccctttcccatggtttcctctaaatcttttcacccatgtccagccacaccattctcacatactgccttgaaactgggctcgaaggggctgcgtgctgagagaaggtcctctcccccagtgatcctccagaggggctgccgcctgggtcccccgagcacctcctaccccaccctccccattcctgccatccccagggtccagggagcccagatt

SEQ ID NO: 181484 - DNA, 601 bp, Human
gcccagattccagggaagggttgcattagctcccactcggagtcctgatgcagcagagacagacagaggccctgggagaagtgagcatgaattattaagacaagacaagggtgaggccccagagagggggtggcggaagggtcatgttcatgcagcgagagttgcttcgagcttgaaccgcgtatccaggagtcaagcagattgcaactggcgagaggccttcagaaatgccccgtgagagtcctgtgtgcagagctccatctcagcacacttcctgttcttttggttcgtcgatttttgyattttcagtcccctgtgatccattatttataacagtggagattggcctcagacactagcagtgaggaaaacaaaagcgaagctacgcagaaaaatgacaagagtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattcccca

SEQ ID NO: 181485 - DNA, 601 bp, Human
tttataacagtggagattggcctcagacactagcagtgaggaaaacaaaagcgaagctacgcagaaaaatgacaagagtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattccccacggattatcagagctgctccctccaccccccgccacgtcccacgcgggccacatcaactccctctgcagcctctggccagcggctgagccctccgtgtctcccctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaat

SEQ ID NO: 181486 - DNA, 601 bp, Human
acagtggagattggcctcagacactagcagtgaggaaaacaaaagcgaagctacgcagaaaaatgacaagagtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattccccacggattatcagagctgctccctccaccccccsccacgtcccacgcgggccacatcaactccctctgcagcctctggccagcggctgagccctccgtgtctcccctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaatcgctgg

SEQ ID NO: 181487 - DNA, 601 bp, Human
ggcctcagacactagcagtgaggaaaacaaaagcgaagctacgcagaaaaatgacaagagtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattccccacggattatcagagctgctccctccaccccccgccacgtcccacrcgggccacatcaactccctctgcagcctctggccagcggctgagccctccgtgtctcccctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaatcgctgggctgaaatccag

SEQ ID NO: 181488 - DNA, 601 bp, Human
gtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattccccacggattatcagagctgctccctccaccccccgccacgtcccacgcgggccacatcaactccctctgcagcctctggccagcggctgagccctccgtgtctccyctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaatcgctgggctgaaatccaggtgtgggcagggccgcgctccctctagaggctcccccggagattcccttccttgcctct

SEQ ID NO: 181489 - DNA, 601 bp, Human
ggctgagccctccgtgtctcccctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaatcgctgggctgaaatccaggtgtgggcagggccgcgctccctctagaggctcccccrgagattcccttccttgcctcttccagctgctggtggctgccagcagtttgggaattgcggccgcatcacaccacctttctgtttgttgttgacatccccgcctcccctgcctgcggggtcttagatgtctctctccttcccactgagtttcactccacatttgaattggattaactcatgccatgttaggcaaacgtgcccctcaaatccttccacttaacagacatttattgaaggttcctgtgtgcggggcccaagagaagggacattaaattaggagatgaaccttgggaggccatg

SEQ ID NO: 181490 - DNA, 601 bp, Human
aaagattccacccctcttagaacagagaccagggccgctgtagcaaatggccataaatgccacagcttaaaacaacagaaacggattatctcgcagctctggaggatggagtccaaaatctgaatcgctgggctgaaatccaggtgtgggcagggccgcgctccctctagaggctcccccggagattcccttccttgcctcttccagctgctggtggctgccagcagtttgggaattgcggccgcatcacaccacctttctgtttgttgttgacatccccgcctcccctgcctgcggggtyttagatgtctctctccttcccactgagtttcactccacatttgaattggattaactcatgccatgttaggcaaacgtgcccctcaaatccttccacttaacagacatttattgaaggttcctgtgtgcggggcccaagagaagggacattaaattaggagatgaaccttgggaggccatggcatgcttcggagcctcggcgtcaaaatgacaacccacaccccacttggcggttcatctggggccctggaatcagcagactgaggctggaacccagcaatggcacatgctggctgtatgt

SEQ ID NO: 181491 - DNA, 601 bp, Human
gccataaatgccacagcttaaaacaacagaaacggattatctcgcagctctggaggatggagtccaaaatctgaatcgctgggctgaaatccaggtgtgggcagggccgcgctccctctagaggctcccccggagattcccttccttgcctcttccagctgctggtggctgccagcagtttgggaattgcggccgcatcacaccacctttctgtttgttgttgacatccccgcctcccctgcctgcggggtcttagatgtctctctccttcccactgagtttcactccacatttgaattgsattaactcatgccatgttaggcaaacgtgcccctcaaatccttccacttaacagacatttattgaaggttcctgtgtgcggggcccaagagaagggacattaaattaggagatgaaccttgggaggccatggcatgcttcggagcctcggcgtcaaaatgacaacccacaccccacttggcggttcatctggggccctggaatcagcagactgaggctggaacccagcaatggcacatgctggctgtatgttctcgggcctcagtttcaacatcagtgacatggggatagaatctgccca

SEQ ID NO: 181492 - DNA, 601 bp, Human
gcagctctggaggatggagtccaaaatctgaatcgctgggctgaaatccaggtgtgggcagggccgcgctccctctagaggctcccccggagattcccttccttgcctcttccagctgctggtggctgccagcagtttgggaattgcggccgcatcacaccacctttctgtttgttgttgacatccccgcctcccctgcctgcggggtcttagatgtctctctccttcccactgagtttcactccacatttgaattggattaactcatgccatgttaggcaaacgtgcccctcaaatcctyccacttaacagacatttattgaaggttcctgtgtgcggggcccaagagaagggacattaaattaggagatgaaccttgggaggccatggcatgcttcggagcctcggcgtcaaaatgacaacccacaccccacttggcggttcatctggggccctggaatcagcagactgaggctggaacccagcaatggcacatgctggctgtatgttctcgggcctcagtttcaacatcagtgacatggggatagaatctgcccagcggagttaagtcaccgcatcccggagagccgagtgtctcata

SEQ ID NO: 181493 - DNA, 601 bp, Human
tgctcagcacggaatgaagaggttcaggaacttgcccacagccacggataatgagggacagagctggaattgagcccgggaacctgcacacacagcccagtgtgaccgtgccttctagagagaggccagccctggcaccaggtgggcatgccagcatcaccttcaaggtgtgctttaaggatccaagataatgtgggtgcttcaacagatgcatggcaataaaaggaaagcaccatgtttcaccttcacacacacacacttacacattcacacactcacatacttacacacattctcatayactcacacatatgcttacacacattcacaggctcacacatgcttacacacacattcacacgcacacacattcacacgcacacatacacttacacacattcacacacatacacttacattcacacacatacacttacattcacactcatacacatacatacattcacacacatattcacacattcacacatacacattcacacacatacacttagacaccacactcacattcacacacattcacatacatttacacacacatccacacacacattcacacacattcacatttacattcaca

SEQ ID NO: 181494 - DNA, 601 bp, Human
cacatacacttagacaccacactcacattcacacacattcacatacatttacacacacatccacacacacattcacacacattcacatttacattcacaaacattcacacatacattcacacgcacttacagtcacacatacacttatacacagtcacacagacttgcacatagacttacacacatacacttacacacgcactcacaccttcacacacacaggcaatcacacattcacactcacgtacacttacccacacattcacacatacacacaccacatacacgcatacacttacayatgcactcacacactatcacattcacacacacatacacttacaaactatcattcacacacatacacacatacacatgcattcacacacatgctcacacactcacacatacacttacactcacagtcacatacacccacattcacacacatacactcacattcacacgcacatacactctgacacacatatacatacattcactcacacatacattcacacacacacggatgcattagttttcaagtcaggatcctagcacagcccacaccctgcatttgcttggtgtctcctgaggtctc

SEQ ID NO: 181495 - DNA, 601 bp, Human
ttacacacgcactcacaccttcacacacacaggcaatcacacattcacactcacgtacacttacccacacattcacacatacacacaccacatacacgcatacacttacacatgcactcacacactatcacattcacacacacatacacttacaaactatcattcacacacatacacacatacacatgcattcacacacatgctcacacactcacacatacacttacactcacagtcacatacacccacattcacacacatacactcacattcacacgcacatacactctgacacacatayacatacattcactcacacatacattcacacacacacggatgcattagttttcaagtcaggatcctagcacagcccacaccctgcatttgcttggtgtctcctgaggtctctagttatacttcccatcccttttcttgccatgtatttcctgaacacatgttatctttgatccttaaaccatgacttagagatacagatgtatgacaagctgagagatgatgtgagactgttgttaattttttctccatgtactaattacattgtggttatcttaaccacaaaggaagcgttctactccag

SEQ ID NO: 181496 - DNA, 601 bp, Human
catgacttagagatacagatgtatgacaagctgagagatgatgtgagactgttgttaattttttctccatgtactaattacattgtggttatcttaaccacaaaggaagcgttctactccagagaaccgcgtggaaacagtgcagatggactagcacgatacctgagaggagctttaggataactccggtgctggggaggttggggcccagttcaagcaggaggggaggcgtggggacaggtgttgaagctgtgggtgtgcagcggaggcttcatgacgctttcctcctgctcttgtgtaygtctgagcatttccataacagggaagtgttttgttttgttttttaaataacattttaaatgcctctggcacatgggaatccatggtaatttctgtcgttgttgtatattctttttcaaatgcaaggacctgaaaaatatctcctaaactggaaaaggaaatgaggctgaatacagattttattttagcaaatagagaagcagtgattgtctggcggttaactgtaatccattctgagtgtgactttactgttaagtattctaaaaacaagagaccaaacaaaatgaacaatatgtccaaa

SEQ ID NO: 181497 - DNA, 601 bp, Human
tgacagatgattcatagataacttgcaatgtttcttcagtgaacgcatatttatttcttgggtaataagaaaaaacaatagaatgtggaatttggggcttggcctcttttagctcatttaaaaaaatattaaacacttggaattatcgagcgctgaaaaaggcaatagaaaattcaccttttaactccctcaaagatagaaatgtgtgaatctgctagtgggttgcgtttggctggtcctgcaggctgatttggtctgttctctctcccagagagatccccaagcccggctgagatgtgcytgtttgtcttgagggcagacaaagcctagcaaaatcttatggaagctgatataaaagcttaatagcttataaaagctctaaaaatgattcacagtctaggatagagaaaataaaaggaatttgaattggtttattttcctttagaggagcctaaatcaatatttattctgagtatgcaatcagaaatatcagtaatttgagaacaaggcaaacagagctgcacatcccgttatggccacgagcccacctcgccttcgttcagaccacagctgaaggtctgacttaggtgcagcacgcacc

SEQ ID NO: 181498 - DNA, 601 bp, Human
aaaaaggcaatagaaaattcaccttttaactccctcaaagatagaaatgtgtgaatctgctagtgggttgcgtttggctggtcctgcaggctgatttggtctgttctctctcccagagagatccccaagcccggctgagatgtgcctgtttgtcttgagggcagacaaagcctagcaaaatcttatggaagctgatataaaagcttaatagcttataaaagctctaaaaatgattcacagtctaggatagagaaaataaaaggaatttgaattggtttattttcctttagaggagcctaartcaatatttattctgagtatgcaatcagaaatatcagtaatttgagaacaaggcaaacagagctgcacatcccgttatggccacgagcccacctcgccttcgttcagaccacagctgaaggtctgacttaggtgcagcacgcacccctggagctgagggcctggagcagggccaggccgggctcttctctctcttgtctgtcctcgtctgtgggggaatgaagatgacacagcactcaggaggtccttttcaggacccagagtcactgggcttttagggcgtttggctctggttctagcc

SEQ ID NO: 181499 - DNA, 601 bp, Human
aaatgtgtgaatctgctagtgggttgcgtttggctggtcctgcaggctgatttggtctgttctctctcccagagagatccccaagcccggctgagatgtgcctgtttgtcttgagggcagacaaagcctagcaaaatcttatggaagctgatataaaagcttaatagcttataaaagctctaaaaatgattcacagtctaggatagagaaaataaaaggaatttgaattggtttattttcctttagaggagcctaaatcaatatttattctgagtatgcaatcagaaatatcagtaatttsagaacaaggcaaacagagctgcacatcccgttatggccacgagcccacctcgccttcgttcagaccacagctgaaggtctgacttaggtgcagcacgcacccctggagctgagggcctggagcagggccaggccgggctcttctctctcttgtctgtcctcgtctgtgggggaatgaagatgacacagcactcaggaggtccttttcaggacccagagtcactgggcttttagggcgtttggctctggttctagcccgagtgtggtctcagtccccattggtggttgtggttgtggcatg

SEQ ID NO: 181500 - DNA, 601 bp, Human
ttatggccacgagcccacctcgccttcgttcagaccacagctgaaggtctgacttaggtgcagcacgcacccctggagctgagggcctggagcagggccaggccgggctcttctctctcttgtctgtcctcgtctgtgggggaatgaagatgacacagcactcaggaggtccttttcaggacccagagtcactgggcttttagggcgtttggctctggttctagcccgagtgtggtctcagtccccattggtggttgtggttgtggcatgggcatcattagtcacacaacataaaaccacrgaacgcagaatttgctcaccctggttcacacaggagcaagcttgggcaccagcaccccctgaacgcatgccaaagggcaggtccagctcagtgctggggtgtggaggaacccacctggggcctgcctgcaaagacagatgccctgccgtgtttagaaaaagagaaaactggcctaaaccacagtgaggtcaaatggatcatttaacccgtcgagtttggtttcttgttcatccgacgcggttgatcttattaacgcatatgtgtttgtgttgatgtggcctccagcttctgtcgcactgt

SEQ ID NO: 181501 - DNA, 601 bp, Human
gctctggttctagcccgagtgtggtctcagtccccattggtggttgtggttgtggcatgggcatcattagtcacacaacataaaaccacagaacgcagaatttgctcaccctggttcacacaggagcaagcttgggcaccagcaccccctgaacgcatgccaaagggcaggtccagctcagtgctggggtgtggaggaacccacctggggcctgcctgcaaagacagatgccctgccgtgtttagaaaaagagaaaactggcctaaaccacagtgaggtcaaatggatcatttaacccgtygagtttggtttcttgttcatccgacgcggttgatcttattaacgcatatgtgtttgtgttgatgtggcctccagcttctgtcgcactgtggacacagttggatgtggctgctaatcaatgcggggctccgtaggtcagtgagagcaatcagagcctgctgtgcggtggcatccccgagttaagacaggcttttgtcccatactctattgaaacacccagaaatgctgacatgttgaagttaaggccatgtgccttggtgctacttgcttgcgaaacagcctttgaaggaaaaaggaggag

SEQ ID NO: 181502 - DNA, 601 bp, Human
gtttcaagggtcccctcctgtaatcacggctgccactcaacggagtaagtaatgtgtagcgggccctctatctgcatgacgaatcctcctaacattcctgtgggcgaggtaggatttgtctcgctttgcagccgaagaatcagagcctcagaaaagttaagaaatcttccctgggtcaagctggtaggaggagggactggaactgaactcacatctccacctcctctcttcctactcctctgcctttcttgcacctagagcagtgtacaacatcaacaactgaccagggcgatcctagagrtaagagacagccgaatggcacggacccagccaagcccaggcctgcccaggtggaacagagccagctaggagcattcggtagcagaggtcagtccgctgattgactgttctcacttccaggcccacagcctcctccaccctgatggtctatgagtctagtgcggccctttgcacaattttagcaactgaacccttttcctcacagaattgtgataccgtcctaacatatgaagcatatataaacagttgggcaaatcataatagtttccattatttcataaatttgcatttgtggcaccaa

SEQ ID NO: 181503 - DNA, 601 bp, Human
tggcccagtcttacaaccagggtattgacagcgagacaagcccccatctgatccagattctccagttgtacttgctgatgtcgtttagatatttgtccccgccaaatctcatgttgaattggtatcctcagtgttggagtggggcctggtgggaggtgactggatcgtggggtgggtttctcacaaatggtttagtgccatccccttggtgctatccttgagatagtgaattcttgcaagatctggttgtttatgtgtgaaggtagaaggcatctcctctctctccctcacgggtgtgcaygcctcccttcatcatgtgatatgcctgctcctgtttcaccttccatcctgagtgaaagctccctgaggcctccccagaagcccagtgatgtcggtgccatgcttatacagcctgcagaactgtgagccaattagaaattggctttataaatgacccagtctcagatatttctttatagcaatgcaagaacagcctcatgcacttgtactcacttgagcatgtgcacttacttctgcacgatgttcttgcctgtgtagactcttacatccacaaccacagtcacagtctagaacattccat

SEQ ID NO: 181504 - DNA, 601 bp, Human
tttagatatttgtccccgccaaatctcatgttgaattggtatcctcagtgttggagtggggcctggtgggaggtgactggatcgtggggtgggtttctcacaaatggtttagtgccatccccttggtgctatccttgagatagtgaattcttgcaagatctggttgtttatgtgtgaaggtagaaggcatctcctctctctccctcacgggtgtgcacgcctcccttcatcatgtgatatgcctgctcctgtttcaccttccatcctgagtgaaagctccctgaggcctccccagaagccyagtgatgtcggtgccatgcttatacagcctgcagaactgtgagccaattagaaattggctttataaatgacccagtctcagatatttctttatagcaatgcaagaacagcctcatgcacttgtactcacttgagcatgtgcacttacttctgcacgatgttcttgcctgtgtagactcttacatccacaaccacagtcacagtctagaacattccatcgccgcaaggctgcctcttataaccaaccacatcccctacctgcacccatttccaacaccccatgcctaactcgatttccagc

SEQ ID NO: 181505 - DNA, 601 bp, Human
ccttcatcatgtgatatgcctgctcctgtttcaccttccatcctgagtgaaagctccctgaggcctccccagaagcccagtgatgtcggtgccatgcttatacagcctgcagaactgtgagccaattagaaattggctttataaatgacccagtctcagatatttctttatagcaatgcaagaacagcctcatgcacttgtactcacttgagcatgtgcacttacttctgcacgatgttcttgcctgtgtagactcttacatccacaaccacagtcacagtctagaacattccatcgccgyaaggctgcctcttataaccaaccacatcccctacctgcacccatttccaacaccccatgcctaactcgatttccagcaccccgtcctggtgaacatgaatctgttctctatctcttcaattccgtcatttcaagaatattatataaatgggattacacagtatgtaacctcttgagactggctttttccaactggcatcattcccttgagatccatccaagtggttgtgtgcaccttttccttgctgagccgtgttccatgttgtgggccgaccccagtttagcactcgcccattggagg

SEQ ID NO: 181506 - DNA, 601 bp, Human
acttgtactcacttgagcatgtgcacttacttctgcacgatgttcttgcctgtgtagactcttacatccacaaccacagtcacagtctagaacattccatcgccgcaaggctgcctcttataaccaaccacatcccctacctgcacccatttccaacaccccatgcctaactcgatttccagcaccccgtcctggtgaacatgaatctgttctctatctcttcaattccgtcatttcaagaatattatataaatgggattacacagtatgtaacctcttgagactggctttttccaactgkcatcattcccttgagatccatccaagtggttgtgtgcaccttttccttgctgagccgtgttccatgttgtgggccgaccccagtttagcactcgcccattggagggttggagggcatccgactcatctctagtgtggggcagtgcgtcaccttctcacaattgtcaacgggattgtcactagtatttgccttccatgtcttggaggccaatgtggctgctcttagaaatcagtcctccttattttggttggggagatttctgatgtcagtttgacgtttataattaataagcatcatcat

SEQ ID NO: 181507 - DNA, 601 bp, Human
ggagggcatccgactcatctctagtgtggggcagtgcgtcaccttctcacaattgtcaacgggattgtcactagtatttgccttccatgtcttggaggccaatgtggctgctcttagaaatcagtcctccttattttggttggggagatttctgatgtcagtttgacgtttataattaataagcatcatcatcaagttacaagagtaaataaaaatatgaggcagggtgaaatgtaagatgctcgagaggctgagatcagtagctgtgtgaatacagcagggcgggcaccagcagtgagckccacggggcccagcgtccggcctcattaaccagctgcccttggggaggagcagagcccgctcttccctcctggggaagggtagtgtgatggaaagacaggctgcccttctctcctgcaggagctcagcatcatgctgtgtacatgcctgggctctcttcttcagccctagccacttaaaaccacttggagggaaagattgtagaataattataatgaggaaaatttcgctccagattcgttactccaagttcagagaagctctgtaaaaattgttgctaaggcaattgaataaagaatgt

SEQ ID NO: 181508 - DNA, 601 bp, Human
attgtcaacgggattgtcactagtatttgccttccatgtcttggaggccaatgtggctgctcttagaaatcagtcctccttattttggttggggagatttctgatgtcagtttgacgtttataattaataagcatcatcatcaagttacaagagtaaataaaaatatgaggcagggtgaaatgtaagatgctcgagaggctgagatcagtagctgtgtgaatacagcagggcgggcaccagcagtgagctccacggggcccagcgtccggcctcattaaccagctgcccttggggaggagmagagcccgctcttccctcctggggaagggtagtgtgatggaaagacaggctgcccttctctcctgcaggagctcagcatcatgctgtgtacatgcctgggctctcttcttcagccctagccacttaaaaccacttggagggaaagattgtagaataattataatgaggaaaatttcgctccagattcgttactccaagttcagagaagctctgtaaaaattgttgctaaggcaattgaataaagaatgtcagccgatgtaagcgataacagcaagacaatgaacataattgcatgtttta

SEQ ID NO: 181509 - DNA, 601 bp, Human
catcaagttacaagagtaaataaaaatatgaggcagggtgaaatgtaagatgctcgagaggctgagatcagtagctgtgtgaatacagcagggcgggcaccagcagtgagctccacggggcccagcgtccggcctcattaaccagctgcccttggggaggagcagagcccgctcttccctcctggggaagggtagtgtgatggaaagacaggctgcccttctctcctgcaggagctcagcatcatgctgtgtacatgcctgggctctcttcttcagccctagccacttaaaaccacttggrgggaaagattgtagaataattataatgaggaaaatttcgctccagattcgttactccaagttcagagaagctctgtaaaaattgttgctaaggcaattgaataaagaatgtcagccgatgtaagcgataacagcaagacaatgaacataattgcatgttttacaacaaccaacctcaaagcatgacttccctgacatagatatgttttttaatgattttgaaaggtaacacagacattttcagggatttggagaggaaactaatgccatcctggtttaccagctttatggggtcatctct

SEQ ID NO: 181510 - DNA, 601 bp, Human
cctgcctcggcctcctgaggagctgggactacaggcacatgcccccacgcccagctaatttttgtatttttagtagagatgggatttcgccacactggccaggctgggctcaaactcctaaccttgggtgatccacccacctcagtctcccaaagagctaggatcacaggcgtgagccactgagcccagcctagttatcttgtttgtccaggaattggagcatttctaggtagcaccacaaatgtctgtgcaagaaacccacaatttccagtggtcattggctttgtgccaatccaaactwgagtctgacaaacccagcaagaaatattcgcggcagctgcaaggaagctcctcaaatagaaatagaaaaatgaaccagggtctgctcttcccttccgggtgtggaatcaacggaagccgactcaacacagagccctgggggcgtgaggggtttggcgggatctctgccggctgcagatctctgctctgttattaccagcccttctgcccagctcctaattgctctgaagagggaataattttctcagcagccattgccagccacatttggactgaatagatgctgaaatggcaagggtaa

SEQ ID NO: 181511 - DNA, 601 bp, Human
agatgctgaaatggcaagggtaaatggggcagagacagtgaaaagccattttctatctggagcccaaataaaatcttcctcccacactcctgcctggctcctccgcagcctcaatgcccttctgagagctgcctgccccagtaggaggccaggctgggaccaaggacacccagttctgggtaaccatcttcccatggctccttggacaaccaccttaaagaagggaaaggcaagaagcagaaggaaagcagaggctggacattggaatcagcctttctttaaactaaaaaaaagttttcayatatgtgaatgcgtgtgtgaatttgaagtcgtatgtggaaggggccatatatccgtcaatgcatgctccaaaaatcagaactgatggacggcaaacagcatcggatgtgcagccagcattcttccggcggccacctcccgggggaaataggtgcagcagacaggaccgtctgtgggacggggacaggcaagcatgacagcaggtaccacagatcagggtgcacagacagggctgggggaggcagcgtggcacggcacccacttcccctcggcgtgtctgggctgaagcccagtggactcc

SEQ ID NO: 181512 - DNA, 601 bp, Human
gcaagggtaaatggggcagagacagtgaaaagccattttctatctggagcccaaataaaatcttcctcccacactcctgcctggctcctccgcagcctcaatgcccttctgagagctgcctgccccagtaggaggccaggctgggaccaaggacacccagttctgggtaaccatcttcccatggctccttggacaaccaccttaaagaagggaaaggcaagaagcagaaggaaagcagaggctggacattggaatcagcctttctttaaactaaaaaaaagttttcacatatgtgaatgcrtgtgtgaatttgaagtcgtatgtggaaggggccatatatccgtcaatgcatgctccaaaaatcagaactgatggacggcaaacagcatcggatgtgcagccagcattcttccggcggccacctcccgggggaaataggtgcagcagacaggaccgtctgtgggacggggacaggcaagcatgacagcaggtaccacagatcagggtgcacagacagggctgggggaggcagcgtggcacggcacccacttcccctcggcgtgtctgggctgaagcccagtggactcccgctgatcagaag

SEQ ID NO: 181513 - DNA, 601 bp, Human
agaagggaaaggcaagaagcagaaggaaagcagaggctggacattggaatcagcctttctttaaactaaaaaaaagttttcacatatgtgaatgcgtgtgtgaatttgaagtcgtatgtggaaggggccatatatccgtcaatgcatgctccaaaaatcagaactgatggacggcaaacagcatcggatgtgcagccagcattcttccggcggccacctcccgggggaaataggtgcagcagacaggaccgtctgtgggacggggacaggcaagcatgacagcaggtaccacagatcaggktgcacagacagggctgggggaggcagcgtggcacggcacccacttcccctcggcgtgtctgggctgaagcccagtggactcccgctgatcagaaggatcctccactagaaggatctcactggacgagtcccctccaaactggaacatgcaggtgccttgggcttcatgctgcacctttcagataaaaacacacaggtgagctgggagagctggagtcccatggaccccagagatccaggtcacgaggaggggatcgcgctgcaccaggacacattcaccaaggtgagccctggttcctcc

SEQ ID NO: 181514 - DNA, 601 bp, Human
tccaagtatgatttccactcggaaccctgagctgcctcatccctcgctccgtctcccctccctcccgcccagctcacactgaaatcacgcctcgcgttcagcggctggagtcctggtggattgctgcttcggggctctcagaaatccctttacttgagtcttggttttacaggaagaccatgaagcaccccccaggagctggagctcctccttctggacccagtgtctcttctcagcctcacgacgaggagacctgctcatggagctgctgcgccggcctgagctctgatccctcctccgrcccagcctcaccctgcaagcagcaccatgtggggctcagaatggggatcttaagggacccttcccacaacctcccgataagcctttccacggagggcccaagcggagacaggagaacactgtatttgataaaatagagtcaaatccaggaaaatgcctctggacccggaaaggaaacgactcaccccccacccatgagagacccttctgtcctgtcccttaacccagaggccctgggcatgggtttcgcagccccctggaggccagaccctcaaactccagccttgtttcttctaagtgt

SEQ ID NO: 181515 - DNA, 601 bp, Human
tcccgcccagctcacactgaaatcacgcctcgcgttcagcggctggagtcctggtggattgctgcttcggggctctcagaaatccctttacttgagtcttggttttacaggaagaccatgaagcaccccccaggagctggagctcctccttctggacccagtgtctcttctcagcctcacgacgaggagacctgctcatggagctgctgcgccggcctgagctctgatccctcctccgacccagcctcaccctgcaagcagcaccatgtggggctcagaatggggatcttaagggaccctycccacaacctcccgataagcctttccacggagggcccaagcggagacaggagaacactgtatttgataaaatagagtcaaatccaggaaaatgcctctggacccggaaaggaaacgactcaccccccacccatgagagacccttctgtcctgtcccttaacccagaggccctgggcatgggtttcgcagccccctggaggccagaccctcaaactccagccttgtttcttctaagtgtgccagtcaagatgcttctcactgcaagaaacagactctttctcaagccagttcaagaagatc

SEQ ID NO: 181516 - DNA, 601 bp, Human
cccttcccacaacctcccgataagcctttccacggagggcccaagcggagacaggagaacactgtatttgataaaatagagtcaaatccaggaaaatgcctctggacccggaaaggaaacgactcaccccccacccatgagagacccttctgtcctgtcccttaacccagaggccctgggcatgggtttcgcagccccctggaggccagaccctcaaactccagccttgtttcttctaagtgtgccagtcaagatgcttctcactgcaagaaacagactctttctcaagccagttcaagamgatctgcgttgctgcagaggccgatgggtgtggggagcaggctcagtgagagactgtcgtaaggaggctgagaggtcttcagaaaaatccccaggacctggggtgccaggagcctgggcgggcctgggctctcgcagcctgcagcccctcccctccctctcacagcctccgctgcccccgggctcagggcccctgcctgtgccttctcctgaggcttctcctttttacctctcagggtcccagtgtggccagcccggcactaaacccatgcgaccctggctcactgacagtcgccaccag

SEQ ID NO: 181517 - DNA, 601 bp, Human
tgccctcctgcactgcctgacagggctgggccatggcccgtaccaaccgtgagctgagccaggaatccagtcaaaccgtgtgcctgagtgacacgtagctctcttccttctctggattcactgctgatcaaccccaacaagcagcaggactgtcttgctgtgaacccaccgcttgcggacccctccccaggcctccattcccgcctttctgaaggtcaaggcagcgccctccccaagaaacggtgggaacagaggagccaggtgttcgttcttcccagctccggaaacgctgcagattgcrcactcgagttcctgctgacataacagtggctgccagacaaaatgtggcgaaaagtttttctaggtgcctttgttcactcagagacttcctagagacttgtgtgaaaatcacaggatttgcaaccagtggggacgttgagattcgtggcaactgaaatgatacaaacttgaactttgtgtcaaaccagtagtgttttgtgtaattcttttcaaacctgtcatttcacttactgcttctcacagccccaaggggcaggtggagttgatgccatcaaccctatttacagaatggtaaactgag

SEQ ID NO: 181518 - DNA, 601 bp, Human
agtgacacgtagctctcttccttctctggattcactgctgatcaaccccaacaagcagcaggactgtcttgctgtgaacccaccgcttgcggacccctccccaggcctccattcccgcctttctgaaggtcaaggcagcgccctccccaagaaacggtgggaacagaggagccaggtgttcgttcttcccagctccggaaacgctgcagattgcgcactcgagttcctgctgacataacagtggctgccagacaaaatgtggcgaaaagtttttctaggtgcctttgttcactcagagacytcctagagacttgtgtgaaaatcacaggatttgcaaccagtggggacgttgagattcgtggcaactgaaatgatacaaacttgaactttgtgtcaaaccagtagtgttttgtgtaattcttttcaaacctgtcatttcacttactgcttctcacagccccaaggggcaggtggagttgatgccatcaaccctatttacagaatggtaaactgaggctcccactggttatgcgcttgcccacagggttgaaagagaagccatggacaaaaggagtcactggttacccaaagggcttcctgt

SEQ ID NO: 181519 - DNA, 601 bp, Human
atcaatttccagtgggggagccgccctctgtctcatcatttgtttctctcatcttgctttaatatcacagcactgccagtcaaaccacacaaaagggtttgtgatgacctgccgtgcattctcgtaagctccagccctgactcgcctgcaagccagaagccaacataaaactttcgtttttcccttaatcttgctgcctctgcatctcattttcaaatttcattttatcaactttttttgcactatttgtttctggataaaggatttgcaaaattcttcagcatgtggtcaggaagccctrtggcctcctgacgaggcagcctaggggtcctcccgtggtctgaagctgcagccgggctggcctcccacagtcaggagcagcatcaggctgggtgcttctgacaccagcgaagagcgcggctgtccaagcccccatccctagggctcacgcctcatgcccaaactcgcacccactttggcgccgctggagactaatgaacagcaaaagctgaagtcatgactctcatccagatctaaaatgaccgtgtgtcaaacatttttactgaactgatgaatcgaatgggaactggtaagaaggtac

SEQ ID NO: 181520 - DNA, 601 bp, Human
tgccgtgcattctcgtaagctccagccctgactcgcctgcaagccagaagccaacataaaactttcgtttttcccttaatcttgctgcctctgcatctcattttcaaatttcattttatcaactttttttgcactatttgtttctggataaaggatttgcaaaattcttcagcatgtggtcaggaagccctatggcctcctgacgaggcagcctaggggtcctcccgtggtctgaagctgcagccgggctggcctcccacagtcaggagcagcatcaggctgggtgcttctgacaccagcraagagcgcggctgtccaagcccccatccctagggctcacgcctcatgcccaaactcgcacccactttggcgccgctggagactaatgaacagcaaaagctgaagtcatgactctcatccagatctaaaatgaccgtgtgtcaaacatttttactgaactgatgaatcgaatgggaactggtaagaaggtacgaccagttcaaaagagaaatccaagaaccctaaatgtataaggagtgaagcaatgttgaaatggacttacaaacggatgcagctatattctccagtggagacagccagt

SEQ ID NO: 181521 - DNA, 601 bp, Human
ggaggtgcttactgcggtccttttccatggggctcgaagcttctgcattgaatcacgagctctggcctccagcctggtgcagaaccttccagggggcattggagtaaaagcttctgtagatgacagctaccccttttttggtccattttatagcagaggaaatttaggttcaaagaagttgagttgagagtcccaggagtaagaagcagtcaaggatccccccaggcctccggggccgcctgggctgcctggcctcacgacctggccccatgctcctgagatggagaagccccaggcccakgagcctgttgcccttggcaaagccacttcccttctgagtaaagtcagacgagcctgcccagtcccaagagactgcgattccgtaatcgccctcccctcgccttttgaggtcttgctggtaggtgcacccccttcaagccagcccaaggagccatgatttgagtcggtcttgccagatgtgtctggagagaatttaactccaagatcatcccccgtgcactctgaggggctgggacaggatgtggtgccctttgtgcccaggaggagaagcacccagtggggcggggtggggcgaggactt

SEQ ID NO: 181522 - DNA, 601 bp, Human
gttgagagtcccaggagtaagaagcagtcaaggatccccccaggcctccggggccgcctgggctgcctggcctcacgacctggccccatgctcctgagatggagaagccccaggcccatgagcctgttgcccttggcaaagccacttcccttctgagtaaagtcagacgagcctgcccagtcccaagagactgcgattccgtaatcgccctcccctcgccttttgaggtcttgctggtaggtgcacccccttcaagccagcccaaggagccatgatttgagtcggtcttgccagatgtgtytggagagaatttaactccaagatcatcccccgtgcactctgaggggctgggacaggatgtggtgccctttgtgcccaggaggagaagcacccagtggggcggggtggggcgaggactttataaaggcgtcatttgctgcggccacccaggttggaacacagggaccacagggccccccgccttctgcaggaccaccccgctcatctgagggagacactgtagaaacacatctttgagcagtggcttctaatccaagaaacccaatagaagtcaaacgcagattcctagggcccaacccgg

SEQ ID NO: 181523 - DNA, 601 bp, Human
cctggccccatgctcctgagatggagaagccccaggcccatgagcctgttgcccttggcaaagccacttcccttctgagtaaagtcagacgagcctgcccagtcccaagagactgcgattccgtaatcgccctcccctcgccttttgaggtcttgctggtaggtgcacccccttcaagccagcccaaggagccatgatttgagtcggtcttgccagatgtgtctggagagaatttaactccaagatcatcccccgtgcactctgaggggctgggacaggatgtggtgccctttgtgcccasgaggagaagcacccagtggggcggggtggggcgaggactttataaaggcgtcatttgctgcggccacccaggttggaacacagggaccacagggccccccgccttctgcaggaccaccccgctcatctgagggagacactgtagaaacacatctttgagcagtggcttctaatccaagaaacccaatagaagtcaaacgcagattcctagggcccaacccggacccactgcgtgggaatccctcagccggggccagaagcacgctttgaagacaccaacctcctcagcaagcctcttgca

SEQ ID NO: 181524 - DNA, 601 bp, Human
ggagaagccccaggcccatgagcctgttgcccttggcaaagccacttcccttctgagtaaagtcagacgagcctgcccagtcccaagagactgcgattccgtaatcgccctcccctcgccttttgaggtcttgctggtaggtgcacccccttcaagccagcccaaggagccatgatttgagtcggtcttgccagatgtgtctggagagaatttaactccaagatcatcccccgtgcactctgaggggctgggacaggatgtggtgccctttgtgcccaggaggagaagcacccagtggggyggggtggggcgaggactttataaaggcgtcatttgctgcggccacccaggttggaacacagggaccacagggccccccgccttctgcaggaccaccccgctcatctgagggagacactgtagaaacacatctttgagcagtggcttctaatccaagaaacccaatagaagtcaaacgcagattcctagggcccaacccggacccactgcgtgggaatccctcagccggggccagaagcacgctttgaagacaccaacctcctcagcaagcctcttgcaaaccacatcctgcttctccaga

SEQ ID NO: 181525 - DNA, 601 bp, Human
cgccacaactccacgggcatagcctgggaggccgcagcgtgaactgtgactagggctgaggatggtgccatggtagaagtgagggcctggcacccggccaagtgcaggactcctcggcagtggggttgggagaagcagcctctgcaggcgaggccaggaaccaggacacaggaggagaagcacatctcagaggagggagctctgggaggagccagcagagtcctgcaaaggaggatgtgggggaaatggggtgaggccaaagtgggggctgctgaaggggctactgcacccgtgcgagcakggccaggaccaagctgcataggcagccagggacacagccgatgccacagacgtcaggaaccacgcaatgacacaggccacctttgaccgaccgttacccctggggcaaataccagtggggataacgggcaaggagaggtgctgtttactgtcttattgttgccagttcagcagcccacaggaaatggtgttagtcacagaaaaaaaaaatctgttttctatatttcactgtttccaagtaaagaaaaaagaaaactaatcttagcttaaaaaaaaaaaaaatggtgcgctgggcaccgaa

SEQ ID NO: 181526 - DNA, 601 bp, Human
gcagcgtgaactgtgactagggctgaggatggtgccatggtagaagtgagggcctggcacccggccaagtgcaggactcctcggcagtggggttgggagaagcagcctctgcaggcgaggccaggaaccaggacacaggaggagaagcacatctcagaggagggagctctgggaggagccagcagagtcctgcaaaggaggatgtgggggaaatggggtgaggccaaagtgggggctgctgaaggggctactgcacccgtgcgagcagggccaggaccaagctgcataggcagccagggayacagccgatgccacagacgtcaggaaccacgcaatgacacaggccacctttgaccgaccgttacccctggggcaaataccagtggggataacgggcaaggagaggtgctgtttactgtcttattgttgccagttcagcagcccacaggaaatggtgttagtcacagaaaaaaaaaatctgttttctatatttcactgtttccaagtaaagaaaaaagaaaactaatcttagcttaaaaaaaaaaaaaatggtgcgctgggcaccgaaaaataaccatcttcctaggcctgcgtttccccc

SEQ ID NO: 181527 - DNA, 601 bp, Human
tctgggaggagccagcagagtcctgcaaaggaggatgtgggggaaatggggtgaggccaaagtgggggctgctgaaggggctactgcacccgtgcgagcagggccaggaccaagctgcataggcagccagggacacagccgatgccacagacgtcaggaaccacgcaatgacacaggccacctttgaccgaccgttacccctggggcaaataccagtggggataacgggcaaggagaggtgctgtttactgtcttattgttgccagttcagcagcccacaggaaatggtgttagtcacagaaaaaaaaaatctgttttctatatttcactgtttccaagtaaagaaaaaagaaaactaatcttagcttaaaaaaaaaaaaaatggtgcgctgggcaccgaaaaataaccatcttcctaggcctgcgtttcccccacaccggggacttgtgctggaaagaaaagctgcgttggcagccaggagccggggaaactgtccagggaggcatcctctgcgatgaaggcggggcctcggcgtggcccgttccgcgctctgtccagccctggagaagccccaccctcaccgagctcgaaataccccct

SEQ ID NO: 181528 - DNA, 601 bp, Human
cgtggtggcgagcacctgtcatcccagctgcttgggaggctgaggcaggagaatggcttgaaccctggaggcagaggttgtagtgagctgagatcatgccattgcactccagcctgggcaacagagcgagactccgcctcaaaataaataaataaataaaaaagagtgtgggttttttcctctcacttcttcattcacttttggagaaagcggggtggttgtgtgtgtttggtccccagccccacatcaccccataggtgccttttctacccagggggcttgacccagatcaacactgggygaaaggctgacttcagaaatgggttgaaaagaccagtgatctgccttatcgagtcctcagagtcccacaggagttaatgtcctaaatcaacagtgtgttcgagccagtgaattttctaattatcagcaaactttccaaatgtaaagggtgagcaggagtagctttggctcaaggattaactttaaagttaggacggaggtggagaagggcaattgaagtttctcacagacaggtgagaaaagggagatgaaagtacacgtctgaaagtgcagcaaatggcagttttagccgcaaaaatag

SEQ ID NO: 181529 - DNA, 601 bp, Human
tgtcctggttgtctcagggctctggccccatgtgtacattcaagtgtacatcccagagcacactatgggcgaaaacacgggcttgggtgtgttttccaggaacacgaccatctccctgctgaccaccgacgacgccatggtctccatcgaccccaccatgcccgcgaattcagaacggtaagaggctccggccgcgctcctcggggtgtgcctggcacttctctccatgacatgggaggctttctgtgattttgtaaatgtgctactgcagaaaggtgtgaattgacagcagagatggagrgcgagggtaggagccagtgtgaaggaagcttgactcgtcgtgttcccctgcagaggagctgggcacgttccaagataacaattgcagccgtggctctgcacctgcttctcaacgggaggaggcattgtacagaggggaaactgaggcccaggagggtgagccaagagctgcagagccaggccccgggatccccacattaaccccaggaaggacctcgggagattccctacagagcccctggggacatttcgtgtttacccacttagggccggtctctgtgttcataaagtgatgcctgtg

SEQ ID NO: 181530 - DNA, 601 bp, Human
agggctctggccccatgtgtacattcaagtgtacatcccagagcacactatgggcgaaaacacgggcttgggtgtgttttccaggaacacgaccatctccctgctgaccaccgacgacgccatggtctccatcgaccccaccatgcccgcgaattcagaacggtaagaggctccggccgcgctcctcggggtgtgcctggcacttctctccatgacatgggaggctttctgtgattttgtaaatgtgctactgcagaaaggtgtgaattgacagcagagatggagagcgagggtaggagcsagtgtgaaggaagcttgactcgtcgtgttcccctgcagaggagctgggcacgttccaagataacaattgcagccgtggctctgcacctgcttctcaacgggaggaggcattgtacagaggggaaactgaggcccaggagggtgagccaagagctgcagagccaggccccgggatccccacattaaccccaggaaggacctcgggagattccctacagagcccctggggacatttcgtgtttacccacttagggccggtctctgtgttcataaagtgatgcctgtgggagattctaagcac

SEQ ID NO: 181531 - DNA, 601 bp, Human
ttgtcaatctggtcatcagggtgtcctgcccaactgacccatggccagctctgagcccacaggagaaagtgcatgtcaggcagacccttgtgtcagtgaggtcccagtgggcgtggccagcaccgtccccctcagtgaggccccccagtggacgtggccagtgctgcctccctcagtgaggtctcagtggacatggccagagccgtccccctcagtgagcgctcagtagacatggccagtgccgtcctcagcgaggtccccgtgggtgtggccagcgccatccccctcagcgaggtcctcktgggtgtggccagcaccatcccactcagcgaggtcccagtggacatggccagcgccgcccccctcagtgaggcttcagtgggcatggccagtgccgtccccctcagcgaggtcccagtggacgtgtccagagctgtcctggtcagccgtcctccctgtcaccttgaggcctcagccgagctcctctcatctggctgtgcccgtcagtctcccctcctgccctagccaggatgcccgtctcctgccccacacagtctggctctgactcttggcttccagactccccggaaggtgcagtgct

SEQ ID NO: 181532 - DNA, 601 bp, Human
ctcctctcatctggctgtgcccgtcagtctcccctcctgccctagccaggatgcccgtctcctgccccacacagtctggctctgactcttggcttccagactccccggaaggtgcagtgctaattggctccccagagactccagtaagcatcttgtcagcctcagcaccagctccagcctggggggtctcgctcagaagcaaagtcactgagtgacctgtcctcctgacacccacaagactaaaatgatctctcagaggggacctcacagaaaccagcaccttgtccatgccagctgggtmtctgagagaaactgctttgttttcctgaagtcatttgaaacagcgtgcagagacatttaaactcggcgggaaataggagaagcccaccttgacccttctaattctctggccccaggtgccttattaacaagagacagtatcagacacaccagacaaaagccctcctgagcccaaagagcccaaatgtctggaagctctctgctgagatgccaaaatgcatgcctttctgataaagagacagagacagatgaggtaccatgatatggacatggcagtggacgtggacaggggagcagtgga

SEQ ID NO: 181533 - DNA, 601 bp, Human
agagcccaaatgtctggaagctctctgctgagatgccaaaatgcatgcctttctgataaagagacagagacagatgaggtaccatgatatggacatggcagtggacgtggacaggggagcagtggagatggagaagatggagacacacgcagttgaggatacaggcgaagaagatggagacacacgcggatgaggatacaggcgaagaagatggagacacacgcggatgaggatacaggtgaagaagatggagacacacgcggatgaggatacaggtgaagaaggtggagacagacgcggrtgaggatacagatggagaagatggaggtagacgcgggtgaggatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccggg

SEQ ID NO: 181534 - DNA, 601 bp, Human
tctggaagctctctgctgagatgccaaaatgcatgcctttctgataaagagacagagacagatgaggtaccatgatatggacatggcagtggacgtggacaggggagcagtggagatggagaagatggagacacacgcagttgaggatacaggcgaagaagatggagacacacgcggatgaggatacaggcgaagaagatggagacacacgcggatgaggatacaggtgaagaagatggagacacacgcggatgaggatacaggtgaagaaggtggagacagacgcggatgaggatacagrtggagaagatggaggtagacgcgggtgaggatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgc

SEQ ID NO: 181535 - DNA, 601 bp, Human
aggatacaggcgaagaagatggagacacacgcggatgaggatacaggcgaagaagatggagacacacgcggatgaggatacaggtgaagaagatggagacacacgcggatgaggatacaggtgaagaaggtggagacagacgcggatgaggatacagatggagaagatggaggtagacgcgggtgaggatacaggtggagaagatggaggtagacgcgggtgaggatacaggtggagaagatggaggtagacgcggatgaggatacaggtggagaagatggaggtagacgcggatgaggayacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgcggaaacggatctagacagcgatgtggaaatggatctagacagcgatgtggatgtgatctagataatgtggctctggacgtagaaagagcttcagatgctctatctatgatcgtgggtgtggatataggcatagacatggtgaa

SEQ ID NO: 181536 - DNA, 601 bp, Human
atggagaagatggaggtagacgcgggtgaggatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgyggaaacggatctagacagcgatgtggaaatggatctagacagcgatgtggatgtgatctagataatgtggctctggacgtagaaagagcttcagatgctctatctatgatcgtgggtgtggatataggcatagacatggtgaagaggagagaatagactctcctctctcatgacaaactgatcgtggctgggggcggcacgtgctgagatgtggctgtatttgtcccccaggctggtgcctgcgcctcctgcacccccgtctcctttgtgccttcttccattccctctgccactgttagg

SEQ ID NO: 181537 - DNA, 601 bp, Human
gatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgcggaaacggatctagacagcgatgtggaaayggatctagacagcgatgtggatgtgatctagataatgtggctctggacgtagaaagagcttcagatgctctatctatgatcgtgggtgtggatataggcatagacatggtgaagaggagagaatagactctcctctctcatgacaaactgatcgtggctgggggcggcacgtgctgagatgtggctgtatttgtcccccaggctggtgcctgcgcctcctgcacccccgtctcctttgtgccttcttccattccctctgccactgttaggtccaggcctcactgagctctgacctccctg

SEQ ID NO: 181538 - DNA, 601 bp, Human
ctccatggtggcctcccaatctgggccctgccaacttatgcctcaccaacttctccaacttacccctgtacccacgcccgcaccatgcccagcccacaggatcctgccttcccagctctgcagaaccagcttctgcttatccgctaggtgccagcccagccacctgccttaagcaccatccacagtcacccagcccatcaccatcactagcaaagtcacccagacccatcaccatcaccatccagagtcacccagcccttcactatcaccatccaaagtcaccagccccatcaccatcacyatccagagtcaccagccccatcaccatcaccattcaaagtcacccaccccgataccatcaccatccaaagtcacccagacctatcaccatcatcatccagagtcaccagccccttcaccatcaccatccaaagtcaccagcccctttaccatcaccatccagagtcacccagtcccatcgccatcaccatccagattcacccagacccatcaccatctccatctaaagtcacccagacccatcaccatcactatccaaagtcacgcatcctgtcactatcaccatccaaagtcaccaagc

SEQ ID NO: 181539 - DNA, 601 bp, Human
taccatcactatccaaagtcacccagacccatcaccatcaccacccaaagtcacccagccccttcaccatctccatccaaagtcacccaacctgtcaccatcagcacatcactggcttcctcccctcagtgtgcgcctcagtctgaagtgatctcacttacttgtttgaggttctcactgctgctggccccgctggacggtcttctctcataggaaggaaatttcaccttgctctctgctggatttccagcccctaaacgaggcggggcatgctgggtgcaggatggaatgagttggggayggagtgaaccagtccagctcgtgcgtgcctccccctctgcactgcccagagcagttttttcttctggggacgcagggcaacgtctggagacatttctggatgtcaccaggggtaagggcctgctacttgtatctgatgggtggagacccgggatgccaatggcatcctacagcgcacaggacaggcccacaacaatgacacacgtggccggagacatcagcggtgctgaggcggagcacctggtgtctgaggtctcccctgtgctctgtcgctgtcctctcaccctcccccaatcttcca

SEQ ID NO: 181540 - DNA, 601 bp, Human
cttcaccatctccatccaaagtcacccaacctgtcaccatcagcacatcactggcttcctcccctcagtgtgcgcctcagtctgaagtgatctcacttacttgtttgaggttctcactgctgctggccccgctggacggtcttctctcataggaaggaaatttcaccttgctctctgctggatttccagcccctaaacgaggcggggcatgctgggtgcaggatggaatgagttggggacggagtgaaccagtccagctcgtgcgtgcctccccctctgcactgcccagagcagttttttyttctggggacgcagggcaacgtctggagacatttctggatgtcaccaggggtaagggcctgctacttgtatctgatgggtggagacccgggatgccaatggcatcctacagcgcacaggacaggcccacaacaatgacacacgtggccggagacatcagcggtgctgaggcggagcacctggtgtctgaggtctcccctgtgctctgtcgctgtcctctcaccctcccccaatcttccaacctagtagttctcagacaactgcgtcagaatccgcagggggcttggtggagcacagagct

SEQ ID NO: 181541 - DNA, 601 bp, Human
gagaatctttctgcagcagaaagccaggctttctgcaggttcccagtgaggaggacgaggctggcccgggacacgccactgatgctcttctgacccaggggcttttctctcccgcttccgtccctcttccctcgccggcaggtgacgttactggccttttcttttttggccctgcctcccccttggcttctcccctcttcctctcctccactcggtgcctggtgacatgcggccatcctcagagatgtgcttcggggcccgcacgccttgctcctcgcactcttcctgcaccggagccgcsgtgcgaggcctcgggaatgctcaccgtttctctcccgccccccggccgcatgctgcagccattccctcaccacatgtccaggagggagccggcatcctttgctgactttcttgctgtgactatggtgctgcgtggaaaaggggccgtgggaaggctgggcaggtggctgctcagagccccacctgacacggtgacccacggggcctggaaattcactgccccgatttccacacaggtgcctgagctcctgcagagaatgcctgagagcgagacgcatgcccgtcaatttgtgctttcagg

SEQ ID NO: 181542 - DNA, 601 bp, Human
ctcccgcttccgtccctcttccctcgccggcaggtgacgttactggccttttcttttttggccctgcctcccccttggcttctcccctcttcctctcctccactcggtgcctggtgacatgcggccatcctcagagatgtgcttcggggcccgcacgccttgctcctcgcactcttcctgcaccggagccgcggtgcgaggcctcgggaatgctcaccgtttctctcccgccccccggccgcatgctgcagccattccctcaccacatgtccaggagggagccggcatcctttgctgactytcttgctgtgactatggtgctgcgtggaaaaggggccgtgggaaggctgggcaggtggctgctcagagccccacctgacacggtgacccacggggcctggaaattcactgccccgatttccacacaggtgcctgagctcctgcagagaatgcctgagagcgagacgcatgcccgtcaatttgtgctttcaggcgtcctaagcacacacgcctgctcttatttgaaccactccctgtaagctagttccactaaagagtggctttccaccctggctgcagattgcaaccacccaggaatctt

SEQ ID NO: 181543 - DNA, 601 bp, Human
tttcttgctgtgactatggtgctgcgtggaaaaggggccgtgggaaggctgggcaggtggctgctcagagccccacctgacacggtgacccacggggcctggaaattcactgccccgatttccacacaggtgcctgagctcctgcagagaatgcctgagagcgagacgcatgcccgtcaatttgtgctttcaggcgtcctaagcacacacgcctgctcttatttgaaccactccctgtaagctagttccactaaagagtggctttccaccctggctgcagattgcaaccacccaggaatctttttttttttttttttgagacggagtctggctctgtcgcccaggctggagtgcagtggcgcgatctcggctcactgcaagctctgccttccgggttcacgccattctcctgcctcagcctcccgagtagctgggactacaggcgcccgccaccacgcccagctaattttttgtgtttttagtagagacgggatgttagccaggatgatcacgatctcctgacctcgtgatccacctgcctcggccccccagagtgctgcgattacaggcgtgagccaccgcgtcctactttttttttttt

SEQ ID NO: 181544 - DNA, 601 bp, Human
tgcatctggcatgcttggattcctgcaggtggctggttgcacctagcttgcttggattcttcccagattcacagccatagggtgggcgtttcatgaaatctccaaattccaagggctcttgacagaccacctccatcctgatcagaaggggtgatgccggttgcacggtctcttagagcttaaaactctagcttcttctctgctcctcattccaaactaaacaaattgttgcattggattattctttcaaaatactccttgccttaatgccatcctttagattttggtggctggctcctgktgtggaccgcatctcacaggtggacttcctggtttctgcctcctgttacccctcacagttatctctcccttgagtcctgctaccttccagaaaaataggctccaaacacactttcatcccatcactcccagcatggagttctccagtggcctgttggctacaggacactctccagccccccgcattgggatgtctggccccaatccaccataatgtacttgtctccaatctgctgagctgcatgaatgcccaccccagcccagcgggcactccccttctgcaaacctccaagcacattcc

SEQ ID NO: 181545 - DNA, 601 bp, Human
cactcccttttagagctggcaagaaaaataattgatgactaaacaacctaacgaccaacaaatataaaaagtcatagcccaaccatgatcaaataaggctccagcattcctccttggagggactctgagccatctggtgtcattttcctttccaatccgggaacattctggagatcctgacatccagctaacatgggcgttgcttcctgacaaccctaccccttccattccccagtcactactgcttcaagatgcagtggaaggagataaatcagacacctcagtagcgtgagtgaaagtrgggtgtgtggtgagacacatacagaggggagagggccagaggacggcgccgtgcgacacacaccattgctccttttgttcccggtttcggccaagttgtgccgcaggtgactctccaccggctgagctctgtgcatgcagggccagtattctcggccattctggcttagagaaaagctttctatattccagaatggctccaggcctcctcctcctcctattaaatgtgttttaaaagaggtcttagagcccaggcagttagatcttagaaaaagacaaatacagtagaagctggaggcaa

SEQ ID NO: 181546 - DNA, 601 bp, Human
cagagtctggaggctgaaatccaagatgagggtgtgggcaggttctgttcctggggaggcctctcttcctggcttgcatacagctgccttctggctgtgccctcatgaggcagagcaagagacagctctggtgtctttggcccttgtaaggacaccaaccccatcccatgggccccaccctcaggaactcctccaaacccaatcacctcccaaggccctacctcctaatcttacccactggggatgagggcttcattatatgaatttggggtgggggtgcctcaacattcagaccccagcmccatgggaccactaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacc

SEQ ID NO: 181547 - DNA, 601 bp, Human
cactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaawaaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccggtaaggccctgctgtcgttttttaaactaaaagaaggaaaaagaaatcttgagcttgcccctgtgataaaatatatactagttaagcatttgaatctaagcatttgaaatatatatgagttacctttgaagcattta

SEQ ID NO: 181548 - DNA, 601 bp, Human
tatatgttagttaagcatttgaatctgcatttgaagccgatacaactgcagaatctgaaaccttgtactactgtaagggctctgcctttctaaccccagggagaatagcatctgcctggggttagcctcccttgtgtggattttttcttactccttttggccactgcctgttcctggtctatggccgttccattggctgcactgtctgtccctgcccctcggccagaggccatcccaaggactttgcagttgcagggcggcatccactctggtcttcctggcccagcacctgtcctccccsctccactgtgagttgccaaggcaggcatttgtggcccctgggatgccttggggtgcctcatacagttacttgggccgctgtgttacaatcctttttctttttctttttttttttttaaaaaaaaacggagtctggtcctgtcacccagggctggaatgcagtggcacgatctcggctcactgcaacctctgcctcccaagttcaagtgattctcctgcctcaccctcccaggtagctgggattacaggcgtgcaccaccaagcctgggtaattttttttgtatttttggtagagacggga

SEQ ID NO: 181549 - DNA, 601 bp, Human
ggggttagcctcccttgtgtggattttttcttactccttttggccactgcctgttcctggtctatggccgttccattggctgcactgtctgtccctgcccctcggccagaggccatcccaaggactttgcagttgcagggcggcatccactctggtcttcctggcccagcacctgtcctccccgctccactgtgagttgccaaggcaggcatttgtggcccctgggatgccttggggtgcctcatacagttacttgggccgctgtgttacaatcctttttctttttctttttttttttttwaaaaaaaacggagtctggtcctgtcacccagggctggaatgcagtggcacgatctcggctcactgcaacctctgcctcccaagttcaagtgattctcctgcctcaccctcccaggtagctgggattacaggcgtgcaccaccaagcctgggtaattttttttgtatttttggtagagacgggattttgccatgttagccaggctggtctcgaactcctgacctcaggtgatccacctgtcttagcctcccaaagtgctaggattacaggcgtgagccacagcacccagcctagaatgcct

SEQ ID NO: 181550 - DNA, 601 bp, Human
gggttagcctcccttgtgtggattttttcttactccttttggccactgcctgttcctggtctatggccgttccattggctgcactgtctgtccctgcccctcggccagaggccatcccaaggactttgcagttgcagggcggcatccactctggtcttcctggcccagcacctgtcctccccgctccactgtgagttgccaaggcaggcatttgtggcccctgggatgccttggggtgcctcatacagttacttgggccgctgtgttacaatcctttttctttttctttttttttttttaaaaaaaaacggagtctggtcctgtcacccagggctggaatgcagtggcacgatctcggctcactgcaacctctgcctcccaagttcaagtgattctcctgcctcaccctcccaggtagctgggattacaggcgtgcaccaccaagcctgggtaattttttttgtatttttggtagagacgggattttgccatgttagccaggctggtctcgaactcctgacctcaggtgatccacctgtcttagcctcccaaagtgctaggattacaggcgtgagccacagcacccagcctagaatgcctt

SEQ ID NO: 181551 - DNA, 601 bp, Human
tcttcctggcccagcacctgtcctccccgctccactgtgagttgccaaggcaggcatttgtggcccctgggatgccttggggtgcctcatacagttacttgggccgctgtgttacaatcctttttctttttctttttttttttttaaaaaaaaacggagtctggtcctgtcacccagggctggaatgcagtggcacgatctcggctcactgcaacctctgcctcccaagttcaagtgattctcctgcctcaccctcccaggtagctgggattacaggcgtgcaccaccaagcctgggtaattttttttgtatttttggtagagacgggattttgccatgttagccaggctggtctcgaactcctgacctcaggtgatccacctgtcttagcctcccaaagtgctaggattacaggcgtgagccacagcacccagcctagaatgccttttccatttgatttttatcacttttatttatgtgtgatttatacatcataaaatgccatttaagtgcctattttgatgacttttgaaaaatgtgtacacccttgtaaccatcaccaaaatcaagacatttgcaccacctagaaaagctctctctt

SEQ ID NO: 181552 - DNA, 601 bp, Human
ttacaggcgtgcaccaccaagcctgggtaattttttttgtatttttggtagagacgggattttgccatgttagccaggctggtctcgaactcctgacctcaggtgatccacctgtcttagcctcccaaagtgctaggattacaggcgtgagccacagcacccagcctagaatgccttttccatttgatttttatcacttttatttatgtgtgatttatacatcataaaatgccatttaagtgcctattttgatgacttttgaaaaatgtgtacacccttgtaaccatcaccaaaatcaagrcatttgcaccacctagaaaagctctctcttgccccctccagtgtgtctcagtccacaacggacctgctttctgacatcatccatgagatttctttttgagagtttcatatataagaaattacatggtatatgtactctttttgactcaacataatgtttttgagatccatccatgtgctgtgtgtagagacagttcatgctttgtattgctaagtggtatcccatggtgtaggttgtaccacagggcgtcttccattcactgtggatggacatttgggttgttaccagtctgggggcttt

SEQ ID NO: 181553 - DNA, 601 bp, Human
ttaaagtacaagtattggtggaaacgtatatttttatatatttcatttcacttggctaaatacctatgatacctataaccttgccaacttttttatacagttaaacatatacttaaccgtcttccctaagagtggatataagagtctgtagagtgttccccagtctgggtttgtctgacgtttctctcacgaccagcctgggtgtggtgggttttggaaggaatacgtggggcgcatgacagccaggtaggaccacgagcttctccactgcagagttactgttgatctccttccctgctcytctttgaaagcaagtcacgaagtccagcccacccaaacacaggagagaaaaaccgaggttcgttttctctacacagatattcatttctccagcaccatttgttgaaaagatgatcttttctcccactgaattaccatgacacctttgtggaaaatcgatgggccatgtatgtgtgagtctttttctggactccagatcctgtcgtgtgaatttacatgtcttaaaacaacagcacaccatcttgactaccgtagataaatagtaggtcttgaaatcaggtactctaagttatctctggtt

SEQ ID NO: 181554 - DNA, 601 bp, Human
tttcatttcacttggctaaatacctatgatacctataaccttgccaacttttttatacagttaaacatatacttaaccgtcttccctaagagtggatataagagtctgtagagtgttccccagtctgggtttgtctgacgtttctctcacgaccagcctgggtgtggtgggttttggaaggaatacgtggggcgcatgacagccaggtaggaccacgagcttctccactgcagagttactgttgatctccttccctgctcttctttgaaagcaagtcacgaagtccagcccacccaaacasaggagagaaaaaccgaggttcgttttctctacacagatattcatttctccagcaccatttgttgaaaagatgatcttttctcccactgaattaccatgacacctttgtggaaaatcgatgggccatgtatgtgtgagtctttttctggactccagatcctgtcgtgtgaatttacatgtcttaaaacaacagcacaccatcttgactaccgtagataaatagtaggtcttgaaatcaggtactctaagttatctctggtttcttttttctttttcaaaaatgttattgcttttattttca

SEQ ID NO: 181555 - DNA, 601 bp, Human
ttgaaatcaggtactctaagttatctctggtttcttttttctttttcaaaaatgttattgcttttattttcaaataaattttagaatcagtctatgaattgcttccaaaaaaacagtctgctaggattttgactgaagttgcattaaatatacagaccaatgtgggaagaattaatatcttaagaatgttgagtcttctggttcataaatatggtctatctccccattcatttgggtttcctttaatgtttctcaataatgtgttaccattgttaatatgaagtacttaataaatactgayaaatacatcactatttcatgtatttaatggtactgcaaatggacttttttttcatttcaatttccggtagtttttagtttataggaattggcttctgtatgggaccttgctaaactcatttattaggtctagtacctttttgcagatttcctgtgattctatagatgattttcttatagtgctggtcttctgacaacaaattccttctgcttttgtctgaaaaagcttttctttgctgttttgcttttttttttttcaaagagagagagagataaagtctttgtctgttgcccaggctgg

SEQ ID NO: 181556 - DNA, 601 bp, Human
tctgtatgggaccttgctaaactcatttattaggtctagtacctttttgcagatttcctgtgattctatagatgattttcttatagtgctggtcttctgacaacaaattccttctgcttttgtctgaaaaagcttttctttgctgttttgcttttttttttttcaaagagagagagagataaagtctttgtctgttgcccaggctggagtgcagtgatgcggtcatagctcacgacagccttgacctcctaggctgaagcaatcctccctcctcagcctcccaagtagctgggactatagrcacacaccaccatgcccggcgaattttttaagtttttatagggacaaggtcttacagtattgcccaggctggtctcaaactcctaaactcaagtaatcctccctccctgagattacagacgtgagccaccatgcccgactgacagtgtttttatttcatcttcattttgaaagggtattttcttgccatagagaattttagtttcacagttttccagcactgtgaatatgtcttctcattgtgttttagctagtacagcttctaatgagaagtctgtgatgtcttatctttgttcctctg

SEQ ID NO: 181557 - DNA, 601 bp, Human
ccctctggcaacttaagatgttttctttatcactggtttgcaggaatttgattatgatggccttggtgtggttttcttttggtttaacctgcttggtgttcattgatcttcttggaactttgggatcatatttttcatgaaatttggaattttttctgctctcctctgtctctctcctttcccctgggaccctaactacctgaatgatagacagcctgagagcgtcccctgactcactcacactgtttctttctttccagacctttttttctgtttgctttatttttcttagacttttccrtgacgtcttccattgcactggtcttccctcctgcagtatctagtctgctgttaatctcgttcagtgaaattttcatttcagatattgcattcttcatccctaggaattatgtttccctcctttttcgtatctcccatttttacatctcccatttatgcctcattatgtttatatttcctgtaaatgcttatacctcattataattctgtttcatgccattgtctgctggtttcctcctctctgccatatccgagtctgtctctgttgattgatttatctcctgggtatgggtcatatttt

SEQ ID NO: 181558 - DNA, 601 bp, Human
tgaagtctgggacttggtgaggccagcagggagtgagtgagcaccagcaggaggggccaggcctgagccggacggagaccgaacccatccgtgggagaaggacgctggtgacaggacaccatcgggagcagaggggaagccataaagccctggaggcaggaagaggcaaaggctggccgggtgtgggtgaggtgctgcagggctctcgcaggccagcgaagacaggcgagatggctgtgctcagagttagaagagcatcgctgggagcagaggaaagagggatttctgtgtcacctggggrcccatccaggaccagtgggagatggagttgggctcattgagggaaagaggtgaatggaaggaagttggaaccagctgtcctaaggccggagctgctcctccctggaggactccggcaaaggctgctggccttgggctgtgcgggcacccagtggctgagagatcgttgccctctgcagccctcctgcaacttggatcctaggagccacaaagaggcttgaaaaataatccatcctgagaaacacaaaggctcacattaaacttcgcatcgtaaagttttgagtaaaagaacaataagggg

SEQ ID NO: 181559 - DNA, 601 bp, Human
tgctggccttgggctgtgcgggcacccagtggctgagagatcgttgccctctgcagccctcctgcaacttggatcctaggagccacaaagaggcttgaaaaataatccatcctgagaaacacaaaggctcacattaaacttcgcatcgtaaagttttgagtaaaagaacaataaggggcatttctgctaaaggtgccaggatgagaaaaagcaggaaacagtgctgcaccgccaggctctgcaccgtctctacagagggctggggttggttcaggagcattcggcccaggctgtgatctcragaaggtggtcagggcccaggctcccgccagccctcacggcagcacgaggctggtacgagacaggtgcttcaggtgtttgttgagagctgcacacacttctgctgggctgggcaagacttccctcttcagagaggatgagcggccacacggaaggccaggctgggtgtccctccgggccagccgaggagcgctgcgcttattccgcagtgaggagtcgctggctgtccaggggagctgcattttcctagcagcgacaacccctcccacatctccatagtcacatcctggctgggctaaca

SEQ ID NO: 181560 - DNA, 601 bp, Human
gttcctcactgattctcagcaggtttcagtaaatgcctctaacgggcccggtggaactgtgcaatgcagaaacaccccagggttttgctgttttgctacttaaatattcaggaaatagtaaagagaagagtattatcaaaaacgtgacttttcatagaaaagggagaataggccagccctggcctgggtccacaaccccagtgtgagctgcagagacttctctggagcggtgaacagctcctgccaggaaagagcatggcacagcctcgttctccagcgtagagtagaaggaatggccccrtccacgcgaaggtctgtgttcaccaagcatcttctgtagaaaaatgctctcttcgcctgatcatgggagggaatcaaatggatagagcatttatcccttttgtgactaaaataaaggtaatagcaactacaaaaaccacgacacaggcttctcagcatctttttataacgatagtgctgattttttggaaaatccttgagcctcaatcacttttatttgatgtaagccgctcaaactcaaagagtgttgttttccagattataaaacacagatctcagctgatggcggttgacgggtgtc

SEQ ID NO: 181561 - DNA, 601 bp, Human
actgattctcagcaggtttcagtaaatgcctctaacgggcccggtggaactgtgcaatgcagaaacaccccagggttttgctgttttgctacttaaatattcaggaaatagtaaagagaagagtattatcaaaaacgtgacttttcatagaaaagggagaataggccagccctggcctgggtccacaaccccagtgtgagctgcagagacttctctggagcggtgaacagctcctgccaggaaagagcatggcacagcctcgttctccagcgtagagtagaaggaatggccccgtccacgygaaggtctgtgttcaccaagcatcttctgtagaaaaatgctctcttcgcctgatcatgggagggaatcaaatggatagagcatttatcccttttgtgactaaaataaaggtaatagcaactacaaaaaccacgacacaggcttctcagcatctttttataacgatagtgctgattttttggaaaatccttgagcctcaatcacttttatttgatgtaagccgctcaaactcaaagagtgttgttttccagattataaaacacagatctcagctgatggcggttgacgggtgtcccccgag

SEQ ID NO: 181562 - DNA, 601 bp, Human
tgctacttaaatattcaggaaatagtaaagagaagagtattatcaaaaacgtgacttttcatagaaaagggagaataggccagccctggcctgggtccacaaccccagtgtgagctgcagagacttctctggagcggtgaacagctcctgccaggaaagagcatggcacagcctcgttctccagcgtagagtagaaggaatggccccgtccacgcgaaggtctgtgttcaccaagcatcttctgtagaaaaatgctctcttcgcctgatcatgggagggaatcaaatggatagagcatttmtcccttttgtgactaaaataaaggtaatagcaactacaaaaaccacgacacaggcttctcagcatctttttataacgatagtgctgattttttggaaaatccttgagcctcaatcacttttatttgatgtaagccgctcaaactcaaagagtgttgttttccagattataaaacacagatctcagctgatggcggttgacgggtgtcccccgagtgccctcggctgccaggagctggcaggggagatgcctgtgatgaggattgggtgctgtgatcacagcacgcgggaaaaggacaggg

SEQ ID NO: 181563 - DNA, 601 bp, Human
gcagttgaaccgtgctgtcacacttaacccaagtgatgacagcctcttcaactaggacagtgctgtaggggtctggttctgcttgttctcccccacattcctgcctgccctaggacccaggacctgtctctagtcacacacaccctgttcagcctctgcatctggcccccgcggagacccacaccacattctactcccctggccagagaccgagggtgactcggaggcttccagttcccagcagctttattggcgttgctgtttccatagaaggacaataaaagggggccataaggaggcrcatccgcagagtgcgtgcttgagcttctgcaagccagaggaggccggcggccggcagggtgggcaggctggctggctgtgccccacaacatgcatgtggagaggttttgggggcagccatggaaccccggagctgcccccacatgagagttcccccaggtggtgaccaaatgcatttacagtccagccgcagtccagatgcagatgcgctgtaactgtagaacacacagcaaattctgaaggcttagtatgaaaaagaatataaaaatctcagtcatttttatattgatttcatgtttcc

SEQ ID NO: 181564 - DNA, 601 bp, Human
ctgtcacacttaacccaagtgatgacagcctcttcaactaggacagtgctgtaggggtctggttctgcttgttctcccccacattcctgcctgccctaggacccaggacctgtctctagtcacacacaccctgttcagcctctgcatctggcccccgcggagacccacaccacattctactcccctggccagagaccgagggtgactcggaggcttccagttcccagcagctttattggcgttgctgtttccatagaaggacaataaaagggggccataaggaggcgcatccgcagagtgygtgcttgagcttctgcaagccagaggaggccggcggccggcagggtgggcaggctggctggctgtgccccacaacatgcatgtggagaggttttgggggcagccatggaaccccggagctgcccccacatgagagttcccccaggtggtgaccaaatgcatttacagtccagccgcagtccagatgcagatgcgctgtaactgtagaacacacagcaaattctgaaggcttagtatgaaaaagaatataaaaatctcagtcatttttatattgatttcatgtttcctggttgagatgtca

SEQ ID NO: 181565 - DNA, 601 bp, Human
ttttaaagtgtacaacctcagccaggcatggtggctcacgcctgtaatcccagcactctgggaggctgaggcgggcagatcacctgaggtcaggagtttgagaccagactggccaacatggtgaaaccctgtctctactaaaaatacaaaaattagccgggtgtggtggtgcacatctgtaatcctagctacttggaaggctgaggcaggagaatcgcttgaacctgggggtagaggttgcagcaagccgagatcacaccactgcactctagcctgggtgacacagtgagactctatctcaaaaaaaaaaaaattgtacaacctcagtcttttttagtgtcttcattttgttgtgcaaccatcaccactatttaattccagaacatttccatcaacccaaaaagaatccctgtacctgtgagcagtcccccctccatccccttcaccccccagcccctggcaggccctgttctctgtcctgtgcattctgacctttcacataacagaatccgtggcctttccagcctggcttcttccactttgcacacggtgttgcaggctccccgcgttgtggcatatgacagctctttgttcctttatg

SEQ ID NO: 181566 - DNA, 601 bp, Human
ggcagatcacctgaggtcaggagtttgagaccagactggccaacatggtgaaaccctgtctctactaaaaatacaaaaattagccgggtgtggtggtgcacatctgtaatcctagctacttggaaggctgaggcaggagaatcgcttgaacctgggggtagaggttgcagcaagccgagatcacaccactgcactctagcctgggtgacacagtgagactctatctcaaaaaaaaaaaaattgtacaacctcagtcttttttagtgtcttcattttgttgtgcaaccatcaccactatttmattccagaacatttccatcaacccaaaaagaatccctgtacctgtgagcagtcccccctccatccccttcaccccccagcccctggcaggccctgttctctgtcctgtgcattctgacctttcacataacagaatccgtggcctttccagcctggcttcttccactttgcacacggtgttgcaggctccccgcgttgtggcatatgacagctctttgttcctttatggctggatgacgttccgttgcgtggctgcgtcctgtggctgcattgtgtggctgtgtcacgtggctacgtcacg

SEQ ID NO: 181567 - DNA, 601 bp, Human
tgcaggctccccgcgttgtggcatatgacagctctttgttcctttatggctggatgacgttccgttgcgtggctgcgtcctgtggctgcattgtgtggctgtgtcacgtggctacgtcacgtttggttgatccgttcatcagctgatggacatttgggctgtttccacaaaggctcttgtgaatgatgctgctgcaaacgtttgtgtgcaaatttttgtatgaaagatacatggtgaaatgaggtattttgaggtacattggattaaatgagatattaaaaatttttttaaagtctagccrtcttgaaggggagggcctgagagaagtgctgaaagttcacagcagaggataccggatgctgcgggtgtgccaggctggcctgtccaggaggtccctgcagcctgggtgggaggtcccttacccactaatgggtgcctcctccaacccctgagtccccctacctgaggacttcctctgtgtgtggcatacgcggctgccccgaggtcagtcctccccagtgaaagggagctgaaggacaggtgcccagcttctttgctccacagtgggaccaatctctgacatcatcaatgcagttgctca

SEQ ID NO: 181568 - DNA, 601 bp, Human
cctgagagaagtgctgaaagttcacagcagaggataccggatgctgcgggtgtgccaggctggcctgtccaggaggtccctgcagcctgggtgggaggtcccttacccactaatgggtgcctcctccaacccctgagtccccctacctgaggacttcctctgtgtgtggcatacgcggctgccccgaggtcagtcctccccagtgaaagggagctgaaggacaggtgcccagcttctttgctccacagtgggaccaatctctgacatcatcaatgcagttgctcaaagggagctcagagcraggagtcacctgtacatcaactcaccctctgggagctctcttcccttccatgcctcaatcccccactccctcccagggcttcctgggctggcctccaaatgcaccactagcccccagctccttgtctccggtgggcttttgaggatttccaactaagaaccttagactccaagacaggtcaagccccctggcatactcatttgtcatttggatgaaatagccttaggagagctacttaaccccactgaacttccatttccctgacaaaataggaattctaatgcataccttgcatggttc

SEQ ID NO: 181569 - DNA, 601 bp, Human
ctttgctccacagtgggaccaatctctgacatcatcaatgcagttgctcaaagggagctcagagcgaggagtcacctgtacatcaactcaccctctgggagctctcttcccttccatgcctcaatcccccactccctcccagggcttcctgggctggcctccaaatgcaccactagcccccagctccttgtctccggtgggcttttgaggatttccaactaagaaccttagactccaagacaggtcaagccccctggcatactcatttgtcatttggatgaaatagccttaggagagctayttaaccccactgaacttccatttccctgacaaaataggaattctaatgcataccttgcatggttcttggaggataaatgaagtaatttatgcaaaatgctgagcacagtgcctgccacttggtaagcgcccagtaaatggttgttatcattgaaaatgacttagggggcatttttgaatggctaaagttatgtctctctggaattgctgaattttaatagaacaggaatgcttcctaaggtctaaaacaaaaggcggaggactggctgtgtctgccctggaagccaagttaatgctggat

SEQ ID NO: 181570 - DNA, 601 bp, Human
ccaaatgcaccactagcccccagctccttgtctccggtgggcttttgaggatttccaactaagaaccttagactccaagacaggtcaagccccctggcatactcatttgtcatttggatgaaatagccttaggagagctacttaaccccactgaacttccatttccctgacaaaataggaattctaatgcataccttgcatggttcttggaggataaatgaagtaatttatgcaaaatgctgagcacagtgcctgccacttggtaagcgcccagtaaatggttgttatcattgaaaatgayttagggggcatttttgaatggctaaagttatgtctctctggaattgctgaattttaatagaacaggaatgcttcctaaggtctaaaacaaaaggcggaggactggctgtgtctgccctggaagccaagttaatgctggatgtctgcgcatagacatgttgctcatgagaaataataatgctccttaataatattgtctatttcagtgcaatttcagtctagaaggctttataagcaaagccacagtcatccttacttgcatttttttgaaacaaaaagactgcagtgtataaatgaaaaa

SEQ ID NO: 181571 - DNA, 601 bp, Human
atttgagtaaaatggagatgatgacagctgaacattgctgcacggacctcaagactgcaaacgttaggactgccctccctgctcctaggcatttgtgagaaccaggccaacccatacccacccactgctgtgtcctgcctgactgcactgaaatgcacagatcctgtgggtgcagtttgatgagttttgttttgttttttgttgtttttgtttttgaggagtttcgctcttgttgccgaggctggagtgcagtggcgcgatctcggctcactgcaacttctgcctcctgggttcaagcaaktatcctgcctcagcctcccgtgtagctgagattacaggcgcatgccaccatgcccagctaattttttgtatttttagtagagacaaggtttcaccatgttggccaggctgatctcgaactcctgacctcaggtgatccacctgcctcagcctcccaaagtgctgggattacaggcatgagccactgtgcccagccacagtttgatgagttttgatagaagtgcatgtgttagatctttcaggaatcaccacccaaaccagaaataccatttgacccagcaatgacgtttatatatatacc

SEQ ID NO: 181572 - DNA, 601 bp, Human
ccactgctgtgtcctgcctgactgcactgaaatgcacagatcctgtgggtgcagtttgatgagttttgttttgttttttgttgtttttgtttttgaggagtttcgctcttgttgccgaggctggagtgcagtggcgcgatctcggctcactgcaacttctgcctcctgggttcaagcaattatcctgcctcagcctcccgtgtagctgagattacaggcgcatgccaccatgcccagctaattttttgtatttttagtagagacaaggtttcaccatgttggccaggctgatctcgaactyctgacctcaggtgatccacctgcctcagcctcccaaagtgctgggattacaggcatgagccactgtgcccagccacagtttgatgagttttgatagaagtgcatgtgttagatctttcaggaatcaccacccaaaccagaaataccatttgacccagcaatgacgtttatatatatacccaaaggaatataaatcattctattataaagatatatctacatgtatgttcattgtagcactattcacaatagcaaagagatagtatcaatccaaatgcccatcaatgatagattggataaa

SEQ ID NO: 181573 - DNA, 601 bp, Human
aggcgcatgccaccatgcccagctaattttttgtatttttagtagagacaaggtttcaccatgttggccaggctgatctcgaactcctgacctcaggtgatccacctgcctcagcctcccaaagtgctgggattacaggcatgagccactgtgcccagccacagtttgatgagttttgatagaagtgcatgtgttagatctttcaggaatcaccacccaaaccagaaataccatttgacccagcaatgacgtttatatatatacccaaaggaatataaatcattctattataaagatatayctacatgtatgttcattgtagcactattcacaatagcaaagagatagtatcaatccaaatgcccatcaatgatagattggataaagaaaatgtggtacatatacaccatggaatactatgcagccataaaaaggaacaagatcatgtcctttgcagtgacatagacagagctggaagccattatcctcagcaaattaatgcaggaacagaaaaccaaacaccacatgttctcacttataagtgggagctggacaatgagaacacatggacacagggaggggaataacacacactggggcc

SEQ ID NO: 181574 - DNA, 601 bp, Human
cctcagcctccgagtagagacatgttgcccacgctggtgtcgaactcctgggctaaagcaatccgcatcatgatgtttgtaagatccattcgtgcagttatttccttttgcactgctgagcactgcatgcctcgctcattcattcttctgtggagggacatttgggtcatttccagtttagggttcggctactagaattattgtacaagtcttattgtgggcatccttgtccatgatcttgggtccacctaggagttaaatggctggctcatatgctgtgtttgtttaacttaagacttamttgttaagtgtaagaaactgccaagctgggccgggcacagtggctcacgcctgtaatcccagcactttgggaggccgaggcgggcggatcacttgaggtcaggagttcgagaccagcctggccaacatggcaaaaccccatctctacaaaaagtgcaaaaaattagcagggtgtggtggtgtgtgcctgtagtcccagctactcaggaggctgaggcaggagaatctcttgaacctgggaggaggaggttgcagtgagcagaggttgcgccactgcactccagtctgggcgacagagcga

SEQ ID NO: 181575 - DNA, 601 bp, Human
gctttttatgtattgacttgtttttgtttttgtttttgttttgagacagtgtcgctctgtcacccaggctggagtgcagtgctgccatctcggctcactgcaacctccgcctccaggcttcaagtgattctcctgcctcagcctcccgggtagctgggattacaggtgtgcaccaccacaccagataatttttgtatttttagtagagacagggtttcaccatgttggtcagggtggtctcgaactcctgacctcaggtgatccacccgcctcagcctcccaaagtgctgggattacaggygtgagccacagcacctggccgcttttcatgtattgctagatttgatttcctaacaattcgttaagaatgtggctgtctatgcttaaatgggatattgatttgtaattttttttcttgcagtgtctttgtcatgttttgatattggccctatagtggcctcataaaacacattgggaagtttactttcttctgtattttctgaaagattttatgtaattttggtattattttgtcctatgtccctttacacttaatgtatttgggttttttgtgtgtgtctttttaatagttaataacaat

SEQ ID NO: 181576 - DNA, 601 bp, Human
ttttattcttgaaaatcactgagagtacattttgcattctcaccacaaaaaaaaactatgtggcataatgtgtatgttaattcacttgatttagccattctacaatgtatatatttcaaaacatcatcttgaccatgggaaatgtatctaatttttgtcaatttgttaaaactttttttttaattccaatttttttttttttgaggtggagtctcgctttgttgcccaggctggagtgcatgaccatgggaaatgtatctaatttttgtcaatttgttaaaactttttttttcattccaattttttttttttttttttttgagatggagtctcactttgtcgcccaggctggagtgcagtggtgcaatcttggctcactgcaagctccacctcccgggttcacgccattctcctgcctcagcctcccaagtagctgggactacaggcgcccaccaccgtgcctggctaacgtttgtatttttagtagagatggggtttcactgcattagccaggatggtctcgctctcctgacctcatgatccacctgccttgacctcccaaagtgctgggattacaggtgtgagccaccacgcccagccc

SEQ ID NO: 181577 - DNA, 601 bp, Human
aggatggtctcgctctcctgacctcatgatccacctgccttgacctcccaaagtgctgggattacaggtgtgagccaccacgcccagccccaacttttattttacgtacagatctaaacgtatcacatgcaggtttgttatgtggtgtgtcgcacccagatggtgagcagagcccccaagtctttgttgatatggttggggttagctctcccagtctttgttcatatggttggggttggctctaccagtctttgttcatatggttggggttagctctaccagtctttattgatatggttgrggttagctctaccagtctttgtcgatatggttggggttagctctaccagtctttgttgatatggttggggttagctctaccagtctttgttgatatggttggggttagctctaccagtctttgttgattagctctcccagtctttgttgatatggttggggttagctctaccagtctttgttcatatggttggggttagctctaccagtctttgttgatatggttgaggttagctctaccagtctttgttgatatggttggggttagctctcccagtctttgttgatatggttggggtta

SEQ ID NO: 181578 - DNA, 601 bp, Human
atatggttgaggttagctctaccagtctttgtcgatatggttggggttagctctaccagtctttgttgatatggttggggttagctctaccagtctttgttgatatggttggggttagctctaccagtctttgttgattagctctcccagtctttgttgatatggttggggttagctctaccagtctttgttcatatggttggggttagctctaccagtctttgttgatatggttgaggttagctctaccagtctttgttgatatggttggggttagctctcccagtctttgttgatatgrttggggttagctctaccagtctttgttcatatggttggggttagctctaccagtctttgttgatatggttgaggttagctctaccagtctttgttgatatggttggggttagctctacctgtctttgttcatatggttggggttagctctaccagcctttgttcatatggttggggttagctctaccacgttgctatttgctgtttcttgatcttgggttttgtttttctgttcctccttttctgccttctcctgtgttaattgaataaatttttgttttccattttattccttctgctg

SEQ ID NO: 181579 - DNA, 601 bp, Human
ctaccagtctttgttgattagctctcccagtctttgttgatatggttggggttagctctaccagtctttgttcatatggttggggttagctctaccagtctttgttgatatggttgaggttagctctaccagtctttgttgatatggttggggttagctctcccagtctttgttgatatggttggggttagctctaccagtctttgttcatatggttggggttagctctaccagtctttgttgatatggttgaggttagctctaccagtctttgttgatatggttggggttagctctaccwgtctttgttcatatggttggggttagctctaccagcctttgttcatatggttggggttagctctaccacgttgctatttgctgtttcttgatcttgggttttgtttttctgttcctccttttctgccttctcctgtgttaattgaataaatttttgttttccattttattccttctgctgactctttagctgtctctttttgcattatttttcctcggctgttgtaagtgttacaatatgcatctttacttttttttttttttttttttacaattgatagactttgttttttagattcac

SEQ ID NO: 181580 - DNA, 601 bp, Human
ctctcccagtctttgttgatatggttggggttagctctaccagtctttgttcatatggttggggttagctctaccagtctttgttgatatggttgaggttagctctaccagtctttgttgatatggttggggttagctctacctgtctttgttcatatggttggggttagctctaccagcctttgttcatatggttggggttagctctaccacgttgctatttgctgtttcttgatcttgggttttgtttttctgttcctccttttctgccttctcctgtgttaattgaataaatttttgttttccattttattccttctgctgactctttagctgtctctttttgcattatttttcctcggctgttgtaagtgttacaatatgcatctttacttttttttttttttttttttacaattgatagactttgttttttagattcacggcaaaattgagtgaaaagtgtggagctcccacatgttccccccacacacagacattcagcctctgccaccgtcaacgtcctgcatcagattgtatattggttacagccgggcgcactggctcacgcctgtaatcacagcactttgagaggccaagg

SEQ ID NO: 181581 - DNA, 601 bp, Human
tgaggttagctctaccagtctttgttgatatggttggggttagctctacctgtctttgttcatatggttggggttagctctaccagcctttgttcatatggttggggttagctctaccacgttgctatttgctgtttcttgatcttgggttttgtttttctgttcctccttttctgccttctcctgtgttaattgaataaatttttgttttccattttattccttctgctgactctttagctgtctctttttgcattatttttcctcggctgttgtaagtgttacaatatgcatctttacttttttttttttttttttttacaattgatagactttgttttttagattcacggcaaaattgagtgaaaagtgtggagctcccacatgttccccccacacacagacattcagcctctgccaccgtcaacgtcctgcatcagattgtatattggttacagccgggcgcactggctcacgcctgtaatcacagcactttgagaggccaaggcaggcagatcactggaggtcaggagttcaagaccagactggccaacatggtgaaaccctgtctctactaaaaatataaaaattagccaggcgt

SEQ ID NO: 181582 - DNA, 601 bp, Human
tttaagattcttttatgccttttcccggcatcttagcattgaagcatattccatggtctgtatgtatcacagtttatttgcccactcacctattgaagagcatcttggttgcttccaggtttgggcagttatgaataaagctgccataaatatttgtgcacaagtttttgtgtgcacataagattttaacacatttggataaataccaagaagcacaattgctggatcttttggtaacagcatgtttagttttgtaagaagctgccaaacggtcttccaaagtgactgggccattttgcaytcccagcagcaatgaacgagcattcctgccgctccacatcctccccagcttttgtgtttcagtgtcttggattttcaccactctgataggtgtattgcagtatcttcttcttgttttattttgcaattccctagtgacatatcatgataagcatcttctcatatgcctgcttgccatctgcatgtcttctttgaggtgtctgttcatatcttttggccacttttaatcatcctgaacttttcacaatctatttagaattaatactgtaccgcctcacataaaaaataaggacactgcagc

SEQ ID NO: 181583 - DNA, 601 bp, Human
gcacataagattttaacacatttggataaataccaagaagcacaattgctggatcttttggtaacagcatgtttagttttgtaagaagctgccaaacggtcttccaaagtgactgggccattttgcattcccagcagcaatgaacgagcattcctgccgctccacatcctccccagcttttgtgtttcagtgtcttggattttcaccactctgataggtgtattgcagtatcttcttcttgttttattttgcaattccctagtgacatatcatgataagcatcttctcatatgcctgcttkccatctgcatgtcttctttgaggtgtctgttcatatcttttggccacttttaatcatcctgaacttttcacaatctatttagaattaatactgtaccgcctcacataaaaaataaggacactgcagctatataagtctacttactcccctctcccaccacctttgagttattgtgtcatatgttttatatctgcatacattttaagccccataatacaatattataatttcctttttttttttttttttttttgagacggagtctcactctcttgcccaggctggagtgcagtagtgaga

SEQ ID NO: 181584 - DNA, 601 bp, Human
ttgtctctcgagactcccctctgtttacgatttactgacgccgcttttgtttcggtgtttgcacgtacctgcaattgctgcattaaagtctcgtttgctcattttggcatctgagccggcaagcgtccagggtgtctgagggatgattttctcttggccatgggtcacattttcctatttctttgcatgtctattttttattgtagactaagattatgaataacacctaggagagacattggattttgttatcatcctctgaagagtgttaattttgctccagcagtcagttccgttactsactgatcatctgaacttcgtgcagcctggttttatgctttgttggggtagatctctagactgacccttctgtggttttagtaggaagcctgaggtatttatcaagcctctctaactcgactacatttaaactccaaactttgtctcctccacagcaggagctgaaacctctgccacactaggcccacaaacatgcgtcattcagggatccaccaaggaacagggtagtttatacagaatttgggtcccactgccatggcttcctcctttgggaactctcctttccatttccatcctctct

SEQ ID NO: 181585 - DNA, 601 bp, Human
ggaactctcctttccatttccatcctctctgacaacctaaaactgtgtcatctgacgcttcaacctggaactttctgcttaagttttagccatctacattataagggcactttatagcaagaaatagaatattattccattctaggccaagtacagtggctcacacctgacatctcagcactttgggaggccgaggtgggtggatcaactgaggtcaggagtttgaaaccagcctggccaacatggtgaaatcctgtctcttctaaaaaaaattttgaaaaaattagccgggtgtggtggygcatacctgtaatcccagctactcaggagctgaggcaggagaatcccttgaacctgggagccagaggttgcagtgagccgagatggcgccactgccctccagcctgggtgacagagtgagagtctgtctcaaaaaaaaaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgt

SEQ ID NO: 181586 - DNA, 601 bp, Human
tgacaacctaaaactgtgtcatctgacgcttcaacctggaactttctgcttaagttttagccatctacattataagggcactttatagcaagaaatagaatattattccattctaggccaagtacagtggctcacacctgacatctcagcactttgggaggccgaggtgggtggatcaactgaggtcaggagtttgaaaccagcctggccaacatggtgaaatcctgtctcttctaaaaaaaattttgaaaaaattagccgggtgtggtggtgcatacctgtaatcccagctactcaggagctgaggcaggagaatcccttgaacctgggagccagaggttgcagtgagccgagatggcgccactgccctccagcctgggtgacagagtgagagtctgtctcaaaaaaaaaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgttgctgctgtgtacaacctgttaaagtcca

SEQ ID NO: 181587 - DNA, 601 bp, Human
attctaggccaagtacagtggctcacacctgacatctcagcactttgggaggccgaggtgggtggatcaactgaggtcaggagtttgaaaccagcctggccaacatggtgaaatcctgtctcttctaaaaaaaattttgaaaaaattagccgggtgtggtggtgcatacctgtaatcccagctactcaggagctgaggcaggagaatcccttgaacctgggagccagaggttgcagtgagccgagatggcgccactgccctccagcctgggtgacagagtgagagtctgtctcaaaaaaawaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgttgctgctgtgtacaacctgttaaagtccacagatggaataaaagctttggtttgcaaaaatgactcaatctttacaaacattctgtcatttgtaccataatcaattagtttattggatcaccgaattgcctgacagaa

SEQ ID NO: 181588 - DNA, 601 bp, Human
ggagaatcccttgaacctgggagccagaggttgcagtgagccgagatggcgccactgccctccagcctgggtgacagagtgagagtctgtctcaaaaaaaaaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgttgctgctgtgtacaacctgttaaagtccacagatggartaaaagctttggtttgcaaaaatgactcaatctttacaaacattctgtcatttgtaccataatcaattagtttattggatcaccgaattgcctgacagaatccttcctggaactagtctatggggtcatttggcatagagtcaaagcctcagacacgatgagccagagttgatttcctttggcttcacataattaaactttcccagaggattatcaggttacagtgacacacacacaggctgtcagataatggacaaagtcccagcagcgtgtacaaccagctggtggctcccaaattca

SEQ ID NO: 181589 - DNA, 601 bp, Human
tagatgtactattgtgtatcctactgatagatacttgtgttgcttccagtcttgtttttacagcgatcagatggttcttcttaatttctcttgctacaaatgttgctgctgtgtacaacctgttaaagtccacagatggaataaaagctttggtttgcaaaaatgactcaatctttacaaacattctgtcatttgtaccataatcaattagtttattggatcaccgaattgcctgacagaatccttcctggaactagtctatggggtcatttggcatagagtcaaagcctcagacacgatragccagagttgatttcctttggcttcacataattaaactttcccagaggattatcaggttacagtgacacacacacaggctgtcagataatggacaaagtcccagcagcgtgtacaaccagctggtggctcccaaattcaaattcccccagcggcatccgttcggttattcgtacccacaccctcccttagaagtttacccctccgccaggcgcagtgactcacgcctgtaatcccagcactttgggaggccaaggcgggcggatcacctgaggttgggagttcgagaccagcctgacca

SEQ ID NO: 181590 - DNA, 601 bp, Human
gactcacgcctgtaatcccagcactttgggaggccaaggcgggcggatcacctgaggttgggagttcgagaccagcctgaccaacatggagaaaccccgtctctactaaaaatacaaaaattagccgggcatggtcacgcatgcctgtaatcccagctactcgggaggctgaggcaggagaatcgcttgaacctgggaggcggaggttgcggtgagccgagatcatgccattgcactccagcctgggcaacaagagcaaaactccatctcaataaataaataaataagttcaccccactaygggcaagaagccacacagaaagaaaaataaaataggtatctctggggttttctgaagggaaagtaagtgcagctctgtcccgtctttgcagctctaaataggaacatggtggagtagggcaggtcgggcttgacgatgtcatgacttggcctctctcagtgtcacgcagcccctgcaggttataaggaggattgagctggccaggcacagtggctcatacctgtaatcccagcactttgggaggccgaggtgggcggatcacctgaggtcgggagttcgagaccagcctggccaacgtgg

SEQ ID NO: 181591 - DNA, 601 bp, Human
aaaaatacaaaattagcccggcgtggtggtgcatgtctgttaacccagctgctcgggaggctgaggcaggagaattgcttgaacccgggaggcggaggttgcagtgagctgagatttcgccattgcattccagcctgggtaacaagagcgaaactccgtctcaaaaaaaaaaagaaggatagagctaacatgcatgaaccacctagaacagcacccagagcatagtaacagctccttgcagatgttacagtaccttgatctatacaacagtaaagggaaatgcatgctagctgccccagaygctgccagcttcacaggcatttttctgcctgcaaactaatcctaaggaagagaggagggcagggggagaaattgcacccagtcaaatgtaaacgatacaaaatgtgaaattcccctctctgaaaatgaaagggaaaaaactcgattcaatgcctgcccctgaggtgaacctgaaatgacaaggcagacactctctagaacttcacgtttggccaccagggtcttcggttgattttcctttcttcgtcatatctgagtggctgaaacgccagtgatctgggatagtcctttggctgctgat

SEQ ID NO: 181592 - DNA, 601 bp, Human
gtgagctgagatttcgccattgcattccagcctgggtaacaagagcgaaactccgtctcaaaaaaaaaaagaaggatagagctaacatgcatgaaccacctagaacagcacccagagcatagtaacagctccttgcagatgttacagtaccttgatctatacaacagtaaagggaaatgcatgctagctgccccagatgctgccagcttcacaggcatttttctgcctgcaaactaatcctaaggaagagaggagggcagggggagaaattgcacccagtcaaatgtaaacgatacaaaaygtgaaattcccctctctgaaaatgaaagggaaaaaactcgattcaatgcctgcccctgaggtgaacctgaaatgacaaggcagacactctctagaacttcacgtttggccaccagggtcttcggttgattttcctttcttcgtcatatctgagtggctgaaacgccagtgatctgggatagtcctttggctgctgatagacttatgcaatcccttggcaggcaggacaggccagaggaagggctcctgtgcctttaaggtcactgttaatcatgtaactttattgtgttcctgggctata

SEQ ID NO: 181593 - DNA, 601 bp, Human
gaaccacctagaacagcacccagagcatagtaacagctccttgcagatgttacagtaccttgatctatacaacagtaaagggaaatgcatgctagctgccccagatgctgccagcttcacaggcatttttctgcctgcaaactaatcctaaggaagagaggagggcagggggagaaattgcacccagtcaaatgtaaacgatacaaaatgtgaaattcccctctctgaaaatgaaagggaaaaaactcgattcaatgcctgcccctgaggtgaacctgaaatgacaaggcagacactctcyagaacttcacgtttggccaccagggtcttcggttgattttcctttcttcgtcatatctgagtggctgaaacgccagtgatctgggatagtcctttggctgctgatagacttatgcaatcccttggcaggcaggacaggccagaggaagggctcctgtgcctttaaggtcactgttaatcatgtaactttattgtgttcctgggctataaaggaaatgtcgtccttgatctgaatgtctgttttatgatgtccataaacagtgaattgccagtgactgtaccctgagtgagaacatcctca

SEQ ID NO: 181594 - DNA, 601 bp, Human
aacagctccttgcagatgttacagtaccttgatctatacaacagtaaagggaaatgcatgctagctgccccagatgctgccagcttcacaggcatttttctgcctgcaaactaatcctaaggaagagaggagggcagggggagaaattgcacccagtcaaatgtaaacgatacaaaatgtgaaattcccctctctgaaaatgaaagggaaaaaactcgattcaatgcctgcccctgaggtgaacctgaaatgacaaggcagacactctctagaacttcacgtttggccaccagggtcttcrgttgattttcctttcttcgtcatatctgagtggctgaaacgccagtgatctgggatagtcctttggctgctgatagacttatgcaatcccttggcaggcaggacaggccagaggaagggctcctgtgcctttaaggtcactgttaatcatgtaactttattgtgttcctgggctataaaggaaatgtcgtccttgatctgaatgtctgttttatgatgtccataaacagtgaattgccagtgactgtaccctgagtgagaacatcctcagccagttgaatagttcaagggcagttgcagg

SEQ ID NO: 181595 - DNA, 601 bp, Human
ggaagagaggagggcagggggagaaattgcacccagtcaaatgtaaacgatacaaaatgtgaaattcccctctctgaaaatgaaagggaaaaaactcgattcaatgcctgcccctgaggtgaacctgaaatgacaaggcagacactctctagaacttcacgtttggccaccagggtcttcggttgattttcctttcttcgtcatatctgagtggctgaaacgccagtgatctgggatagtcctttggctgctgatagacttatgcaatcccttggcaggcaggacaggccagaggaagggmtcctgtgcctttaaggtcactgttaatcatgtaactttattgtgttcctgggctataaaggaaatgtcgtccttgatctgaatgtctgttttatgatgtccataaacagtgaattgccagtgactgtaccctgagtgagaacatcctcagccagttgaatagttcaagggcagttgcaggggtcaggagagagcaaaagtgggacagaagatgagtttgcttcccaggaagagagacagtgccaccccacccctcgctgacagggaagccttccagcccttcctccaaagagccttggct

SEQ ID NO: 181596 - DNA, 601 bp, Human
cacccagtcaaatgtaaacgatacaaaatgtgaaattcccctctctgaaaatgaaagggaaaaaactcgattcaatgcctgcccctgaggtgaacctgaaatgacaaggcagacactctctagaacttcacgtttggccaccagggtcttcggttgattttcctttcttcgtcatatctgagtggctgaaacgccagtgatctgggatagtcctttggctgctgatagacttatgcaatcccttggcaggcaggacaggccagaggaagggctcctgtgcctttaaggtcactgttaatcwtgtaactttattgtgttcctgggctataaaggaaatgtcgtccttgatctgaatgtctgttttatgatgtccataaacagtgaattgccagtgactgtaccctgagtgagaacatcctcagccagttgaatagttcaagggcagttgcaggggtcaggagagagcaaaagtgggacagaagatgagtttgcttcccaggaagagagacagtgccaccccacccctcgctgacagggaagccttccagcccttcctccaaagagccttggctctcaggggttggaggttggacaagagcag

SEQ ID NO: 181597 - DNA, 601 bp, Human
tttaaggtcactgttaatcatgtaactttattgtgttcctgggctataaaggaaatgtcgtccttgatctgaatgtctgttttatgatgtccataaacagtgaattgccagtgactgtaccctgagtgagaacatcctcagccagttgaatagttcaagggcagttgcaggggtcaggagagagcaaaagtgggacagaagatgagtttgcttcccaggaagagagacagtgccaccccacccctcgctgacagggaagccttccagcccttcctccaaagagccttggctctcaggggtyggaggttggacaagagcagaaataaaggcaccctgctcccaccccccacaatcttccggacgtctagagtgcttatctctttgggggcaagtaatgtgaattattttccctaatgcaaaaataaaaaataagagaccccttttacccttttctgaaaggatagcagaggtatttttcttttcttttttttttttgagatggaatcttgctctgtcaccaggctggagtgcagtggcacaatctcagctcactgcaacctccgactccctggttcaagtgattctcctgcctcagcctccc

SEQ ID NO: 181598 - DNA, 601 bp, Human
cctgggctataaaggaaatgtcgtccttgatctgaatgtctgttttatgatgtccataaacagtgaattgccagtgactgtaccctgagtgagaacatcctcagccagttgaatagttcaagggcagttgcaggggtcaggagagagcaaaagtgggacagaagatgagtttgcttcccaggaagagagacagtgccaccccacccctcgctgacagggaagccttccagcccttcctccaaagagccttggctctcaggggttggaggttggacaagagcagaaataaaggcaccctgcycccaccccccacaatcttccggacgtctagagtgcttatctctttgggggcaagtaatgtgaattattttccctaatgcaaaaataaaaaataagagaccccttttacccttttctgaaaggatagcagaggtatttttcttttcttttttttttttgagatggaatcttgctctgtcaccaggctggagtgcagtggcacaatctcagctcactgcaacctccgactccctggttcaagtgattctcctgcctcagcctcccgagtagctgggattacaggcacgtaccaccatgccca

SEQ ID NO: 181599 - DNA, 601 bp, Human
gcaaaagtgggacagaagatgagtttgcttcccaggaagagagacagtgccaccccacccctcgctgacagggaagccttccagcccttcctccaaagagccttggctctcaggggttggaggttggacaagagcagaaataaaggcaccctgctcccaccccccacaatcttccggacgtctagagtgcttatctctttgggggcaagtaatgtgaattattttccctaatgcaaaaataaaaaataagagaccccttttacccttttctgaaaggatagcagaggtatttttcttttcttttttttttttgagatggaatcttgctctgtcaccaggctggagtgcagtggcacaatctcagctcactgcaacctccgactccctggttcaagtgattctcctgcctcagcctcccgagtagctgggattacaggcacgtaccaccatgcccagctaatttttttgtatttttagtagagacggagtttcaccatgttggccaggatggtcttgaacttctgacctcatgatccgcccacctcagcctccagaagtgctgagattacaggcgtgagccaccatgcccgtccagcagagg

SEQ ID NO: 181600 - DNA, 601 bp, Human
caagctgatgttcctaggtcacctccctcaatgcatgggtctaggggccagcatgttctattgctagggccatgtgtgcattcgtttgcctaggggagaaaagtacacattcccatcagctcaggtgcgtggaggacggaagaactgctgttgctgctagtattctcttcagcacaagataaaaaggagataggcaaatcagctggctggccaatcaaattaacttattgttacactaatttttagaatcagaattatgggtcaggctgtgctagcaatcagtgaaatcaaatttcatgtyattctgcactgggtagactcaggatttgcctgaaacaagtaaacaattcctggaagaagtgggcgaggcagaggcttgaactatccactcagaccaaggaggagtcaggcaatggcttctgggcatcgtgtggggtgggggcagcccctgccctggacacccgtgaacacggaggcagccgtgtgaacaccatgaggcagggtgtccatcctgccacccacacagctgcgtcctgcccaggaatgaggctggcagcccataggcccctccttggtccctctagaggtttgcttcattcca

SEQ ID NO: 181601 - DNA, 601 bp, Human
tgttcctaggtcacctccctcaatgcatgggtctaggggccagcatgttctattgctagggccatgtgtgcattcgtttgcctaggggagaaaagtacacattcccatcagctcaggtgcgtggaggacggaagaactgctgttgctgctagtattctcttcagcacaagataaaaaggagataggcaaatcagctggctggccaatcaaattaacttattgttacactaatttttagaatcagaattatgggtcaggctgtgctagcaatcagtgaaatcaaatttcatgtcattctgcrctgggtagactcaggatttgcctgaaacaagtaaacaattcctggaagaagtgggcgaggcagaggcttgaactatccactcagaccaaggaggagtcaggcaatggcttctgggcatcgtgtggggtgggggcagcccctgccctggacacccgtgaacacggaggcagccgtgtgaacaccatgaggcagggtgtccatcctgccacccacacagctgcgtcctgcccaggaatgaggctggcagcccataggcccctccttggtccctctagaggtttgcttcattccagtaccctt

SEQ ID NO: 181602 - DNA, 601 bp, Human
gaagaactgctgttgctgctagtattctcttcagcacaagataaaaaggagataggcaaatcagctggctggccaatcaaattaacttattgttacactaatttttagaatcagaattatgggtcaggctgtgctagcaatcagtgaaatcaaatttcatgtcattctgcactgggtagactcaggatttgcctgaaacaagtaaacaattcctggaagaagtgggcgaggcagaggcttgaactatccactcagaccaaggaggagtcaggcaatggcttctgggcatcgtgtggggtgsgggcagcccctgccctggacacccgtgaacacggaggcagccgtgtgaacaccatgaggcagggtgtccatcctgccacccacacagctgcgtcctgcccaggaatgaggctggcagcccataggcccctccttggtccctctagaggtttgcttcattccagtacccttggttctgtcaagtgggcagggcctgggcccctctgctgcaaacccatggcccaaagcggacctgatccggcagcatctaaaaacaggacccggagaatctgctggactccaggattgccctggaacaaac

SEQ ID NO: 181603 - DNA, 601 bp, Human
tagcaatcagtgaaatcaaatttcatgtcattctgcactgggtagactcaggatttgcctgaaacaagtaaacaattcctggaagaagtgggcgaggcagaggcttgaactatccactcagaccaaggaggagtcaggcaatggcttctgggcatcgtgtggggtgggggcagcccctgccctggacacccgtgaacacggaggcagccgtgtgaacaccatgaggcagggtgtccatcctgccacccacacagctgcgtcctgcccaggaatgaggctggcagcccataggcccctcctyggtccctctagaggtttgcttcattccagtacccttggttctgtcaagtgggcagggcctgggcccctctgctgcaaacccatggcccaaagcggacctgatccggcagcatctaaaaacaggacccggagaatctgctggactccaggattgccctggaacaaacctaaagtctcctatgacatgcaaacaattctgccagccccggccagcattccctgcatgtgcttatcaagtgaggaggccagcaggacttagcacccaggtgagcacacttcattgagtccaggtgtgtgcaga

SEQ ID NO: 181604 - DNA, 601 bp, Human
cacataatatcaaatttggctgacacaaggtgattttgccacgaaggttgggaaggatgaacatttgcaattgaaaactgtttgttgcccccagaatccagcggtttcaggctctctgaggattccagaggtgctagagggggtaaggccacattcaggtggtgcaggtgggattcaccccttcacagcctggaggtggtgcccggagcgcaccctgtcaccccaaggatgatgacaccccagggaaggtggtggaagcaggaaggggaggtcagaggaaaactggggccctcagtgggcrtccgtgatgcggaaacactaataatgccaacagcaatagcagaggcaggcagggcttacgtggccagggctgggctggtgctgtcctgagcacttgacatgcatgaaatcacagttgttttaagttctgaactcccctgggaggaaactgtggccacagcaggaattccaatgattctagggtcaggagaggaggcacccacttcctgatcagggctctgtttgtggatgcgtgggtgtggttggcctttgtgcacactggtggttttgcttctttcccccagcaaaagaatgcagattt

SEQ ID NO: 181605 - DNA, 601 bp, Human
aaggggaggtcagaggaaaactggggccctcagtgggcatccgtgatgcggaaacactaataatgccaacagcaatagcagaggcaggcagggcttacgtggccagggctgggctggtgctgtcctgagcacttgacatgcatgaaatcacagttgttttaagttctgaactcccctgggaggaaactgtggccacagcaggaattccaatgattctagggtcaggagaggaggcacccacttcctgatcagggctctgtttgtggatgcgtgggtgtggttggcctttgtgcacactggyggttttgcttctttcccccagcaaaagaatgcagattttgcattatctaaagaggcggttccgtgagcccactgtgctgagtcacatatattccatcggtgtaagtaccaccacctgggcagtgcccctggagtgttctcactgggagcgcagctttgtgtctgtacccttcctgagaatagctgacatgctggcctgggtggcgcattggccgaggtgtggctatgacagaccaggataccagcatctgccccagcactgaactgagcacaccacagaaggtgtggacagagtggcatg

SEQ ID NO: 181606 - DNA, 601 bp, Human
ccatagtgctgggattacaggcatgatccaccatgcccggcctctggtctctatttgtatgatgttgtcaattctgtaacgttctacacatgtaatcatgcagtaggtgactttgggattggcgccttccacccagcacaaccccctggcatccatccgggttgtcgcctatatccgtggttcattcccttctttctgagtcatactccgcggtatggatggaccacggttggttcaaccattctcccttgaaaggcatctgcatcgtttgcatttgggactactacaaatacatccgccrggaacatgtggacaggcctttgtgtgaacatcagttctccgcgtacatcatctctctgccctggtgcttgcatctttagttggttttttctgtcttttgaagaacctaccagactgttttcagaatgactgtaccatttttcattcccaccagccacgagtgagtgagccgtgtttccacgggggttggcattattttgtatcccagccattttgataggtgtgcagtggtgtctcactgtggttgtaactggcatttcctaatggccgagtggctctcagcatctcttcatgggcttct

SEQ ID NO: 181607 - DNA, 601 bp, Human
tggtctcaaactcctgggctcaagcaatcctccaacctcgacctcccaaagtgctgggattacaggcatgcgccactgtgtgtggctggtattttatttataatttcagtgtctacatggtcattgctaagctttcttttctctgttgaattgcttttacatctgggtcaaaaatcagttgggcgtatttgtatggacatggtcataggccctctgtttctttccattgctctacctgtctgtctttctgccagtacctcacagtcttgattaccgaaattatgtcataagtctcaaaaakaagataggctgattcctctcattttgtctgttgtttttcaaaattgtttttattcttgtgaatcctttccctatctaaatgttagaataatctctatttctacaaaaaaaaaaaaaaaaaaaaaaagtcttgctaggctttcaatgggaattgtgtaaaacttgtttacctatgtggggagaatttactatgttgagtcttccaacccattaacatggtcagtcttgccatttgtttatatcttctttgatttctttcatgaatgttttgtagttttcaacatacaacttctgcatatgt

SEQ ID NO: 181608 - DNA, 601 bp, Human
ttgctaagctttcttttctctgttgaattgcttttacatctgggtcaaaaatcagttgggcgtatttgtatggacatggtcataggccctctgtttctttccattgctctacctgtctgtctttctgccagtacctcacagtcttgattaccgaaattatgtcataagtctcaaaaataagataggctgattcctctcattttgtctgttgtttttcaaaattgtttttattcttgtgaatcctttccctatctaaatgttagaataatctctatttctacaaaaaaaaaaaaaaaaaaamaaagtcttgctaggctttcaatgggaattgtgtaaaacttgtttacctatgtggggagaatttactatgttgagtcttccaacccattaacatggtcagtcttgccatttgtttatatcttctttgatttctttcatgaatgttttgtagttttcaacatacaacttctgcatatgttttgtcagtttgacacctaggggcatttttgagtgactgtaaatggtactggtgtttgtttgtttgtttttgagacagggtctttgtccctgaggctggagtgcagtggcatgatcgtggctc

SEQ ID NO: 181609 - DNA, 601 bp, Human
tatgcaattatttttatctattactgaattctacttgctatttcattagtgatttttgtatctatattcatgagggatgttggcatgtagttttctttttgttgtttttccttgtctgcatttggtatcagggtaataccaacttcataaaatgaatggggcccaggtgcagtggctcacacctgtaatcccagcactttgggaggccaaggcaggcagatcacttgaggccaggagttcaagaccagcctggctaacatgctaaaaccccggctctactaaaaatacaaaaaattagcckggcttagtggcgggcacctataatcccagctactcaggaggctgaggcagagaatcacttgagcccaggaggcggaggctgcagagagctgggatcataccactgcactccagcttgggggacagagtgagactcagtctcaaaaaaaaaaaaaaaaaagaatggtagtgttccctcctcttctgttttcttgaagatattgttagaatcatgttgactttttaaacatttggtagaattctctataaatgtttagaaccatcttggcctggacatttcgttttggggagtttttaaatt

SEQ ID NO: 181610 - DNA, 601 bp, Human
agagtgagactcagtctcaaaaaaaaaaaaaaaaaagaatggtagtgttccctcctcttctgttttcttgaagatattgttagaatcatgttgactttttaaacatttggtagaattctctataaatgtttagaaccatcttggcctggacatttcgttttggggagtttttaaattacaaattgacttttgctataggttgtttaaattacctgtttgatattgaatgagttgtagtacctcatgcttctctaggagttggtccattttattgaagatgtcagagttatgtgtgtagagrcatttgtagtgttcccgtattatccttttgatgtctgcagggtctgtagtgatgttccctctttcattcctgatattgacagtctgtgtcttccctctaattgtttctttgtcagtcttgctagaagtttgacaatttcttattttcaaatacctagctctgttttgttgattttctgcattgtttttctgttttctgttaccgggatttctattcccctatctttgtgatttccctccttccttcctttgctatcattgtgggtttactttgctcttcttttcctgggtgctcatggtg

SEQ ID NO: 181611 - DNA, 601 bp, Human
ttatagaaaatgcataagaaaaaggggaaatgcataagatagagggaagcaaacatttttaaataaaatttatataaaacttataaccaaagatgactactatttttattttggagtatactctcccaatatgttttcaaaagcaggatcactctctatgactgctttaaaatcttttttttgtactttaacaacagacatgaacatttttcaaaatattatttctaatagcaaaatatcattccagatatatgtctgatgatacagttttctcatcatttatttaatgagtctccattgrgtgggcgtgcaggttgtgacagttttctctgtgttaaataacactgtgatgaatatcttttgtgtacatgcatgatgatttcctagaaatgggaccctgggtcagtgcttgtgaacatttttagcttctgagccccattgccaagttggattcttgaaattttttgtttgtttgggcagctttggttttgtttttttgttttcttttgagatggagtttcgctcttgttccccaggctggagtgcaatggcacgatctcagctcaccgcaacctctgcctcccaggttcaagtgattctc

SEQ ID NO: 181612 - DNA, 601 bp, Human
tctcagctcaccgcaacctctgcctcccaggttcaagtgattctcctgcctcagcctcccgagtacctgggattacaggcatgcaccaccatgcctggctaattttgtattttttagtagagacggggtttctccatgttggtcaggctggtctcgaactcccgacctcaggtgatctgcctgcctcggcctcccaaagtgctgggattacaggcgtgagccactgcgcccagcgcagctttggttttatttgttttgtttatagtggagggttagacatgaaatcaacatagaagatgaygtaaacttatgactaagcctggtgtgggctctcggtgttctggggcatgagctagaggatggctggagccaggtagagaccgctcccttccttagaatgtcaccttgctgacaaggacagcgctgtgagcatccacaccttcctgtgaggtatctggcattgagcctggtcaggaaacaggaagacaagcaggttccattgagcctgggacctggaccttgtaaagccagccacccagcccagttttacaggccaggcaacaaagggagcaaccggctggacccaggcctgcctcccccg

SEQ ID NO: 181613 - DNA, 601 bp, Human
tcaagtcctgattcaatgatcacaaagctcaaattctgggaagaaaacagcttcaagtcacccaccctttttgtcctcatccataatatcaagatcaatgcttgaattccataggcctcacaattctgtgttccactcacagcttgacaagtgaactctttgtcaatgacaaggcaaaggttaatgattaacaggcactgtatttaccaacttaggaactaaataaacagaatccagacaggataccattaagagttgcagcatcaccaaaaatatctggctgattgactgaatgtcgtcrcttttctttttctttttttgagagacagagtcttgctctgttgtccaggctggagtgcaatagcacaatcttggctcaatgcaaccttcgcctcctgggttcaagtgattctcctgaaacatgatttacatagtcagatttatacttttcaaagtgtgttgacatttctaaaaatgtatgtggtcactggatcttcaagacagtttcattttccccattgtcaacgaggaagccacagagaggttaggtaacctcaagttcactcagcaaattagaaaaataaataaagctgggactggc

SEQ ID NO: 181614 - DNA, 601 bp, Human
gtcttgctctgttgtccaggctggagtgcaatagcacaatcttggctcaatgcaaccttcgcctcctgggttcaagtgattctcctgaaacatgatttacatagtcagatttatacttttcaaagtgtgttgacatttctaaaaatgtatgtggtcactggatcttcaagacagtttcattttccccattgtcaacgaggaagccacagagaggttaggtaacctcaagttcactcagcaaattagaaaaataaataaagctgggactggcacccagggtcctggccgggctgctgtcackgcctgctacctgcccttctggaacgagtcacttccctgcacacctggctgaagaggaccaggcactccatgaggattccttgataacgcaggttagaaagctaaagctgcaagcaacagaaactgatcgtggctgctttcaacagaaaaggagtttttccctaaaggattttgggaagcttccccagatccccaggaaggcttgggaacagggctcagaggttgtgcagcagcaacaattccccaaatcccgtgcagagctgatgctgtgcggatgcctgtgctgccgtctctgagcccc

SEQ ID NO: 181615 - DNA, 601 bp, Human
ctttcaacagaaaaggagtttttccctaaaggattttgggaagcttccccagatccccaggaaggcttgggaacagggctcagaggttgtgcagcagcaacaattccccaaatcccgtgcagagctgatgctgtgcggatgcctgtgctgccgtctctgagccccagatgcggcaccagctcccctgtactcctcactctggacctaggtcccccggaggctccacaaccacttatgcagatatcaggctgcttctccatgtcactggctacaggttcaaaatctagacagagccaggccrcgcacccaaggtctagctgcaaggcaggccccacgaagggaggctgtgagtatcctgaagctgcctcacaaagcaccacagactgggaggcttaagcatcaaaaactgactctttcacagctctgcaggccagaagtcagaaatcaaggcatgagcatgactggctatttctggaggctctgaggggccctggttccatgcctgtctcctagaaccttgtggttcccagcaatccttaccgttcctgagcttggaaggctacattgctataatctctgcctgtgtctacacgtgatgaca

SEQ ID NO: 181616 - DNA, 601 bp, Human
ccaccccaggaggcagccatgtccagacaggctgtcctcctcctgaactccacctggctttgggctcatcctccccgggcacttctggctgatggctccccactctccagcggatgtgctttagcgggaggtggccaggatgctgcacctgtgctgagccccagagattctgagttccagagacactacaagggcagcagagccttaacccaaagatgcaagagcccagacattttaggaagcttggagggcagaaacggaaagtccttttgaggagagggcctgcagctgaacctctcaygcaggccactgggtaggtgcgcgcccagcttctcagaaggtcagtcccaaccctgcacggctgccagaagctagccagatggggaaggcggccaggagcctggtccgacaccccgatgcacagggcctgggccagaggcagatgctcccatctacatatgcacacacacatataaacacaaacagagaaaggtgcacatgcactcacatatacacatgtgaaatcacacaggcatgtcaggatgtcacatatacatgcacacgtgtaagcacccaggcacgtgcagatacattcatatat

SEQ ID NO: 181617 - DNA, 601 bp, Human
atcacacaggcatgtcaggatgtcacatatacatgcacacgtgtaagcacccaggcacgtgcagatacattcatatatatgatcacatacccacacatgcgcacacacagctgcttctgctatacatgagctgctgtgagctgttttgttttgtcttgtcttgtttttgttgttgtttgagacggagttttgctctttggcccaggctagagagaagtggcgtgatcttggctcactgcaacctctgccccccgaagacaggacacttctgtctcagcctcccaagtagctgggattatagctgcccgccaccatgtccggctaatttttgtatttttagtagagatggggttccgccatgttggccaggctggtctcgaactcctgacctcaggtgatcgacccgcctcggcctcccaaagtgctgagattacaggcgtgagccattgtgcccggccaagctgttttctgcctcttgagttaaaggattcatccactagaactggccaccttaaggccatattatattgtggtggacttgtcttaaatggaatttcctgcttcttcttaaatgtataattcctctgaattgaatataaat

SEQ ID NO: 181618 - DNA, 601 bp, Human
cacacaggcatgtcaggatgtcacatatacatgcacacgtgtaagcacccaggcacgtgcagatacattcatatatatgatcacatacccacacatgcgcacacacagctgcttctgctatacatgagctgctgtgagctgttttgttttgtcttgtcttgtttttgttgttgtttgagacggagttttgctctttggcccaggctagagagaagtggcgtgatcttggctcactgcaacctctgccccccgaagacaggacacttctgtctcagcctcccaagtagctgggattatagctgcccgccaccatgtccggctaatttttgtatttttagtagagatggggttccgccatgttggccaggctggtctcgaactcctgacctcaggtgatcgacccgcctcggcctcccaaagtgctgagattacaggcgtgagccattgtgcccggccaagctgttttctgcctcttgagttaaaggattcatccactagaactggccaccttaaggccatattatattgtggtggacttgtcttaaatggaatttcctgcttcttcttaaatgtataattcctctgaattgaatataaattt

SEQ ID NO: 181619 - DNA, 601 bp, Human
acggattattttgtaaacagaacacccaggctcctcccctcatgtcctggctggaggtgaaacattaaaaagagattttaaagcagggccctttactcccttccttcctggtttgtggccagggcacagggcagctctgctccatccaccctttgtccctgtgctctgggcttggaccaaaacctaaacacagcgtgggccgtggcaggagctgaccggctggggcaaagtttaacacaggccatacaaacagcccagagcctggatgctagaaccaagccttgcttttctctgtcactcmggaagtgtgctctacgcgggctctttagtgaggctcctggaggaagtgttgaaacacaactctattcatacatgtctttaaacagctttcactagctctgtagccaaaggactgggcctgccaggttcccggcctcttgctggagcacagtgaggctggggaaggagcacagcacagagcctcctgagcctcggctcagctctccccgacccccagctcggctctccccaccctccggctcggctctctctgacccccagctcagctcttccccacctgccaggacgatttccccaaagc

SEQ ID NO: 181620 - DNA, 601 bp, Human
gcctcccaaagtgctgggattataggcatgagccactgcgcccggcctacagtccttttaagaggacagcccggggtttccagataatactagccccacacacaggcatgtcctagggtccacacctggtcagcgggaataacaggcagccgtgggctgggctcccagccccctagcagggtccagtgggccagggagcctctgctttggtttgtggtgcgtggtctgtgcccgcctgtgttcagcgtttgaaggcagaggagcgggccatgatgggcagagccgacgtccaggctccacrgtagggccgtcctgctgctgtctgcagacctctcaggcttgaggccccccgccccacaggactggcccgctcctccctctggattgaggtggagcagggctggcagtgggtcgaagaggggagctgtggaatcttccccaaagcagccgggtgtcctggaaaggccagggagtgaggaggcaggacccccggggacacaggcacacacatccaccacatgctcacctctgcctcctcctgcagacctccccgccagccccgtcatttcatggcatcttgctttctcttcattgaggaatg

SEQ ID NO: 181621 - DNA, 601 bp, Human
cgcctgtgttcagcgtttgaaggcagaggagcgggccatgatgggcagagccgacgtccaggctccacggtagggccgtcctgctgctgtctgcagacctctcaggcttgaggccccccgccccacaggactggcccgctcctccctctggattgaggtggagcagggctggcagtgggtcgaagaggggagctgtggaatcttccccaaagcagccgggtgtcctggaaaggccagggagtgaggaggcaggacccccggggacacaggcacacacatccaccacatgctcacctctgcytcctcctgcagacctccccgccagccccgtcatttcatggcatcttgctttctcttcattgaggaatgcacttttgcaatgttgttactcactatccatctacttggccaacagcctcttcataaacttaattgccacaaattctgcatctctgggatgcaaactagtgaagctgtgctgtgtcacccaggaggcttaattttaacatcacctcaataggtagccagggaagcggatctcggtggactctgcactgtcaatacaaacgctatgcacccatcaaaaaccatgagctggctt

SEQ ID NO: 181622 - DNA, 601 bp, Human
atagatatgtaaatagaaagataggtagaggctgggtgcagtggctcatgcctaaagtggttccccagcactttgggaggtgaaggcaggaggattgctttagcccaggagttcaagaccatcctgggcaacatggcaaaaccccatctctacaaaaaatacaaaaattagccaggtgtggcggtgcacccctttagaccctgttattcaggaggctgaagtggcaggatcacttgaacctaggaggtaaaggttgcagtgagctgtgattgttccactgcactccagcctgggtgacagrgcaagcccctgtctcaaaaaaaaaaaaagaaaagaaaagaaagataggtagatacatagaatgggtggatagagagatagaacggatagaaaaataggatggataaatagaacataggtagatacataaatatgatgaatgcatagatggatgggtggatggatggatggatggatggatggatgaatggatagatgaatggatggatagatagtatataaatggatggatggatagatacacagtaggtaggtaggtagtagatagatagatagatagatagatagatagatagataga

SEQ ID NO: 181623 - DNA, 601 bp, Human
aaagataggtagaggctgggtgcagtggctcatgcctaaagtggttccccagcactttgggaggtgaaggcaggaggattgctttagcccaggagttcaagaccatcctgggcaacatggcaaaaccccatctctacaaaaaatacaaaaattagccaggtgtggcggtgcacccctttagaccctgttattcaggaggctgaagtggcaggatcacttgaacctaggaggtaaaggttgcagtgagctgtgattgttccactgcactccagcctgggtgacagggcaagcccctgtctcaaaaaaaaaaaaagaaaagaaaagaaagataggtagatacatagaatgggtggatagagagatagaacggatagaaaaataggatggataaatagaacataggtagatacataaatatgatgaatgcatagatggatgggtggatggatggatggatggatggatggatgaatggatagatgaatggatggatagatagtatataaatggatggatggatagatacacagtaggtaggtaggtagtagatagatagatagatagatagatagatagatagatagatagataaacaggatag

SEQ ID NO: 181624 - DNA, 601 bp, Human
cacccctttagaccctgttattcaggaggctgaagtggcaggatcacttgaacctaggaggtaaaggttgcagtgagctgtgattgttccactgcactccagcctgggtgacagggcaagcccctgtctcaaaaaaaaaaaaagaaaagaaaagaaagataggtagatacatagaatgggtggatagagagatagaacggatagaaaaataggatggataaatagaacataggtagatacataaatatgatgaatgcatagatggatgggtggatggatggatggatggatggatggatgratggatagatgaatggatggatagatagtatataaatggatggatggatagatacacagtaggtaggtaggtagtagatagatagatagatagatagatagatagatagatagatagataaacaggatagatagatagatagatagatagatagatagatagatagataaacaggatgaatatttagaaggctgggagtgggcagaaagcctggaaggacacacattaatacaaataatattaactgagttgttttctgggcccataggatcctagacaagtttttaaatattattcttt

SEQ ID NO: 181625 - DNA, 601 bp, Human
ctcaaaaaaaaaaaaagaaaagaaaagaaagataggtagatacatagaatgggtggatagagagatagaacggatagaaaaataggatggataaatagaacataggtagatacataaatatgatgaatgcatagatggatgggtggatggatggatggatggatggatggatgaatggatagatgaatggatggatagatagtatataaatggatggatggatagatacacagtaggtaggtaggtagtagatagatagatagatagatagatagatagatagatagatagataaacagggtagatagatagatagatagatagatagatagatagatagataaacaggatgaatatttagaaggctgggagtgggcagaaagcctggaaggacacacattaatacaaataatattaactgagttgttttctgggcccataggatcctagacaagtttttaaatattattctttgaagtgctatttcctacacttcctacaatgataataggatattttatattcagaaaaatgacatttaagacatagtcaatggtccatggaccttggacagagggcccagctgccctgtttgcagtct

SEQ ID NO: 181626 - DNA, 601 bp, Human
gaaggctgggagtgggcagaaagcctggaaggacacacattaatacaaataatattaactgagttgttttctgggcccataggatcctagacaagtttttaaatattattctttgaagtgctatttcctacacttcctacaatgataataggatattttatattcagaaaaatgacatttaagacatagtcaatggtccatggaccttggacagagggcccagctgccctgtttgcagtctacaccgcatgcccaacccttccccagatctactcactttcagaatgtgctgccttccacrtgtgaaccagactgagctcctttctgccactgatgttgaattgtccatttgctcacgtcagtgtccacgtggcaaatccacagggcatgggtgggatcctgcagtctagacaaagccaaggagcaccgctggaggccacgttgggcttcccaatccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggaca

SEQ ID NO: 181627 - DNA, 601 bp, Human
tgggagtgggcagaaagcctggaaggacacacattaatacaaataatattaactgagttgttttctgggcccataggatcctagacaagtttttaaatattattctttgaagtgctatttcctacacttcctacaatgataataggatattttatattcagaaaaatgacatttaagacatagtcaatggtccatggaccttggacagagggcccagctgccctgtttgcagtctacaccgcatgcccaacccttccccagatctactcactttcagaatgtgctgccttccacgtgtgarccagactgagctcctttctgccactgatgttgaattgtccatttgctcacgtcagtgtccacgtggcaaatccacagggcatgggtgggatcctgcagtctagacaaagccaaggagcaccgctggaggccacgttgggcttcccaatccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggacaaagacg

SEQ ID NO: 181628 - DNA, 601 bp, Human
actgagttgttttctgggcccataggatcctagacaagtttttaaatattattctttgaagtgctatttcctacacttcctacaatgataataggatattttatattcagaaaaatgacatttaagacatagtcaatggtccatggaccttggacagagggcccagctgccctgtttgcagtctacaccgcatgcccaacccttccccagatctactcactttcagaatgtgctgccttccacgtgtgaaccagactgagctcctttctgccactgatgttgaattgtccatttgctcacrtcagtgtccacgtggcaaatccacagggcatgggtgggatcctgcagtctagacaaagccaaggagcaccgctggaggccacgttgggcttcccaatccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggacaaagacgtcccgacctcagacctcaggtaccctgtgtttccccagcggcagctcatct

SEQ ID NO: 181629 - DNA, 601 bp, Human
tagacaagtttttaaatattattctttgaagtgctatttcctacacttcctacaatgataataggatattttatattcagaaaaatgacatttaagacatagtcaatggtccatggaccttggacagagggcccagctgccctgtttgcagtctacaccgcatgcccaacccttccccagatctactcactttcagaatgtgctgccttccacgtgtgaaccagactgagctcctttctgccactgatgttgaattgtccatttgctcacgtcagtgtccacgtggcaaatccacagggcrtgggtgggatcctgcagtctagacaaagccaaggagcaccgctggaggccacgttgggcttcccaatccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggacaaagacgtcccgacctcagacctcaggtaccctgtgtttccccagcggcagctcatctggactcggccatcacgacagcgaccacact

SEQ ID NO: 181630 - DNA, 601 bp, Human
acatagtcaatggtccatggaccttggacagagggcccagctgccctgtttgcagtctacaccgcatgcccaacccttccccagatctactcactttcagaatgtgctgccttccacgtgtgaaccagactgagctcctttctgccactgatgttgaattgtccatttgctcacgtcagtgtccacgtggcaaatccacagggcatgggtgggatcctgcagtctagacaaagccaaggagcaccgctggaggccacgttgggcttcccaatccacatgcaaacccaaaatgtgttcttgkgtaccttttctgagaagacagcctgtggcatgcatcagcttccttgaggggcccatgatgctggagaaaacggagacccggctccaaaggagaatgtggactcttagtggttggacaaagacgtcccgacctcagacctcaggtaccctgtgtttccccagcggcagctcatctggactcggccatcacgacagcgaccacactggctccagccacatgcacttccggaccccatgtcctctagctgttgggtagaagaggggtggagaaggtttctgtagcacagaaacacatcagcag

SEQ ID NO: 181631 - DNA, 601 bp, Human
ccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggacaaagacgtcccgacctcagacctcaggtaccctgtgtttccccagcggcagctcatctggactcggccatcacgacagcgaccacactggctccagccacatgcacttccggaccccatgtcctctagctgttgggtagaagaggggtggagaagrtttctgtagcacagaaacacatcagcaggaccagatccaaatattgcactctccagattcttcgtccttctggcagaaagaagcagtgtcccgggaacatgcccctacttgacccctgaccctggaaacgcctcgaaacccacccgggaggctgattccagccagtctgccctgggccactgtactgggagagtttctttccggagctgcagtacttcctttggggtgggaaggagttgttacaaactagccaaaggctctgagttgcttggtttttcctttagaaaacatttgcttttt

SEQ ID NO: 181632 - DNA, 601 bp, Human
gacctcagacctcaggtaccctgtgtttccccagcggcagctcatctggactcggccatcacgacagcgaccacactggctccagccacatgcacttccggaccccatgtcctctagctgttgggtagaagaggggtggagaaggtttctgtagcacagaaacacatcagcaggaccagatccaaatattgcactctccagattcttcgtccttctggcagaaagaagcagtgtcccgggaacatgcccctacttgacccctgaccctggaaacgcctcgaaacccacccgggaggctgattccagccagtctgccctgggccactgtactgggagagtttctttccggagctgcagtacttcctttggggtgggaaggagttgttacaaactagccaaaggctctgagttgcttggtttttcctttagaaaacatttgctttttatttttagcagttattcagagccaaacttcatgaaaaggggaatagagtggtatcgtgggagtatccttttgcataaaaactaaggtgtgattacaaagtaacaaagctaatcttttttatttcaattggtttatgaaccaactctaattgaaaag

SEQ ID NO: 181633 - DNA, 601 bp, Human
tttgggaaagggctgttacagtctttgtctaaactataaactacaaatgaagtttctcccaaagttagttcagccaaggaatgaacacagacagcttggaggttcgaagcaagatggagcccgctaagttagatctctttcactgtctcagtcataatttggccaaggcagtttcaactccaggaatgtgatcaagtccaagttctgctgatcctcaactttgcctatttatttctcttctgttttaagtcaacactttctcctggtgaaactgctctggaaggacgttccaatgaaaagmttttcccataatgagatcgtaatccttgctgaaaacgctttgccgttcactgcattttaatgctctggcaccacatgtgcccccttttctttttgggataaaagacgcctttgtcccatgtcctcagctggtgcttaggggtatggagcaaaaagtgggtgccagagttgagattcagggagtggagagtggggaggagcttctgccttctgaaaactgcccggatggatgcggtagtgcagcggtggccacggcacatgcctgcgaggatagagtcagttgtggctgagctaagcgcgg

SEQ ID NO: 181634 - DNA, 601 bp, Human
gcgacctgcttgtcagtggtgtgactttcttctaacaaaagagcacgcatgggccgggtgtggtggctcacgcctgtaatcccagcactttgggaggccgaggtgggaggatcacctgaggacaggagttcaataccggcttggccaacatggtgaaaccccgtctctactaaaaatacaaacggtagccaggcatggtggcacatgcctgtaaccccagctacttgggaagctgaggcgggagaatcgcttgaacccaggaggtggaggttgcagtgagccgagatcgcgccactgcacyccagcctgggctcgacagagcaagactctgtctcaagaaaaaaagagcacatattggagataggggctgggaagacgatttcacagaagaagagtcctcctcctgcagatccaagccttaggagcaatgtgtccagcttggaataagttgatatccacttttaaagacagaacaagaagaggaaaagcattaggggaggagcctcctgttgcccccagggacccggttccttgtgtgatgttcccactgggttgcattccagcgagggcttcagcactggggacacagaagtcattctcc

SEQ ID NO: 181635 - DNA, 601 bp, Human
aaagagcacgcatgggccgggtgtggtggctcacgcctgtaatcccagcactttgggaggccgaggtgggaggatcacctgaggacaggagttcaataccggcttggccaacatggtgaaaccccgtctctactaaaaatacaaacggtagccaggcatggtggcacatgcctgtaaccccagctacttgggaagctgaggcgggagaatcgcttgaacccaggaggtggaggttgcagtgagccgagatcgcgccactgcactccagcctgggctcgacagagcaagactctgtctcaaraaaaaaagagcacatattggagataggggctgggaagacgatttcacagaagaagagtcctcctcctgcagatccaagccttaggagcaatgtgtccagcttggaataagttgatatccacttttaaagacagaacaagaagaggaaaagcattaggggaggagcctcctgttgcccccagggacccggttccttgtgtgatgttcccactgggttgcattccagcgagggcttcagcactggggacacagaagtcattctcctgggaacaggcatccttcacaggcgcttcggggggcc

SEQ ID NO: 181636 - DNA, 601 bp, Human
ggacaggagttcaataccggcttggccaacatggtgaaaccccgtctctactaaaaatacaaacggtagccaggcatggtggcacatgcctgtaaccccagctacttgggaagctgaggcgggagaatcgcttgaacccaggaggtggaggttgcagtgagccgagatcgcgccactgcactccagcctgggctcgacagagcaagactctgtctcaagaaaaaaagagcacatattggagataggggctgggaagacgatttcacagaagaagagtcctcctcctgcagatccaagcctyaggagcaatgtgtccagcttggaataagttgatatccacttttaaagacagaacaagaagaggaaaagcattaggggaggagcctcctgttgcccccagggacccggttccttgtgtgatgttcccactgggttgcattccagcgagggcttcagcactggggacacagaagtcattctcctgggaacaggcatccttcacaggcgcttcggggggcccagtgagctgtgactcgtggggaaaatgccccagtctccacgatgccacctccaaagtcagttttgtgtacagcaggactct

SEQ ID NO: 181637 - DNA, 601 bp, Human
gacccggttccttgtgtgatgttcccactgggttgcattccagcgagggcttcagcactggggacacagaagtcattctcctgggaacaggcatccttcacaggcgcttcggggggcccagtgagctgtgactcgtggggaaaatgccccagtctccacgatgccacctccaaagtcagttttgtgtacagcaggactctttactggagccagggtcaggacacgtgtggatgaaccacgaccaaactggggatggaaatgccggtagtagcaaagagacggcggtgatgatgagcagagygcatgcattgaggcacttactgtgtgcgggcgctgtgcttagtgaggggcacacaggacctgctcacacctccgggctttgcctccatgcccgctggtgccagcccagacaccacaggcatatgatgtggctcatggttccccagagtgccactgcccggcctcagtgggatttaatggggactaatggactgagaaacagccctgtgcaattgcactgagttgtctcagagccacctggcatgctgacgatcattccctgattttgaaattgagggcaatctgcttattgaggaagcgt

SEQ ID NO: 181638 - DNA, 601 bp, Human
ctggggtcccaaggctgggacctggcaaggctgggacccggcttggcagcctcagacacacagcaccttcacctgtggcaccgcccttggccgtgggctctacgtggcttggttcagccctctggctgtcccttgcgccccaggtgccatggctgctttggcaggagggtggtgttccagggtggtgctgcctggcagggttcccctctgcccagagccaggcggagatgggttgcctcaagctggggctgcgggtgtagcagggccagcctttccagccccaccagcagcacgaggggawgaggacaaaaactgagttctagtcttcagcctgaaaccagactccctgaacagcggcctctgggccccatatgggttggggaactccaccgccccaaggggtgtgtctggagccaggccatgcctcccgaagctgcccccagctcctcacccacaactgtgtgtccctgagcactttctggaggtgtttgtaggatgcagcctcttatcccttaaacgactgcatttaccgcccacctacagcagcaggagtgagtggtgagacagcctccggcctcacaggtcttgcctctgccgtgcc

SEQ ID NO: 181639 - DNA, 601 bp, Human
atcacacgccgctcctggcgtggtttctggtgtgcactagtcctgcaggtcaggttgaggttgcaggggggaagattatttttatcgaagttgtagtcatttcctggggctgcgtaacgaattctcataaactgggcagcttaaaacaatagaaatgtattcccacatagttctggaggccacaagtccaaaatcaaggtgccagcaggccctgccacctctgaaggccccaggggagggaccttcccggtctctcttggcctctggtggctgccggcggcattctctgcctgcttcttcmcctggtgctcccatccgttctgtccaaattccccctttttgtaaggacacccatcctattggagtaggggtcaccctcctccaggatgacatccccttaactacatctgcaacagtcatgtccccaaatgaggtcaccctcagaggcagcagggttaggacttcaacatacaacttttggggggagatgtacttcagcccataacacaccacgtgggaggataacaccgatttcagagcttgcagaggaagccgccaggaactccagtgagacatcagcccccaggtgcctgtcaggcac

SEQ ID NO: 181640 - DNA, 601 bp, Human
tctgcaggagcctggggtggcaactgagggctcagcgttcatcccaaacaaatggccttgcccactggcctaagccccagagaagggggatggggaccccaggaaatgaaagcaaagataagctccaaataggatgaaaagaaagagctccatgccagctgctctgtttgctgaagacgctggttcccgtggcagcggagcgcagagagaggggctgcctggccaggcagggtcagcgggccccagcagaccctcctctgctcccagctctggtatctgcaaggaaacagcgggattcgamcagtcaaactgtcttgctcggtgaagatttccataaccctcctggggaatgcaggagacttacagagacagcacatgtgcgaatgtttacacaaaacaggttaaaagcagcgaagaaatcatcatcatgccatctattttttttaactacgcagaaaacgttcgttacttctcagaaatgtgtaaatggaatttctcgtttaatggatgacaatggaaatcatttgattggtgcattttgttggttggttttgttaatactttgctgaatctgttagcgttcccccttacacatcaaact

SEQ ID NO: 181641 - DNA, 601 bp, Human
gagacagcacatgtgcgaatgtttacacaaaacaggttaaaagcagcgaagaaatcatcatcatgccatctattttttttaactacgcagaaaacgttcgttacttctcagaaatgtgtaaatggaatttctcgtttaatggatgacaatggaaatcatttgattggtgcattttgttggttggttttgttaatactttgctgaatctgttagcgttcccccttacacatcaaactgtggtagcaactctgatgggttttgcaagcatgaaacagagggaagggctaccaaatggatctcygtggagcggtggttatcacggggaagagacggcagcatgccgagaaaataacaccgaagcctctttttccagaaaggaaatagattgattattctagttttgaaaatagcacaggctcattggaaaacctccaaactacactgatgggagctgaagggtgcacaccgatcatgacaacagccggcaatgtccccccagtttaaacctggacacgaggccttctagatgtttttctgtgcatagataccttgttttgaaaaacaactaaaacatgcgttgtgtagtctttttttttactag

SEQ ID NO: 181642 - DNA, 601 bp, Human
gtattaacttgctctcccagaagaaggggctttatttacaaatcgcaggagcttctgctgcatttagctccctgagtgcccccatagcctggtgaatgtcacacaagccaggcgtgacccccacccaccatcgtccaagtacacagggagcctgttcacttccaagcaagttcacacccatagggtgtgaacccagatcggcccagccccctggtgcactctgctgcaggggcccaagagcagccagacctcctggggcagctgctcctcattcagcctctggggaccaccctgaagccakcacactgcccaaccggaaggtggctttcctctgaaacatgcctggctcactttgccctgctcctatgtgggatacctcgataccaagtgctaaacaaaaacagagtcagacagaaaactcatctgctaacattacatgtaacagggaaagttggaaacattctaaaagtccatcactggggactggattgctaacgtgtgctatggccacaccctggagaaacttggaaaatgaagctaagctctgtggagcaacttgggatgagttcatgatatgttagatgacaaagcaggttgcagc

SEQ ID NO: 181643 - DNA, 601 bp, Human
aacatagcaagaccctatctctacaaaaaataaaaattaaaatattgttaaaaggtaaaagcggccacccatgtgtgtccacacttcaaaacattctggaaagatacaccaaactattagaagtgatttccagagtatgggatttagggaaataaatgggtaaagtgaggacttcggttttcatattttggtgtttttttttttactttactcttgtgttgtttagattttttagaatgtttttcttttgaaaacagcttctaaaagagaagatagccctcaacatctgacttttttttcttttttttttgagatggagtttcgctcttgttgcccagactggccaggctggcgtgcagtggcacaatctctgctcactgcaacctccgcctcctgggttcaagcgattctcctgccttagcctcccgagtagctgggactacaggcacacgccaccacgcccagctaatttttgtattattattatttttttaatagagatgaggtttcaccatgttggccaggatggtctcgatctcctgacctcatgatcatcccgcctcgacttcccaaagtgctgggattgcaggcatgagccacc

SEQ ID NO: 181644 - DNA, 601 bp, Human
cacgccaccacgcccagctaatttttgtattattattatttttttaatagagatgaggtttcaccatgttggccaggatggtctcgatctcctgacctcatgatcatcccgcctcgacttcccaaagtgctgggattgcaggcatgagccaccacgcccagccccaacatctgactttctgtgtgttttccaagagtctagtgtgaggtcagaggtcagacaggtcatcagggattttgcttcgagtgagttgctgctgccctgactcctctcccacagcaaataagaccacacggggctygggggttgggtttgtcgcttgcttttgctgtgctgagggcttcaccagactgaaacagcaggaccacagctcatctctgctccttctctctaggaccaactgcccctgtaagtacagttttttggataaccacaagaagttgactcctcgacgcgatgttcccacttaccccaaggtaagatgagattccggcccagaagaagctgcagctgtgtccccagccccacgcccagccctgtggccctgcggccagaccctgctgtgtgtacgttcacatcaaccgcccctcccagccctggg

SEQ ID NO: 181645 - DNA, 601 bp, Human
ccggccccgggagctgacctgggtagacagtttttacactcaaacgttactggaaagaactttaacgtttaactgaatttttaaaaatccattccattggcccttgtctctgagcaattcttagttgtcctggcaagttttgctcttttgcacaaaagtgttcttagttctaagagaagctgtgacgttggtgaagtagcaatggcatttttgaaataacgacaaaaggagggtctcgagttgccggtcacccgctcaacgccttcagctgggaagcaggcaaaatcccggcccacctgcttttttttttttttttttttgagacagtgtttcactcttgttgcccaggctggagtgcaatggcacaatcttggctcactgcaacctctgcctcctgggttcaagcaattctcctacctcagcctcccaagtagggggcattacaggtgcccgtcaccatgcccagttaatttttttgtatttttttagtagagacagggtttcaccatgttggccaggctggtcttgaacttgtgacctcaggtgatccgcctgcctcggcctcccaaagtgctgagccaccgcacccggcccggcccac

SEQ ID NO: 181646 - DNA, 601 bp, Human
aaaaaaaaaaaaaagaaagaaagaaaaagaaagagaacgggagaaagaggagaaatatctcagcatgcacatcactgtcacaggcccacggcgcctggttaacacggaactcctgtcctttctagtacctgctctctccagagaccatcgaggccctgcggaagccgacctttgacgtctggctttgggagcccaatgaggtaagtgcggggcttgcaggcaccacgtcccagggggaggcagctcaggatcttggacgccagtgggaccacccccatcgctcttcctccttcttgctttytcctcttctttttaaagactgaaaaaaaaaaacaaaacttgttttgccaggttttagttgaaactaactaacactttatagcagggcccaggagacttcacagcaaggggattctgtgagtgggggagacggctgtcaggggcagggaggctccacccagggctcctgatggcgctgggccccccgagccatctgctcatcctgcagaccctcatgcacgccggtggcagccccgtgctgcagaacacccctgccaggagcaaatctctcctcaaggaaggggctgcggtcagagtgctc

SEQ ID NO: 181647 - DNA, 601 bp, Human
tttgacgtctggctttgggagcccaatgaggtaagtgcggggcttgcaggcaccacgtcccagggggaggcagctcaggatcttggacgccagtgggaccacccccatcgctcttcctccttcttgctttttcctcttctttttaaagactgaaaaaaaaaaacaaaacttgttttgccaggttttagttgaaactaactaacactttatagcagggcccaggagacttcacagcaaggggattctgtgagtgggggagacggctgtcaggggcagggaggctccacccagggctcctgayggcgctgggccccccgagccatctgctcatcctgcagaccctcatgcacgccggtggcagccccgtgctgcagaacacccctgccaggagcaaatctctcctcaaggaaggggctgcggtcagagtgctctgctctgagagcagtgtctgcaaaggcaaggcacaggcaaccggctgccccagataagtggacatgtgggattccgggaactgtgtcaccttctgcagcaaggcttgaggccaggaattccacactagcctgagtgatatgatttggctgtgtccccacccaaatctcac

SEQ ID NO: 181648 - DNA, 601 bp, Human
gactgaaaaaaaaaaacaaaacttgttttgccaggttttagttgaaactaactaacactttatagcagggcccaggagacttcacagcaaggggattctgtgagtgggggagacggctgtcaggggcagggaggctccacccagggctcctgatggcgctgggccccccgagccatctgctcatcctgcagaccctcatgcacgccggtggcagccccgtgctgcagaacacccctgccaggagcaaatctctcctcaaggaaggggctgcggtcagagtgctctgctctgagagcagtgyctgcaaaggcaaggcacaggcaaccggctgccccagataagtggacatgtgggattccgggaactgtgtcaccttctgcagcaaggcttgaggccaggaattccacactagcctgagtgatatgatttggctgtgtccccacccaaatctcaccctgaattgtcataatccccacgtgtcaagggcagggccaggtggagatcttgaatcatgggggcagttttccccatactgttctcgtgatagtgagtaagtctcacgagatctgatggttttataaatgggggattgtcttttgcc

SEQ ID NO: 181649 - DNA, 601 bp, Human
ctgacacctggggcactgccctctcctaagtgaacctcttttcatgtgcatggtctcccagcaggagaaaaactgcagcaccagccagaaaagcaaagctccagcctccactccccagctcagttcacccaagagcagcaggcggccagtcccaggggctgcactgctgcaaacctgctcaaaacctccagccgccacgtggcaacttgctccccagctctgagagtgcaggaccggggcgcagagacgacagaagaggctttaaatatgcagaatgactgtctaggtcaacgcacaaaargaaagggccccaggtgtgggagatgcaaggggtgagagggaaagctcagaagagacgtgttggagctgctggcctgcagcagctcccagggtccctgcacagctgctgagattgggcagagcaagtacacagcaagtagacaccgcagacagttagagcacactgactcctgctcccagcctgtgggcaaccgccgcacctcagcatcatgtagaaaaatcaccatccccaaagtcattttgacctcagcctgctgggaggaagagccaagccaggggccactgatggcaaagcacctgc

SEQ ID NO: 181650 - DNA, 601 bp, Human
agcctgtgggcaaccgccgcacctcagcatcatgtagaaaaatcaccatccccaaagtcattttgacctcagcctgctgggaggaagagccaagccaggggccactgatggcaaagcacctgcgtggaaactggcactcgctgtcttttctgccaccttctaccagggaaccctttgagcacgggccactgtgactggggaggtggggcttgccccacgaagctgggggatctgtgtctccataatagaaaggccacctctctgtcctctgatcacagagtggattcacagctgctctcgsggctggcaggtgggcaaggcagacagctcccggcagctggactcagcctctgggtggcatctcccacggcccgtggctcctgcccagcagatctcaagggcactccaggagaccgatgagggttccagtgcttccaagaagtatctagctgcctgtgtgtgagaatgcagagatgcccaagacaggagccttggcctctggcagatctagggatgccaggaattttggagtgtgagtggcaaagagggacaactaaagggacacacatgaaaacagcccactcggccccacaaaactgca

SEQ ID NO: 181651 - DNA, 601 bp, Human
agatctcaagggcactccaggagaccgatgagggttccagtgcttccaagaagtatctagctgcctgtgtgtgagaatgcagagatgcccaagacaggagccttggcctctggcagatctagggatgccaggaattttggagtgtgagtggcaaagagggacaactaaagggacacacatgaaaacagcccactcggccccacaaaactgcatctggccacgcatgaggcacctggcactcagagaacgtcagggcgcctaaaagtgatcacctccctcccttccagcaggggcgcccccrcttttctccgagtggtttggcccagtgtcctgcccatcacaaaccagacagaggacatgacttcaggctgctgtgtcctcccatgtgttagggcctccgagggcccagggctgtggcccgtgagcgtggcctgcctctatcctccgagggcccagggctgtggcccgtgagcgtggcctgcctctatcctccgagggcccagggctgtggcccgtgagcatggcccgcctctatcaagtgcagagctggaaggctgcaggagcctcccccgtcatctcatgagtcccccactcacgacca

SEQ ID NO: 181652 - DNA, 601 bp, Human
ctgcagttaagatgttaaagtgtcttcggtcccagggggccgcagatgaacacagttcagcgtttctggatgtaaatcgtcaaagctccttcgatccccagcctcgggcaaggaaagggcctttctctctgtgatgccacctgtgctcaggtgtgcactggatggaactgtgtcctagacccctcagctgtgatattgatccgctgagattgtttttcatctgtagaaatcaataaattcctttttggtgcagtgttttgtgaacgggtgcactctctcacccggtcgctgtcctaagaaytctccttgacttcggaactggccctccacgccccaggatccacctgccaggagacccccagtgtgctctcaaacccccacccatctgagtggcctggaaaggctggtctgaagacctctcttcccatgtctgccgaccaggctttgctctccagggactttctgggagggggagaacccacctcctgccaacggccctgctggcactccgaggacagcagagggaaggaagccaggggctggggagccggccacacaactgcccagtgcctatccttctcctgtgcccacagatgctgag

SEQ ID NO: 181653 - DNA, 601 bp, Human
agacccctcagctgtgatattgatccgctgagattgtttttcatctgtagaaatcaataaattcctttttggtgcagtgttttgtgaacgggtgcactctctcacccggtcgctgtcctaagaattctccttgacttcggaactggccctccacgccccaggatccacctgccaggagacccccagtgtgctctcaaacccccacccatctgagtggcctggaaaggctggtctgaagacctctcttcccatgtctgccgaccaggctttgctctccagggactttctgggagggggagarcccacctcctgccaacggccctgctggcactccgaggacagcagagggaaggaagccaggggctggggagccggccacacaactgcccagtgcctatccttctcctgtgcccacagatgctgagctgcctggagcacatgtaccacgacctcgggctggtcagggacttcagcatcaaccctgtcaccctcaggaggtggctggtgagtgccaaacccgccttcggttcttcctgggcacgtggtttcatccagttccacaggaatggagggaatggatcaccagggcaccttccggatg

SEQ ID NO: 181654 - DNA, 601 bp, Human
acctctggttgggatgagggtttggcagagaatgttcaaaccagcgcacagccttctgggtggctttgggaggagaggtgggcgggcccaggcacagggtgactcggaccccctgcctcccgcagttctgcgtccacgacaactacagaaacaaccccttccacaacttccggcactgcttctgcgtggcccagatgatgtacagcatggtctggctctgcagtctccaggtgggtcctgcccgctgcacacccagacctctactctcgggggtcagacggaggcccccttccagggagcrgcagccccatcccaccaagagagccacaggcgtggggtccccagccgctccgcccctcctagggacgcacccctgcccaccgttgtcagtcaccccatgggcgaggctgctcctaggattacgagagcaggtgagtccccgacctggtcacccccccaacccccacaggcaggccgatcctctcccaccatgccaggagatgccagatggctgcaggggcctttgtcccccgcttaccactcacccaattccaccccccctcaccccatcccaccctccgagtgaagagagcaaacacct

SEQ ID NO: 181655 - DNA, 601 bp, Human
agccccatcccaccaagagagccacaggcgtggggtccccagccgctccgcccctcctagggacgcacccctgcccaccgttgtcagtcaccccatgggcgaggctgctcctaggattacgagagcaggtgagtccccgacctggtcacccccccaacccccacaggcaggccgatcctctcccaccatgccaggagatgccagatggctgcaggggcctttgtcccccgcttaccactcacccaattccaccccccctcaccccatcccaccctccgagtgaagagagcaaacacctacrccctgttttccaatccaggagaagttctcacaaacggatatcctgatcctaatgacagcggccatctgccacgatctggaccatcccggctacaacaacacgtatgtacaggattttctctttttttccttttaaaaggcaccctggctactggagggaacctgtcagcccaaccctcagagcagttcccagatggagctgtcaacgacggcctcccagcccccaactctgcctccactgacacagctcctggcttctggactttgcccagggccttgggtctccccggagtaggaactt

SEQ ID NO: 181656 - DNA, 601 bp, Human
agggaaagcacaggcaggagccagaagagagcagaagagggggagaagagggactgcagagggacaggaggtgggagtgaggtgtccctcgtggggccagggatcagaaggacagaccgttgctccactcctgcctccacaggcacagagttccgccccatgtggcggacaaggtccaggccatgggcttgggtctgtgtcctcagtggcgcagcagctctctctgttgaactgtgtgtttgtgtgatgtcatcacatgcctgagagctctgctgccatgtgtcagcgcctagtgggttcygaggtgtggctgtcagcgctcctcccggggccatcaccatgcacacccatctgttccccttttgctcatttcacactcacagtggccggcacagcacaggtcagcagaggccttgaccacagcatcccagtgaacctcagcctcgttctgcccacctgcctctggcacctggtgacgtttgataatttcacaagaggccgtgatgcctcagggcctgtcccagggagcatgccgcttcctcagaggtgtctgtctggtgggactgcaggagcatggggacgtgcagttgcaggggcagct

SEQ ID NO: 181657 - DNA, 601 bp, Human
tgggtctgtgtcctcagtggcgcagcagctctctctgttgaactgtgtgtttgtgtgatgtcatcacatgcctgagagctctgctgccatgtgtcagcgcctagtgggttccgaggtgtggctgtcagcgctcctcccggggccatcaccatgcacacccatctgttccccttttgctcatttcacactcacagtggccggcacagcacaggtcagcagaggccttgaccacagcatcccagtgaacctcagcctcgttctgcccacctgcctctggcacctggtgacgtttgataatttyacaagaggccgtgatgcctcagggcctgtcccagggagcatgccgcttcctcagaggtgtctgtctggtgggactgcaggagcatggggacgtgcagttgcaggggcagctgagcggcaggagggacctcctggccaggccagggcacaggcagctcccccagcccccacggcaccttctcctgactctacttgctccacttacatggctgggtgttgctcccccgtgcaggtacctggtgagggcgcctgagtctcccctcactctctccttgcctcccaggtaccagatcaatgcccg

SEQ ID NO: 181658 - DNA, 601 bp, Human
tgaccacagcatcccagtgaacctcagcctcgttctgcccacctgcctctggcacctggtgacgtttgataatttcacaagaggccgtgatgcctcagggcctgtcccagggagcatgccgcttcctcagaggtgtctgtctggtgggactgcaggagcatggggacgtgcagttgcaggggcagctgagcggcaggagggacctcctggccaggccagggcacaggcagctcccccagcccccacggcaccttctcctgactctacttgctccacttacatggctgggtgttgctccccsgtgcaggtacctggtgagggcgcctgagtctcccctcactctctccttgcctcccaggtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacaggtgtgtggggtgagggccctcccaccggagtgggggcacattcagggacagagcagcccccactctccattggctggaagctccca

SEQ ID NO: 181659 - DNA, 601 bp, Human
aaccaccactgcgccgtggccttccagatcctcgccgagcctgagtgcaacatcttctccaacatcccacctgatgggttcaagcagatccgacaggtgtgtggggtgagggccctcccaccggagtgggggcacattcagggacagagcagcccccactctccattggctggaagctcccagaagctcctggccacagcagtgccctggggacccaagggaacccctccctccttcctcacctcctccagggcccagagtggagccccaaaaagagggtaccctcgccatgcgcacgtgyatcccactgacctgcacttcccagcctgtatttaattcagccttcactggctccctttgagataaatcctttgtccctcttccagcccaagaaactgaggcttagcaaaggtagggagcctgcccaaggaggggacaggccctggacagacacatctgctgcatccaacataggagagctgccccctgccccataaccccagctgctgtcacctgccacccacagcccagtcagcccccttccttttatttatttttttttcttttgagacagagtctcgctctgttgcccaggctggag

SEQ ID NO: 181660 - DNA, 601 bp, Human
aacccctccctccttcctcacctcctccagggcccagagtggagccccaaaaagagggtaccctcgccatgcgcacgtgcatcccactgacctgcacttcccagcctgtatttaattcagccttcactggctccctttgagataaatcctttgtccctcttccagcccaagaaactgaggcttagcaaaggtagggagcctgcccaaggaggggacaggccctggacagacacatctgctgcatccaacataggagagctgccccctgccccataaccccagctgctgtcacctgccaccyacagcccagtcagcccccttccttttatttatttttttttcttttgagacagagtctcgctctgttgcccaggctggagtgtaatggcaggatctcggctcactgcaacctccacctcctgggttcaagcaattctcctgcctcagcctcccaaatagctgggattacaggcatgcgccaccaagccggctaattttcggtatttttaatagagacggggtttcatcatgttggccaggctggtcttgaactccagacctcaggtgatccacctgcctcgacctcccaaagtgctgggat

SEQ ID NO: 181661 - DNA, 601 bp, Human
cgctctgttgcccaggctggagtgtaatggcaggatctcggctcactgcaacctccacctcctgggttcaagcaattctcctgcctcagcctcccaaatagctgggattacaggcatgcgccaccaagccggctaattttcggtatttttaatagagacggggtttcatcatgttggccaggctggtcttgaactccagacctcaggtgatccacctgcctcgacctcccaaagtgctgggattacaggtgtgagccaccacgcccggccaccccttccattttagataagggggctttakgcctctcagggcgtgatgggaggagagtgagaggatatctgcgtgagaggaagatgacctggtccacctgccccagacaaacacctccagctcaccgaaataacgccccattccacacgggaattcctcatcaaaccctcactctctgacatttgcaggggagggaagctctcggagtaaaccctgggagaaatgtgttgggttgaatagcagcgtccttcaaacaaggtccacctcccgtgaatgtgatcttatttggaaaagggtctttgcatttgtacttgttaagatttccagata

SEQ ID NO: 181662 - DNA, 601 bp, Human
aaccctcactctctgacatttgcaggggagggaagctctcggagtaaaccctgggagaaatgtgttgggttgaatagcagcgtccttcaaacaaggtccacctcccgtgaatgtgatcttatttggaaaagggtctttgcatttgtacttgttaagatttccagataagatcagtgtggattgtctaagggggccgtaaatccaaagactagtgtccttggacgaggagacagagtagaaaacagcccagacacagaggagaaggccgcatgaagacgcagtgattggagatttgagtgaygcagccccaaactaagggacttcggggcccccaggagcaggaggagacaaggaaggaccctcccctggagtcttctttgagagcagggccctgcccacactttgatcttggttctggcttccagaactgtgagagaatgagtttgttgttttaagccgcctagtttgtggtactttgtgtggcggccccaggacactcacccagggcaccgtcttctgcggttccacaaggcagacctcagccattcgaagtctaagtggcttccttccagaggcagcaagaaagactgcctggacttca

SEQ ID NO: 181663 - DNA, 601 bp, Human
tgattggagatttgagtgatgcagccccaaactaagggacttcggggcccccaggagcaggaggagacaaggaaggaccctcccctggagtcttctttgagagcagggccctgcccacactttgatcttggttctggcttccagaactgtgagagaatgagtttgttgttttaagccgcctagtttgtggtactttgtgtggcggccccaggacactcacccagggcaccgtcttctgcggttccacaaggcagacctcagccattcgaagtctaagtggcttccttccagaggcagcaasaaagactgcctggacttcagcactgggaagatactcaccaccctccaggcgtgctgctgagcctccctttatcagagagcagcagcctcttctaccatggctttccaatttgtctacgcttccaggaagttcaaagcccagtgtaaaaaactgaagtcagtgaagcatttggggaagctccgaggaagcagcatgctccctgggacggggccctgaggcatcacggcctcttgcgaaattgtcaaatgccaccatgtgccagaggcagaggtgggcagaaccaggctgtggttcattggg

SEQ ID NO: 181664 - DNA, 601 bp, Human
cccccaggagcaggaggagacaaggaaggaccctcccctggagtcttctttgagagcagggccctgcccacactttgatcttggttctggcttccagaactgtgagagaatgagtttgttgttttaagccgcctagtttgtggtactttgtgtggcggccccaggacactcacccagggcaccgtcttctgcggttccacaaggcagacctcagccattcgaagtctaagtggcttccttccagaggcagcaagaaagactgcctggacttcagcactgggaagatactcaccaccctccmggcgtgctgctgagcctccctttatcagagagcagcagcctcttctaccatggctttccaatttgtctacgcttccaggaagttcaaagcccagtgtaaaaaactgaagtcagtgaagcatttggggaagctccgaggaagcagcatgctccctgggacggggccctgaggcatcacggcctcttgcgaaattgtcaaatgccaccatgtgccagaggcagaggtgggcagaaccaggctgtggttcattgggatgctgtggtcaaggcctctgctggcctgtgctgtgccagccactgt

SEQ ID NO: 181665 - DNA, 601 bp, Human
tagtgtaggcctcgtcccactgagccatgtcggagagcatcccgcaagagaaggaggcggcacctgattggaggagcagccgctctgcacaggggatcgttctcgtgcccatccaccgtggggacacaccagcattggcctgcttcaaatgcttcactgactgcaaaatatgactctcctctgggggtaaaattagttgtcccacttttttaaaaatatattttgtcatggaagatttcaggaataactgaataaatgcttcactaataacacaattaaatgtttacaggaaaattgaatwattcaagatacaagtgatccccccaaaaaaatatatatatatacagttgaaatgacctagattgatgggtttgggttttgtatctgatgcttgttgttttattttcttggaagaggaaaacatcatacctggcacagagatgtgttctgtaaatgcttgtggggtgggtgggtggatggatggatggatggatggatggatggatggatgggtggatgggtggatggacaaatggatggaagggtggatggatggatgggtggatgggtggatgaatggacagatggataaatgggtgga

SEQ ID NO: 181666 - DNA, 601 bp, Human
catgtcggagagcatcccgcaagagaaggaggcggcacctgattggaggagcagccgctctgcacaggggatcgttctcgtgcccatccaccgtggggacacaccagcattggcctgcttcaaatgcttcactgactgcaaaatatgactctcctctgggggtaaaattagttgtcccacttttttaaaaatatattttgtcatggaagatttcaggaataactgaataaatgcttcactaataacacaattaaatgtttacaggaaaattgaataattcaagatacaagtgatccccccmaaaaaatatatatatatacagttgaaatgacctagattgatgggtttgggttttgtatctgatgcttgttgttttattttcttggaagaggaaaacatcatacctggcacagagatgtgttctgtaaatgcttgtggggtgggtgggtggatggatggatggatggatggatggatggatggatgggtggatgggtggatggacaaatggatggaagggtggatggatggatgggtggatgggtggatgaatggacagatggataaatgggtggaaggatggatggataaatggatggaa

SEQ ID NO: 181667 - DNA, 601 bp, Human
ttttaaaaatatattttgtcatggaagatttcaggaataactgaataaatgcttcactaataacacaattaaatgtttacaggaaaattgaataattcaagatacaagtgatccccccaaaaaaatatatatatatacagttgaaatgacctagattgatgggtttgggttttgtatctgatgcttgttgttttattttcttggaagaggaaaacatcatacctggcacagagatgtgttctgtaaatgcttgtggggtgggtgggtggatggatggatggatggatggatggatggatgratgggtggatgggtggatggacaaatggatggaagggtggatggatggatgggtggatgggtggatgaatggacagatggataaatgggtggaaggatggatggataaatggatggaagggcagatggatgggtggatgggtagatggatggaggatgaatgggtggatggatggatgaatggatgggtttttgggtgggcagatggatgtgtggacaaatggatgggtgatggatgcacatatgaatcggaataagagatacatgaaataatgtgtgcagggggctcagtacacagtag

SEQ ID NO: 181668 - DNA, 601 bp, Human
atgatcacattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggkcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctcccccatgagaaggtg

SEQ ID NO: 181669 - DNA, 601 bp, Human
tgatcacattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtmctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctcccccatgagaaggtgc

SEQ ID NO: 181670 - DNA, 601 bp, Human
gcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtcctccttcatggtcagaggcagcattctcccattcctcyatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctcccccatgagaaggtgcacttaggttgcccagcatctgccttttggaaaggacag

SEQ ID NO: 181671 - DNA, 601 bp, Human
ctgaaattattagtcttcttggaacaaggtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccargccagcatcccccaccaggcccacaccatagcccagcacccctccataaccaggacaaggtggccagagaaggggtagggggcctcccccatgagaaggtgcacttaggttgcccagcatctgccttttggaaaggacaggcactgggcacaccaaggcacacaaggaccagagcacgactcatgcctggaatccagcactttgggaggccacggcaggaggattgcttgagtccaaaagtttgagaccagtctgagcaatattagcaagactccatctccacaaaaaaagaaagaaaaa

SEQ ID NO: 181672 - DNA, 601 bp, Human
gtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccrtagcccagcacccctccataaccaggacaaggtggccagagaaggggtagggggcctcccccatgagaaggtgcacttaggttgcccagcatctgccttttggaaaggacaggcactgggcacaccaaggcacacaaggaccagagcacgactcatgcctggaatccagcactttgggaggccacggcaggaggattgcttgagtccaaaagtttgagaccagtctgagcaatattagcaagactccatctccacaaaaaaagaaagaaaaataaaaaaatcagtgcatatctgtggtcc

SEQ ID NO: 181673 - DNA, 601 bp, Human
ataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagccyagcacccctccataaccaggacaaggtggccagagaaggggtagggggcctcccccatgagaaggtgcacttaggttgcccagcatctgccttttggaaaggacaggcactgggcacaccaaggcacacaaggaccagagcacgactcatgcctggaatccagcactttgggaggccacggcaggaggattgcttgagtccaaaagtttgagaccagtctgagcaatattagcaagactccatctccacaaaaaaagaaagaaaaataaaaaaatcagtgcatatctgtggtcccaactg

SEQ ID NO: 181674 - DNA, 601 bp, Human
gcactttgggaggccacggcaggaggattgcttgagtccaaaagtttgagaccagtctgagcaatattagcaagactccatctccacaaaaaaagaaagaaaaataaaaaaatcagtgcatatctgtggtcccaactgcttgggaggcagaggtgggaggatcgctggagcccaggtccaggctgcagtgagccatggtcgttccactgcactccagcctgggcaacagagcaagggtctgtctcagataacagagagagagagaggtgcatgagaactgccctcccggccttcagagagaaagctggttttgtggagccttgtctaagcatcaggtgcacccctggcattcttactctgaaatttgattatctgtttaaaatcaatagcatcactttccacctccagagaggttgaaagatagggaactctcggctcaggctgaccttctaaccatccagtcccagtaggtagagtcattaggactcatcgctctctggagctgaggtgcagttaattcccaaagactgtgcgagaggatgggagctcccgcaggcaagggctggacagcaggcaaacctccccaggccagggccaccag

SEQ ID NO: 181675 - DNA, 601 bp, Human
gttgcatggtccagcaggtcctccgtctcttcctgcctgtaatggcaagtccagacccgagcagcagcagcaggcccgtgttctacctcctgttacctcaattccaaaatctcttctttcagctgaagatgattttgataaaatgctgtgatatctctaacgaggtccgtccaatggaagtcgcagagccttgggtggactgtttattagaggaatattttatgcaggtaagagtcttgcagagcaatcaagcctccagccactcttattagccccacttagtaagggtttgcgttaaacaagcacgcctgggtggtcccgcatattccccgggctgccgacagttcagcctccagaaagccttcagggtaagcgtacatcagaaacaaaataggttataatttgagacctgaaagacagtaacaatccagaaaagctaatactctaaaactgtcacctgtcactgctaattgagccattattacaagcagccttgtcaaacaaattgcctgaaagtcaagaagcaaggactgcagaagcaggagggggcccaggagggccgagacccagcaggtcagctcacacagatggccacggggaa

SEQ ID NO: 181676 - DNA, 601 bp, Human
tccagcaggtcctccgtctcttcctgcctgtaatggcaagtccagacccgagcagcagcagcaggcccgtgttctacctcctgttacctcaattccaaaatctcttctttcagctgaagatgattttgataaaatgctgtgatatctctaacgaggtccgtccaatggaagtcgcagagccttgggtggactgtttattagaggaatattttatgcaggtaagagtcttgcagagcaatcaagcctccagccactcttattagccccacttagtaagggtttgcgttaaacgagcacgccwgggtggtcccgcatattccccgggctgccgacagttcagcctccagaaagccttcagggtaagcgtacatcagaaacaaaataggttataatttgagacctgaaagacagtaacaatccagaaaagctaatactctaaaactgtcacctgtcactgctaattgagccattattacaagcagccttgtcaaacaaattgcctgaaagtcaagaagcaaggactgcagaagcaggagggggcccaggagggccgagacccagcaggtcagctcacacagatggccacggggaaggtcgggga

SEQ ID NO: 181677 - DNA, 601 bp, Human
taacgaggtccgtccaatggaagtcgcagagccttgggtggactgtttattagaggaatattttatgcaggtaagagtcttgcagagcaatcaagcctccagccactcttattagccccacttagtaagggtttgcgttaaacgagcacgcctgggtggtcccgcatattccccgggctgccgacagttcagcctccagaaagccttcagggtaagcgtacatcagaaacaaaataggttataatttgagacctgaaagacagtaacaatccagaaaagctaatactctaaaactgtcacmtgtcactgctaattgagccattattacaagcagccttgtcaaacaaattgcctgaaagtcaagaagcaaggactgcagaagcaggagggggcccaggagggccgagacccagcaggtcagctcacacagatggccacggggaaggtcggggacatagaaaaccaagccagctgaaaacaaccaccaaatattaatacaacagcttgatgaaccctaggagaagtcgggaggctttctgcaggacgctgctgccgtcctgggatacatccatccaactcacctctgcctatctctcaggtc

SEQ ID NO: 181678 - DNA, 601 bp, Human
attacaagcagccttgtcaaacaaattgcctgaaagtcaagaagcaaggactgcagaagcaggagggggcccaggagggccgagacccagcaggtcagctcacacagatggccacggggaaggtcggggacatagaaaaccaagccagctgaaaacaaccaccaaatattaatacaacagcttgatgaaccctaggagaagtcgggaggctttctgcaggacgctgctgccgtcctgggatacatccatccaactcacctctgcctatctctcaggtcggtcttcccagctagacctgcaygcccagctctgtttagcactgaagatagggtcaccttctccttgttcttactgagacacatttgtggtgtggtttggttggttggtggttaactggcgcatcttgtctttctctgagaacagcgatctggttatggggcatttctgtctctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaaca

SEQ ID NO: 181679 - DNA, 601 bp, Human
tttggttggttggtggttaactggcgcatcttgtctttctctgagaacagcgatctggttatggggcatttctgtctctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcrcacacacatatacacatatgcacacaggtacacacagacacacactcatgcacacacgtacacagatacacacagacgcacatacaggcacatacacatatacacacacgcacacagctacacacaggcacacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaag

SEQ ID NO: 181680 - DNA, 601 bp, Human
cagcgatctggttatggggcatttctgtctctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcacacacacatatacacatatgcacacaggtacacacagacacacactyatgcacacacgtacacagatacacacagacgcacatacaggcacatacacatatacacacacgcacacagctacacacaggcacacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaaggcacacaggcacacacaggcacacaaatgcacacacaggcacacaca

SEQ ID NO: 181681 - DNA, 601 bp, Human
ctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcacacacacatatacacatatgcacacaggtacacacagacacacactcatgcacacacgtacacagatacacacagaygcacatacaggcacatacacatatacacacacgcacacagctacacacaggcacacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaaggcacacaggcacacacaggcacacaaatgcacacacaggcacacacacacacacacatgcacacaggtacacacagg

SEQ ID NO: 181682 - DNA, 601 bp, Human
gaccgtgagaagtcagaaggccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcacacacacatatacacatatgcacacaggtacacacagacacacactcatgcacacacgtacacagatacacacagacgcacatacaggcacatacacatatacacacacgyacacagctacacacaggcacacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaaggcacacaggcacacacaggcacacaaatgcacacacaggcacacacacacacacacatgcacacaggtacacacaggcacacaaatgcacatgcaggtacacatgcacaca

SEQ ID NO: 181683 - DNA, 601 bp, Human
gccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcacacacacatatacacatatgcacacaggtacacacagacacacactcatgcacacacgtacacagatacacacagacgcacatacaggcacatacacatatacacacacgcacacagctacacacaggcrcacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaaggcacacaggcacacacaggcacacaaatgcacacacaggcacacacacacacacacatgcacacaggtacacacaggcacacaaatgcacatgcaggtacacatgcacacacaggcacacacagggacac

SEQ ID NO: 181684 - DNA, 601 bp, Human
atgcaggtacacatgcacacaaggcacgcaggtacacatgcacacaaggcacacaggcacacacaggcacacaaatgcacacacaggcacacacacacacacacatgcacacaggtacacacaggcacacaaatgcacatgcaggtacacatgcacacacaggcacacacagggacacacaggcacacataggcacacaaatgcacacacaggcacacacatacacacatgcacacaggtacacgcaggcacacacgtacagaggcacacacatgcacacacaggtatgcacatgcacgcmcacaggtacacacaggcacacctgcacacctgcacatcctgagcagcctcttccccggctgtcgtggtgaccgctgtccctgttccatccagagcctgctccccacagcctggcccgtgaccccagcatctcccactctgtgctgcactccctgccttgccttgctgggccctggggggcccctcactgccctcacccatcgctgccggccttcaggaccctggaggcagcactggctgtggactctcctgtccccactctgcgtcccagttcctcacctgtggaggaacccctgagctc

SEQ ID NO: 181685 - DNA, 601 bp, Human
gcacacaaatgcacacacaggcacacacacacacacacatgcacacaggtacacacaggcacacaaatgcacatgcaggtacacatgcacacacaggcacacacagggacacacaggcacacataggcacacaaatgcacacacaggcacacacatacacacatgcacacaggtacacgcaggcacacacgtacagaggcacacacatgcacacacaggtatgcacatgcacgcacacaggtacacacaggcacacctgcacacctgcacatcctgagcagcctcttccccggctgtcgtsgtgaccgctgtccctgttccatccagagcctgctccccacagcctggcccgtgaccccagcatctcccactctgtgctgcactccctgccttgccttgctgggccctggggggcccctcactgccctcacccatcgctgccggccttcaggaccctggaggcagcactggctgtggactctcctgtccccactctgcgtcccagttcctcacctgtggaggaacccctgagctctgtgccctcgagctgtgaagcccctgtccagctcccagtctcaccgcacccagccaccgagacctt

SEQ ID NO: 181686 - DNA, 601 bp, Human
cacatgcacacaggtacacacaggcacacaaatgcacatgcaggtacacatgcacacacaggcacacacagggacacacaggcacacataggcacacaaatgcacacacaggcacacacatacacacatgcacacaggtacacgcaggcacacacgtacagaggcacacacatgcacacacaggtatgcacatgcacgcacacaggtacacacaggcacacctgcacacctgcacatcctgagcagcctcttccccggctgtcgtggtgaccgctgtccctgttccatccagagcctgctmcccacagcctggcccgtgaccccagcatctcccactctgtgctgcactccctgccttgccttgctgggccctggggggcccctcactgccctcacccatcgctgccggccttcaggaccctggaggcagcactggctgtggactctcctgtccccactctgcgtcccagttcctcacctgtggaggaacccctgagctctgtgccctcgagctgtgaagcccctgtccagctcccagtctcaccgcacccagccaccgagaccttgctccttgcacacagctcgttcctgcccagctccc

SEQ ID NO: 181687 - DNA, 601 bp, Human
cacaaatgcacacacaggcacacacatacacacatgcacacaggtacacgcaggcacacacgtacagaggcacacacatgcacacacaggtatgcacatgcacgcacacaggtacacacaggcacacctgcacacctgcacatcctgagcagcctcttccccggctgtcgtggtgaccgctgtccctgttccatccagagcctgctccccacagcctggcccgtgaccccagcatctcccactctgtgctgcactccctgccttgccttgctgggccctggggggcccctcactgccctcrcccatcgctgccggccttcaggaccctggaggcagcactggctgtggactctcctgtccccactctgcgtcccagttcctcacctgtggaggaacccctgagctctgtgccctcgagctgtgaagcccctgtccagctcccagtctcaccgcacccagccaccgagaccttgctccttgcacacagctcgttcctgcccagctccccccagggcctctgagctgcctgtggccccctgccaaggcccccacctcaaggcacccccagcatgtccaaaacaggcccatctcttgttccccc

SEQ ID NO: 181688 - DNA, 601 bp, Human
ccagctgccctgacttctccagttgatgtctcctactggaaagtcacagaaaggtctctaaacctctggaaggctgagagcacttatgcagagggacagatgtagcaagaaggcttcccccactccacaaccccgcaagagagctgaaggggcttctgcctctctcgtgggccctccgagagccatagccctgatggccttgagtctctagtcctgagccctgctgcccagtaggggatagtagggttccttaaggcctctgccttcccccctgtcagcccccacaaaaaggagagacacrccaaagaggtgaaaaggccaagcccaagccgcaggctctgcacacaccaccagtccccgcggctgtggtggctgcagctgggtgagctcactgtccaggccccagatgaggcaccaagggtagcgggacagggtatgcagagctgcctctgaaaagcccatgtcaggagtgcttgggctcagaggggctggggaccacaggctttcacgttgcagcacctccaggcaacagaagctgctgggagagaggcagacactcccctgctgtctcctgctccctgacttggccttctctgtactc

SEQ ID NO: 181689 - DNA, 601 bp, Human
acagatgtagcaagaaggcttcccccactccacaaccccgcaagagagctgaaggggcttctgcctctctcgtgggccctccgagagccatagccctgatggccttgagtctctagtcctgagccctgctgcccagtaggggatagtagggttccttaaggcctctgccttcccccctgtcagcccccacaaaaaggagagacacgccaaagaggtgaaaaggccaagcccaagccgcaggctctgcacacaccaccagtccccgcggctgtggtggctgcagctgggtgagctcactgtmcaggccccagatgaggcaccaagggtagcgggacagggtatgcagagctgcctctgaaaagcccatgtcaggagtgcttgggctcagaggggctggggaccacaggctttcacgttgcagcacctccaggcaacagaagctgctgggagagaggcagacactcccctgctgtctcctgctccctgacttggccttctctgtactctgttccagttacagaagaagactgacagcttgacgtctggggccaccgagaagtccagagagagaagcagagatgtgaaaaacagtgaaggtaat

SEQ ID NO: 181690 - DNA, 601 bp, Human
ctaatcattagaattaggctcttaaggctggtggctcatgcctgcaatcccagcactttgggaggccaaggtgggcggatcacttgaggtcaggagttcaagacccagcttggccaacatggtgaaaccctgtctctactaaaaatacaaaaattagccaggtgttgtggcgtgcacctgtagtcccagctacttgggaggctgaggcaggagagtcacttgaacctgggaggtggaggttgcagtgagcccacattgcgccactgccctccagcctggagaacagtgagactccatctcaaaaaaaaaaaaaaaaaaaagtgaggctcttaaagaaggggaacatgctttagttaatagaaaaacatcaataattagcatatgtatcacttataagagtaagtactttttaaaagtgcaattgaagtactgaaaacttttcacaaatcacgtgtttgctttatatggctttgagcattttcctctgtacttgttgatactagtcattcagctcacggggaatgcagagcagccgtttgttcacctcataataaggtcacactaatggccaggcacggtggctcacgcctgtaatccaagc

SEQ ID NO: 181691 - DNA, 601 bp, Human
attcagctcacggggaatgcagagcagccgtttgttcacctcataataaggtcacactaatggccaggcacggtggctcacgcctgtaatccaagcactttgggaggccaaggcggcggatcacgaggagatcgagaccatcctggctaacacggtgaaaccccgtctctactttaaacacaaaaaattagccgggcgtggtggcgggtgcctgtagtcccagctacttgagaggctgaggcaggagaatggagtgaacccaggaggcggagattgccgtgagccaagatcgcgccactgtactccagcctgggcaacagagcgagacttcgtctcaaaaaataaaaataaataaataagccgggcgcagtggctcatgcctgtagtcccagcactttgggaggccaaggtggacggatcacaaggtcaggagatcgagaccatcctggctaacacggtgaaacccttctctactaaaaatacaaaaaaaattagccgggcgtggtggtgggtgcctgtattcccagctactcgggaggctgaggcggagcttgcagtgagccaagatcgtgccactgcactccagcctgggtgacagagc

SEQ ID NO: 181692 - DNA, 601 bp, Human; identical to SEQ ID NO: 94965

SEQ ID NO: 181693 - DNA, 601 bp, Human; identical to SEQ ID NO: 94966

SEQ ID NO: 181694 - DNA, 601 bp, Human; identical to SEQ ID NO: 94967

SEQ ID NO: 181695 - DNA, 601 bp, Human; identical to SEQ ID NO: 94968

SEQ ID NO: 181696 - DNA, 601 bp, Human; identical to SEQ ID NO: 94969

SEQ ID NO: 181697 - DNA, 601 bp, Human; identical to SEQ ID NO: 94970

SEQ ID NO: 181698 - DNA, 601 bp, Human; identical to SEQ ID NO: 94971

SEQ ID NO: 181699 - DNA, 601 bp, Human; identical to SEQ ID NO: 94972

SEQ ID NO: 181700 - DNA, 601 bp, Human; identical to SEQ ID NO: 94973

SEQ ID NO: 181701 - DNA, 601 bp, Human; identical to SEQ ID NO: 94974

SEQ ID NO: 181702 - DNA, 601 bp, Human; identical to SEQ ID NO: 94975

SEQ ID NO: 181703 - DNA, 601 bp, Human; identical to SEQ ID NO: 94976

SEQ ID NO: 181704 - DNA, 601 bp, Human; identical to SEQ ID NO: 94977

SEQ ID NO: 181705 - DNA, 601 bp, Human; identical to SEQ ID NO: 94978

SEQ ID NO: 181706 - DNA, 601 bp, Human; identical to SEQ ID NO: 94979

SEQ ID NO: 181707 - DNA, 601 bp, Human; identical to SEQ ID NO: 94980

SEQ ID NO: 181708 - DNA, 601 bp, Human; identical to SEQ ID NO: 94981

SEQ ID NO: 181709 - DNA, 601 bp, Human; identical to SEQ ID NO: 94982

SEQ ID NO: 181710 - DNA, 601 bp, Human; identical to SEQ ID NO: 94983

SEQ ID NO: 181711 - DNA, 601 bp, Human; identical to SEQ ID NO: 94984

SEQ ID NO: 181712 - DNA, 601 bp, Human; identical to SEQ ID NO: 94985

SEQ ID NO: 181713 - DNA, 601 bp, Human; identical to SEQ ID NO: 94986

SEQ ID NO: 181714 - DNA, 601 bp, Human; identical to SEQ ID NO: 94987

SEQ ID NO: 181715 - DNA, 601 bp, Human; identical to SEQ ID NO: 94988

SEQ ID NO: 181716 - DNA, 601 bp, Human; identical to SEQ ID NO: 94989

SEQ ID NO: 181717 - DNA, 601 bp, Human; identical to SEQ ID NO: 94990

SEQ ID NO: 181718 - DNA, 601 bp, Human; identical to SEQ ID NO: 94991

SEQ ID NO: 181719 - DNA, 601 bp, Human; identical to SEQ ID NO: 94992

SEQ ID NO: 181720 - DNA, 601 bp, Human; identical to SEQ ID NO: 94993

SEQ ID NO: 181721 - DNA, 601 bp, Human; identical to SEQ ID NO: 94994

SEQ ID NO: 181722 - DNA, 601 bp, Human; identical to SEQ ID NO: 94995

SEQ ID NO: 181723 - DNA, 601 bp, Human; identical to SEQ ID NO: 94996

SEQ ID NO: 181724 - DNA, 601 bp, Human; identical to SEQ ID NO: 94997

SEQ ID NO: 181725 - DNA, 601 bp, Human; identical to SEQ ID NO: 94998

SEQ ID NO: 181726 - DNA, 601 bp, Human; identical to SEQ ID NO: 94999

SEQ ID NO: 181727 - DNA, 601 bp, Human; identical to SEQ ID NO: 95000

SEQ ID NO: 181728 - DNA, 601 bp, Human; identical to SEQ ID NO: 95001

SEQ ID NO: 181729 - DNA, 601 bp, Human; identical to SEQ ID NO: 95002

SEQ ID NO: 181730 - DNA, 601 bp, Human; identical to SEQ ID NO: 95003

SEQ ID NO: 181731 - DNA, 601 bp, Human; identical to SEQ ID NO: 95004

SEQ ID NO: 181732 - DNA, 601 bp, Human; identical to SEQ ID NO: 95005

SEQ ID NO: 181733 - DNA, 601 bp, Human; identical to SEQ ID NO: 95006

SEQ ID NO: 181734 - DNA, 601 bp, Human; identical to SEQ ID NO: 95007

SEQ ID NO: 181735 - DNA, 601 bp, Human; identical to SEQ ID NO: 95008

SEQ ID NO: 181736 - DNA, 601 bp, Human; identical to SEQ ID NO: 95009

SEQ ID NO: 181737 - DNA, 601 bp, Human; identical to SEQ ID NO: 95010

SEQ ID NO: 181738 - DNA, 601 bp, Human; identical to SEQ ID NO: 95011

SEQ ID NO: 181739 - DNA, 601 bp, Human; identical to SEQ ID NO: 95012

SEQ ID NO: 181740 - DNA, 601 bp, Human; identical to SEQ ID NO: 95013

SEQ ID NO: 181741 - DNA, 601 bp, Human; identical to SEQ ID NO: 95014

SEQ ID NO: 181742 - DNA, 601 bp, Human; identical to SEQ ID NO: 95015

SEQ ID NO: 181743 - DNA, 601 bp, Human; identical to SEQ ID NO: 95016

SEQ ID NO: 181744 - DNA, 601 bp, Human; identical to SEQ ID NO: 95017

SEQ ID NO: 181745 - DNA, 601 bp, Human; identical to SEQ ID NO: 95018

SEQ ID NO: 181746 - DNA, 601 bp, Human; identical to SEQ ID NO: 95019

SEQ ID NO: 181747 - DNA, 601 bp, Human; identical to SEQ ID NO: 95020

SEQ ID NO: 181748 - DNA, 601 bp, Human; identical to SEQ ID NO: 95021

SEQ ID NO: 181749 - DNA, 601 bp, Human; identical to SEQ ID NO: 95022

SEQ ID NO: 181750 - DNA, 601 bp, Human; identical to SEQ ID NO: 95023

SEQ ID NO: 181751 - DNA, 601 bp, Human; identical to SEQ ID NO: 95024

SEQ ID NO: 181752 - DNA, 601 bp, Human; identical to SEQ ID NO: 95025

SEQ ID NO: 181753 - DNA, 601 bp, Human; identical to SEQ ID NO: 95026

SEQ ID NO: 181754 - DNA, 601 bp, Human; identical to SEQ ID NO: 95027

SEQ ID NO: 181755 - DNA, 601 bp, Human; identical to SEQ ID NO: 95028

SEQ ID NO: 181756 - DNA, 601 bp, Human; identical to SEQ ID NO: 95029

SEQ ID NO: 181757 - DNA, 601 bp, Human; identical to SEQ ID NO: 95030

SEQ ID NO: 181758 - DNA, 601 bp, Human; identical to SEQ ID NO: 95031

SEQ ID NO: 181759 - DNA, 601 bp, Human; identical to SEQ ID NO: 95032

SEQ ID NO: 181760 - DNA, 601 bp, Human; identical to SEQ ID NO: 95033

SEQ ID NO: 181761 - DNA, 601 bp, Human; identical to SEQ ID NO: 95034

SEQ ID NO: 181762 - DNA, 601 bp, Human; identical to SEQ ID NO: 95035

SEQ ID NO: 181763 - DNA, 601 bp, Human; identical to SEQ ID NO: 95036

SEQ ID NO: 181764 - DNA, 601 bp, Human; identical to SEQ ID NO: 95037

SEQ ID NO: 181765 - DNA, 601 bp, Human; identical to SEQ ID NO: 95038

SEQ ID NO: 181766 - DNA, 601 bp, Human; identical to SEQ ID NO: 95039

SEQ ID NO: 181767 - DNA, 601 bp, Human; identical to SEQ ID NO: 95040

SEQ ID NO: 181768 - DNA, 601 bp, Human; identical to SEQ ID NO: 37994

SEQ ID NO: 181769 - DNA, 601 bp, Human; identical to SEQ ID NO: 37995

SEQ ID NO: 181770 - DNA, 601 bp, Human; identical to SEQ ID NO: 37996

SEQ ID NO: 181771 - DNA, 601 bp, Human; identical to SEQ ID NO: 37997

SEQ ID NO: 181772 - DNA, 601 bp, Human; identical to SEQ ID NO: 37998

SEQ ID NO: 181773 - DNA, 601 bp, Human; identical to SEQ ID NO: 37999

SEQ ID NO: 181774 - DNA, 601 bp, Human; identical to SEQ ID NO: 38000

SEQ ID NO: 181775 - DNA, 601 bp, Human; identical to SEQ ID NO: 38001

SEQ ID NO: 181776 - DNA, 601 bp, Human; identical to SEQ ID NO: 38002

SEQ ID NO: 181777 - DNA, 601 bp, Human; identical to SEQ ID NO: 38003

SEQ ID NO: 181778 - DNA, 601 bp, Human; identical to SEQ ID NO: 38004

SEQ ID NO: 181779 - DNA, 601 bp, Human; identical to SEQ ID NO: 38005

SEQ ID NO: 181780 - DNA, 601 bp, Human; identical to SEQ ID NO: 38006

SEQ ID NO: 181781 - DNA, 601 bp, Human; identical to SEQ ID NO: 38007

SEQ ID NO: 181782 - DNA, 601 bp, Human; identical to SEQ ID NO: 95055

SEQ ID NO: 181783 - DNA, 601 bp, Human; identical to SEQ ID NO: 95056

SEQ ID NO: 181784 - DNA, 601 bp, Human; identical to SEQ ID NO: 95057

SEQ ID NO: 181785 - DNA, 601 bp, Human; identical to SEQ ID NO: 95058

SEQ ID NO: 181786 - DNA, 601 bp, Human; identical to SEQ ID NO: 95059

SEQ ID NO: 181787 - DNA, 601 bp, Human; identical to SEQ ID NO: 95060

SEQ ID NO: 181788 - DNA, 601 bp, Human; identical to SEQ ID NO: 95061

SEQ ID NO: 181789 - DNA, 601 bp, Human; identical to SEQ ID NO: 95062

SEQ ID NO: 181790 - DNA, 601 bp, Human; identical to SEQ ID NO: 95063

SEQ ID NO: 181791 - DNA, 601 bp, Human; identical to SEQ ID NO: 95064

SEQ ID NO: 181792 - DNA, 601 bp, Human; identical to SEQ ID NO: 95065

SEQ ID NO: 181793 - DNA, 601 bp, Human; identical to SEQ ID NO: 95066

SEQ ID NO: 181794 - DNA, 601 bp, Human; identical to SEQ ID NO: 95067

SEQ ID NO: 181795 - DNA, 601 bp, Human; identical to SEQ ID NO: 95068

SEQ ID NO: 181796 - DNA, 601 bp, Human; identical to SEQ ID NO: 95069

SEQ ID NO: 181797 - DNA, 601 bp, Human; identical to SEQ ID NO: 95070

SEQ ID NO: 181798 - DNA, 601 bp, Human; identical to SEQ ID NO: 95071

SEQ ID NO: 181799 - DNA, 601 bp, Human; identical to SEQ ID NO: 95072

SEQ ID NO: 181800 - DNA, 601 bp, Human; identical to SEQ ID NO: 95073

SEQ ID NO: 181801 - DNA, 601 bp, Human; identical to SEQ ID NO: 95074

SEQ ID NO: 181802 - DNA, 601 bp, Human; identical to SEQ ID NO: 38008

SEQ ID NO: 181803 - DNA, 601 bp, Human; identical to SEQ ID NO: 38009

SEQ ID NO: 181804 - DNA, 601 bp, Human
ggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcargcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccct

SEQ ID NO: 181805 - DNA, 429 bp, Human
ggttcggggagccctgggcggggcggctgttggggggaactgggttcggggtgccctgggcagggggctactggggggcggctgtgaggaggagttgggttcagggagccctgggcggggtggctgtcrgggggaactgggttccgggagccctgggccggggcggggggcggctgtaggaaggaactggtttcggggagccctgggcggggcggctgtggggaggaaggtgacgtgcaggggaccagaggctctgcactgctcctaggacagctcatctgtaatcagaaaaaaaataaataaaatacagaacgctgactcctccgtgagacagatcggggaccttagcactttaatccctcccttctgagcgctcggtgtgcacttttagactatagctgtttcattgacgtgtcactctccatccag

SEQ ID NO: 181806 - DNA, 465 bp, Human
ggttcggggagccctgggcggggcggctgttggggggaactgggttcggggtgccctgggcagggggctactggggggcggctgtgaggaggagttgggttcagggagccctgggcggggtggctgtcggggggaactgggttccgggagccctgggccggggcrgggggcggctgtaggaaggaactggtttcggggagccctgggcggggcggctgtggggaggaaggtgacgtgcaggggaccagaggctctgcactgctcctaggacagctcatctgtaatcagaaaaaaaataaataaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaa

SEQ ID NO: 181807 - DNA, 601 bp, Human
ggttcggggagccctgggcggggcggctgttggggggaactgggttcggggtgccctgggcagggggctactggggggcggctgtgaggaggagttgggttcagggagccctgggcggggtggctgtcggggggaactgggttccgggagccctgggccggggcggggggcggctgtaggaaggaactggtttcggggagccctgggcggggcggctgtggggaggaaggtgacgtgcaggggaccagaggctctgcactgctcctaggacagctcatctgtaatcagaaaaaaaataaayaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttaactaaacctgaagtattaattccacaaag

SEQ ID NO: 181808 - DNA, 601 bp, Human
ctctgcactgctcctaggacagctcatctgtaatcagaaaaaaaataaataaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctggtgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttg

SEQ ID NO: 181809 - DNA, 601 bp, Human
tgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttgragaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttt

SEQ ID NO: 181810 - DNA, 601 bp, Human; identical to SEQ ID NO: 38010

SEQ ID NO: 181811 - DNA, 601 bp, Human; identical to SEQ ID NO: 94965

SEQ ID NO: 181812 - DNA, 601 bp, Human; identical to SEQ ID NO: 94966

SEQ ID NO: 181813 - DNA, 601 bp, Human; identical to SEQ ID NO: 94967

SEQ ID NO: 181814 - DNA, 601 bp, Human; identical to SEQ ID NO: 94968

SEQ ID NO: 181815 - DNA, 601 bp, Human; identical to SEQ ID NO: 94969

SEQ ID NO: 181816 - DNA, 601 bp, Human; identical to SEQ ID NO: 94970

SEQ ID NO: 181817 - DNA, 601 bp, Human; identical to SEQ ID NO: 94971

SEQ ID NO: 181818 - DNA, 601 bp, Human; identical to SEQ ID NO: 94972

SEQ ID NO: 181819 - DNA, 601 bp, Human; identical to SEQ ID NO: 94973

SEQ ID NO: 181820 - DNA, 601 bp, Human; identical to SEQ ID NO: 94974

SEQ ID NO: 181821 - DNA, 601 bp, Human; identical to SEQ ID NO: 94975

SEQ ID NO: 181822 - DNA, 601 bp, Human; identical to SEQ ID NO: 94976

SEQ ID NO: 181823 - DNA, 601 bp, Human; identical to SEQ ID NO: 94977

SEQ ID NO: 181824 - DNA, 601 bp, Human; identical to SEQ ID NO: 94978

SEQ ID NO: 181825 - DNA, 601 bp, Human; identical to SEQ ID NO: 94979

SEQ ID NO: 181826 - DNA, 601 bp, Human; identical to SEQ ID NO: 94980

SEQ ID NO: 181827 - DNA, 601 bp, Human; identical to SEQ ID NO: 94981

SEQ ID NO: 181828 - DNA, 601 bp, Human; identical to SEQ ID NO: 94982

SEQ ID NO: 181829 - DNA, 601 bp, Human; identical to SEQ ID NO: 94983

SEQ ID NO: 181830 - DNA, 601 bp, Human; identical to SEQ ID NO: 94984

SEQ ID NO: 181831 - DNA, 601 bp, Human; identical to SEQ ID NO: 94985

SEQ ID NO: 181832 - DNA, 601 bp, Human; identical to SEQ ID NO: 94986

SEQ ID NO: 181833 - DNA, 601 bp, Human; identical to SEQ ID NO: 94987

SEQ ID NO: 181834 - DNA, 601 bp, Human; identical to SEQ ID NO: 94988

SEQ ID NO: 181835 - DNA, 601 bp, Human; identical to SEQ ID NO: 94989

SEQ ID NO: 181836 - DNA, 601 bp, Human; identical to SEQ ID NO: 94990

SEQ ID NO: 181837 - DNA, 601 bp, Human; identical to SEQ ID NO: 94991

SEQ ID NO: 181838 - DNA, 601 bp, Human; identical to SEQ ID NO: 94992

SEQ ID NO: 181839 - DNA, 601 bp, Human; identical to SEQ ID NO: 94993

SEQ ID NO: 181840 - DNA, 601 bp, Human; identical to SEQ ID NO: 94994

SEQ ID NO: 181841 - DNA, 601 bp, Human; identical to SEQ ID NO: 94995

SEQ ID NO: 181842 - DNA, 601 bp, Human; identical to SEQ ID NO: 94996

SEQ ID NO: 181843 - DNA, 601 bp, Human; identical to SEQ ID NO: 94997

SEQ ID NO: 181844 - DNA, 601 bp, Human; identical to SEQ ID NO: 94998

SEQ ID NO: 181845 - DNA, 601 bp, Human; identical to SEQ ID NO: 94999

SEQ ID NO: 181846 - DNA, 601 bp, Human; identical to SEQ ID NO: 95000

SEQ ID NO: 181847 - DNA, 601 bp, Human; identical to SEQ ID NO: 95001

SEQ ID NO: 181848 - DNA, 601 bp, Human; identical to SEQ ID NO: 95002

SEQ ID NO: 181849 - DNA, 601 bp, Human; identical to SEQ ID NO: 95003

SEQ ID NO: 181850 - DNA, 601 bp, Human; identical to SEQ ID NO: 95004

SEQ ID NO: 181851 - DNA, 601 bp, Human; identical to SEQ ID NO: 95005

SEQ ID NO: 181852 - DNA, 601 bp, Human; identical to SEQ ID NO: 95006

SEQ ID NO: 181853 - DNA, 601 bp, Human; identical to SEQ ID NO: 95007

SEQ ID NO: 181854 - DNA, 601 bp, Human; identical to SEQ ID NO: 95008

SEQ ID NO: 181855 - DNA, 601 bp, Human; identical to SEQ ID NO: 95009

SEQ ID NO: 181856 - DNA, 601 bp, Human; identical to SEQ ID NO: 95010

SEQ ID NO: 181857 - DNA, 601 bp, Human; identical to SEQ ID NO: 95011

SEQ ID NO: 181858 - DNA, 601 bp, Human; identical to SEQ ID NO: 95012

SEQ ID NO: 181859 - DNA, 601 bp, Human; identical to SEQ ID NO: 95013

SEQ ID NO: 181860 - DNA, 601 bp, Human; identical to SEQ ID NO: 95014

SEQ ID NO: 181861 - DNA, 601 bp, Human; identical to SEQ ID NO: 95015

SEQ ID NO: 181862 - DNA, 601 bp, Human; identical to SEQ ID NO: 95016

SEQ ID NO: 181863 - DNA, 601 bp, Human; identical to SEQ ID NO: 95017

SEQ ID NO: 181864 - DNA, 601 bp, Human; identical to SEQ ID NO: 95018

SEQ ID NO: 181865 - DNA, 601 bp, Human; identical to SEQ ID NO: 95019

SEQ ID NO: 181866 - DNA, 601 bp, Human; identical to SEQ ID NO: 95020

SEQ ID NO: 181867 - DNA, 601 bp, Human; identical to SEQ ID NO: 95021

SEQ ID NO: 181868 - DNA, 601 bp, Human; identical to SEQ ID NO: 95022

SEQ ID NO: 181869 - DNA, 601 bp, Human; identical to SEQ ID NO: 95023

SEQ ID NO: 181870 - DNA, 601 bp, Human; identical to SEQ ID NO: 95024

SEQ ID NO: 181871 - DNA, 601 bp, Human; identical to SEQ ID NO: 95025

SEQ ID NO: 181872 - DNA, 601 bp, Human; identical to SEQ ID NO: 95026

SEQ ID NO: 181873 - DNA, 601 bp, Human; identical to SEQ ID NO: 95027

SEQ ID NO: 181874 - DNA, 601 bp, Human; identical to SEQ ID NO: 95028

SEQ ID NO: 181875 - DNA, 601 bp, Human; identical to SEQ ID NO: 95029

SEQ ID NO: 181876 - DNA, 601 bp, Human; identical to SEQ ID NO: 95030

SEQ ID NO: 181877 - DNA, 601 bp, Human; identical to SEQ ID NO: 95031

SEQ ID NO: 181878 - DNA, 601 bp, Human; identical to SEQ ID NO: 95032

SEQ ID NO: 181879 - DNA, 601 bp, Human; identical to SEQ ID NO: 95033

SEQ ID NO: 181880 - DNA, 601 bp, Human; identical to SEQ ID NO: 95034

SEQ ID NO: 181881 - DNA, 601 bp, Human; identical to SEQ ID NO: 95035

SEQ ID NO: 181882 - DNA, 601 bp, Human; identical to SEQ ID NO: 95036

SEQ ID NO: 181883 - DNA, 601 bp, Human; identical to SEQ ID NO: 95037

SEQ ID NO: 181884 - DNA, 601 bp, Human; identical to SEQ ID NO: 95038

SEQ ID NO: 181885 - DNA, 601 bp, Human; identical to SEQ ID NO: 95039

SEQ ID NO: 181886 - DNA, 601 bp, Human; identical to SEQ ID NO: 95040

SEQ ID NO: 181887 - DNA, 601 bp, Human; identical to SEQ ID NO: 37994

SEQ ID NO: 181888 - DNA, 601 bp, Human; identical to SEQ ID NO: 37995

SEQ ID NO: 181889 - DNA, 601 bp, Human; identical to SEQ ID NO: 37996

SEQ ID NO: 181890 - DNA, 601 bp, Human; identical to SEQ ID NO: 37997

SEQ ID NO: 181891 - DNA, 601 bp, Human; identical to SEQ ID NO: 37998

SEQ ID NO: 181892 - DNA, 601 bp, Human; identical to SEQ ID NO: 37999

SEQ ID NO: 181893 - DNA, 601 bp, Human; identical to SEQ ID NO: 38000

SEQ ID NO: 181894 - DNA, 601 bp, Human; identical to SEQ ID NO: 38001

SEQ ID NO: 181895 - DNA, 601 bp, Human; identical to SEQ ID NO: 38002

SEQ ID NO: 181896 - DNA, 601 bp, Human; identical to SEQ ID NO: 38003

SEQ ID NO: 181897 - DNA, 601 bp, Human; identical to SEQ ID NO: 38004

SEQ ID NO: 181898 - DNA, 601 bp, Human; identical to SEQ ID NO: 38005

SEQ ID NO: 181899 - DNA, 601 bp, Human; identical to SEQ ID NO: 38006

SEQ ID NO: 181900 - DNA, 601 bp, Human; identical to SEQ ID NO: 38007

SEQ ID NO: 181901 - DNA, 601 bp, Human; identical to SEQ ID NO: 95055

SEQ ID NO: 181902 - DNA, 601 bp, Human; identical to SEQ ID NO: 95056

SEQ ID NO: 181903 - DNA, 601 bp, Human; identical to SEQ ID NO: 95057

SEQ ID NO: 181904 - DNA, 601 bp, Human; identical to SEQ ID NO: 95058

SEQ ID NO: 181905 - DNA, 601 bp, Human; identical to SEQ ID NO: 95059

SEQ ID NO: 181906 - DNA, 601 bp, Human; identical to SEQ ID NO: 95060

SEQ ID NO: 181907 - DNA, 601 bp, Human; identical to SEQ ID NO: 95061

SEQ ID NO: 181908 - DNA, 601 bp, Human; identical to SEQ ID NO: 95062

SEQ ID NO: 181909 - DNA, 601 bp, Human; identical to SEQ ID NO: 95063

SEQ ID NO: 181910 - DNA, 601 bp, Human; identical to SEQ ID NO: 95064

SEQ ID NO: 181911 - DNA, 601 bp, Human; identical to SEQ ID NO: 95065

SEQ ID NO: 181912 - DNA, 601 bp, Human; identical to SEQ ID NO: 95066

SEQ ID NO: 181913 - DNA, 601 bp, Human; identical to SEQ ID NO: 95067

SEQ ID NO: 181914 - DNA, 601 bp, Human; identical to SEQ ID NO: 95068

SEQ ID NO: 181915 - DNA, 601 bp, Human; identical to SEQ ID NO: 95069

SEQ ID NO: 181916 - DNA, 601 bp, Human; identical to SEQ ID NO: 95070

SEQ ID NO: 181917 - DNA, 601 bp, Human; identical to SEQ ID NO: 95071

SEQ ID NO: 181918 - DNA, 601 bp, Human; identical to SEQ ID NO: 95072

SEQ ID NO: 181919 - DNA, 601 bp, Human; identical to SEQ ID NO: 95073

SEQ ID NO: 181920 - DNA, 601 bp, Human; identical to SEQ ID NO: 95074

SEQ ID NO: 181921 - DNA, 601 bp, Human; identical to SEQ ID NO: 38008

SEQ ID NO: 181922 - DNA, 601 bp, Human; identical to SEQ ID NO: 38009

SEQ ID NO: 181923 - DNA, 601 bp, Human; identical to SEQ ID NO: 181804

SEQ ID NO: 181924 - DNA, 429 bp, Human; identical to SEQ ID NO: 181805

SEQ ID NO: 181925 - DNA, 465 bp, Human; identical to SEQ ID NO: 181806

SEQ ID NO: 181926 - DNA, 601 bp, Human; identical to SEQ ID NO: 181807

SEQ ID NO: 181927 - DNA, 601 bp, Human; identical to SEQ ID NO: 181808

SEQ ID NO: 181928 - DNA, 601 bp, Human; identical to SEQ ID NO: 181809

SEQ ID NO: 181929 - DNA, 601 bp, Human; identical to SEQ ID NO: 38010

SEQ ID NO: 181930 - DNA, 601 bp, Human; identical to SEQ ID NO: 94965

SEQ ID NO: 181931 - DNA, 601 bp, Human; identical to SEQ ID NO: 94966

SEQ ID NO: 181932 - DNA, 601 bp, Human; identical to SEQ ID NO: 94967

SEQ ID NO: 181933 - DNA, 601 bp, Human; identical to SEQ ID NO: 94968

SEQ ID NO: 181934 - DNA, 601 bp, Human; identical to SEQ ID NO: 94969

SEQ ID NO: 181935 - DNA, 601 bp, Human; identical to SEQ ID NO: 94970

SEQ ID NO: 181936 - DNA, 601 bp, Human; identical to SEQ ID NO: 94971

SEQ ID NO: 181937 - DNA, 601 bp, Human; identical to SEQ ID NO: 94972

SEQ ID NO: 181938 - DNA, 601 bp, Human; identical to SEQ ID NO: 94973

SEQ ID NO: 181939 - DNA, 601 bp, Human; identical to SEQ ID NO: 94974

SEQ ID NO: 181940 - DNA, 601 bp, Human; identical to SEQ ID NO: 94975

SEQ ID NO: 181941 - DNA, 601 bp, Human; identical to SEQ ID NO: 94976

SEQ ID NO: 181942 - DNA, 601 bp, Human; identical to SEQ ID NO: 94977

SEQ ID NO: 181943 - DNA, 601 bp, Human; identical to SEQ ID NO: 94978

SEQ ID NO: 181944 - DNA, 601 bp, Human; identical to SEQ ID NO: 94979

SEQ ID NO: 181945 - DNA, 601 bp, Human; identical to SEQ ID NO: 94980

SEQ ID NO: 181946 - DNA, 601 bp, Human; identical to SEQ ID NO: 94981

SEQ ID NO: 181947 - DNA, 601 bp, Human; identical to SEQ ID NO: 94982

SEQ ID NO: 181948 - DNA, 601 bp, Human; identical to SEQ ID NO: 94983

SEQ ID NO: 181949 - DNA, 601 bp, Human; identical to SEQ ID NO: 94984

SEQ ID NO: 181950 - DNA, 601 bp, Human; identical to SEQ ID NO: 94985

SEQ ID NO: 181951 - DNA, 601 bp, Human; identical to SEQ ID NO: 94986

SEQ ID NO: 181952 - DNA, 601 bp, Human; identical to SEQ ID NO: 94987

SEQ ID NO: 181953 - DNA, 601 bp, Human; identical to SEQ ID NO: 94988

SEQ ID NO: 181954 - DNA, 601 bp, Human; identical to SEQ ID NO: 94989

SEQ ID NO: 181955 - DNA, 601 bp, Human; identical to SEQ ID NO: 94990

SEQ ID NO: 181956 - DNA, 601 bp, Human; identical to SEQ ID NO: 94991

SEQ ID NO: 181957 - DNA, 601 bp, Human; identical to SEQ ID NO: 94992

SEQ ID NO: 181958 - DNA, 601 bp, Human; identical to SEQ ID NO: 94993

SEQ ID NO: 181959 - DNA, 601 bp, Human; identical to SEQ ID NO: 94994

SEQ ID NO: 181960 - DNA, 601 bp, Human; identical to SEQ ID NO: 94995

SEQ ID NO: 181961 - DNA, 601 bp, Human; identical to SEQ ID NO: 94996

SEQ ID NO: 181962 - DNA, 601 bp, Human; identical to SEQ ID NO: 94997

SEQ ID NO: 181963 - DNA, 601 bp, Human; identical to SEQ ID NO: 94998

SEQ ID NO: 181964 - DNA, 601 bp, Human; identical to SEQ ID NO: 94999

SEQ ID NO: 181965 - DNA, 601 bp, Human; identical to SEQ ID NO: 95000

SEQ ID NO: 181966 - DNA, 601 bp, Human; identical to SEQ ID NO: 95001

SEQ ID NO: 181967 - DNA, 601 bp, Human; identical to SEQ ID NO: 95002

SEQ ID NO: 181968 - DNA, 601 bp, Human; identical to SEQ ID NO: 95003

SEQ ID NO: 181969 - DNA, 601 bp, Human; identical to SEQ ID NO: 95004

SEQ ID NO: 181970 - DNA, 601 bp, Human; identical to SEQ ID NO: 95005

SEQ ID NO: 181971 - DNA, 601 bp, Human; identical to SEQ ID NO: 95006

SEQ ID NO: 181972 - DNA, 601 bp, Human; identical to SEQ ID NO: 95007

SEQ ID NO: 181973 - DNA, 601 bp, Human; identical to SEQ ID NO: 95008

SEQ ID NO: 181974 - DNA, 601 bp, Human; identical to SEQ ID NO: 95009

SEQ ID NO: 181975 - DNA, 601 bp, Human; identical to SEQ ID NO: 95010

SEQ ID NO: 181976 - DNA, 601 bp, Human; identical to SEQ ID NO: 95011

SEQ ID NO: 181977 - DNA, 601 bp, Human; identical to SEQ ID NO: 95012

SEQ ID NO: 181978 - DNA, 601 bp, Human; identical to SEQ ID NO: 95013

SEQ ID NO: 181979 - DNA, 601 bp, Human; identical to SEQ ID NO: 95014

SEQ ID NO: 181980 - DNA, 601 bp, Human; identical to SEQ ID NO: 95015

SEQ ID NO: 181981 - DNA, 601 bp, Human; identical to SEQ ID NO: 95016

SEQ ID NO: 181982 - DNA, 601 bp, Human; identical to SEQ ID NO: 95017

SEQ ID NO: 181983 - DNA, 601 bp, Human; identical to SEQ ID NO: 95018

SEQ ID NO: 181984 - DNA, 601 bp, Human; identical to SEQ ID NO: 95019

SEQ ID NO: 181985 - DNA, 601 bp, Human; identical to SEQ ID NO: 95020

SEQ ID NO: 181986 - DNA, 601 bp, Human; identical to SEQ ID NO: 95021

SEQ ID NO: 181987 - DNA, 601 bp, Human; identical to SEQ ID NO: 95022

SEQ ID NO: 181988 - DNA, 601 bp, Human; identical to SEQ ID NO: 95023

SEQ ID NO: 181989 - DNA, 601 bp, Human; identical to SEQ ID NO: 95024

SEQ ID NO: 181990 - DNA, 601 bp, Human; identical to SEQ ID NO: 95025

SEQ ID NO: 181991 - DNA, 601 bp, Human; identical to SEQ ID NO: 95026

SEQ ID NO: 181992 - DNA, 601 bp, Human; identical to SEQ ID NO: 95027

SEQ ID NO: 181993 - DNA, 601 bp, Human; identical to SEQ ID NO: 95028

SEQ ID NO: 181994 - DNA, 601 bp, Human; identical to SEQ ID NO: 95029

SEQ ID NO: 181995 - DNA, 601 bp, Human; identical to SEQ ID NO: 95030

SEQ ID NO: 181996 - DNA, 601 bp, Human; identical to SEQ ID NO: 95031

SEQ ID NO: 181997 - DNA, 601 bp, Human; identical to SEQ ID NO: 95032

SEQ ID NO: 181998 - DNA, 601 bp, Human; identical to SEQ ID NO: 95033

SEQ ID NO: 181999 - DNA, 601 bp, Human; identical to SEQ ID NO: 95034

SEQ ID NO: 182000 - DNA, 601 bp, Human; identical to SEQ ID NO: 95035

SEQ ID NO: 182001 - DNA, 601 bp, Human; identical to SEQ ID NO: 95036

SEQ ID NO: 182002 - DNA, 601 bp, Human; identical to SEQ ID NO: 95037

SEQ ID NO: 182003 - DNA, 601 bp, Human; identical to SEQ ID NO: 95038

SEQ ID NO: 182004 - DNA, 601 bp, Human; identical to SEQ ID NO: 95039

SEQ ID NO: 182005 - DNA, 601 bp, Human; identical to SEQ ID NO: 95040

SEQ ID NO: 182006 - DNA, 601 bp, Human; identical to SEQ ID NO: 37994

SEQ ID NO: 182007 - DNA, 601 bp, Human; identical to SEQ ID NO: 37995

SEQ ID NO: 182008 - DNA, 601 bp, Human; identical to SEQ ID NO: 37996

SEQ ID NO: 182009 - DNA, 601 bp, Human; identical to SEQ ID NO: 37997

SEQ ID NO: 182010 - DNA, 601 bp, Human; identical to SEQ ID NO: 37998

SEQ ID NO: 182011 - DNA, 601 bp, Human; identical to SEQ ID NO: 37999

SEQ ID NO: 182012 - DNA, 601 bp, Human; identical to SEQ ID NO: 38000

SEQ ID NO: 182013 - DNA, 601 bp, Human; identical to SEQ ID NO: 38001

SEQ ID NO: 182014 - DNA, 601 bp, Human; identical to SEQ ID NO: 38002

SEQ ID NO: 182015 - DNA, 601 bp, Human; identical to SEQ ID NO: 38003

SEQ ID NO: 182016 - DNA, 601 bp, Human; identical to SEQ ID NO: 38004

SEQ ID NO: 182017 - DNA, 601 bp, Human; identical to SEQ ID NO: 38005

SEQ ID NO: 182018 - DNA, 601 bp, Human; identical to SEQ ID NO: 38006

SEQ ID NO: 182019 - DNA, 601 bp, Human; identical to SEQ ID NO: 38007

SEQ ID NO: 182020 - DNA, 601 bp, Human; identical to SEQ ID NO: 95055

SEQ ID NO: 182021 - DNA, 601 bp, Human; identical to SEQ ID NO: 95056

SEQ ID NO: 182022 - DNA, 601 bp, Human; identical to SEQ ID NO: 95057

SEQ ID NO: 182023 - DNA, 601 bp, Human; identical to SEQ ID NO: 95058

SEQ ID NO: 182024 - DNA, 601 bp, Human; identical to SEQ ID NO: 95059

SEQ ID NO: 182025 - DNA, 601 bp, Human; identical to SEQ ID NO: 95060

SEQ ID NO: 182026 - DNA, 601 bp, Human; identical to SEQ ID NO: 95061

SEQ ID NO: 182027 - DNA, 601 bp, Human; identical to SEQ ID NO: 95062

SEQ ID NO: 182028 - DNA, 601 bp, Human; identical to SEQ ID NO: 95063

SEQ ID NO: 182029 - DNA, 601 bp, Human; identical to SEQ ID NO: 95064

SEQ ID NO: 182030 - DNA, 601 bp, Human; identical to SEQ ID NO: 95065

SEQ ID NO: 182031 - DNA, 601 bp, Human; identical to SEQ ID NO: 95066

SEQ ID NO: 182032 - DNA, 601 bp, Human; identical to SEQ ID NO: 95067

SEQ ID NO: 182033 - DNA, 601 bp, Human; identical to SEQ ID NO: 95068

SEQ ID NO: 182034 - DNA, 601 bp, Human; identical to SEQ ID NO: 95069

SEQ ID NO: 182035 - DNA, 601 bp, Human; identical to SEQ ID NO: 95070

SEQ ID NO: 182036 - DNA, 601 bp, Human; identical to SEQ ID NO: 95071

SEQ ID NO: 182037 - DNA, 601 bp, Human; identical to SEQ ID NO: 95072

SEQ ID NO: 182038 - DNA, 601 bp, Human; identical to SEQ ID NO: 95073

SEQ ID NO: 182039 - DNA, 601 bp, Human; identical to SEQ ID NO: 95074

SEQ ID NO: 182040 - DNA, 601 bp, Human; identical to SEQ ID NO: 38008

SEQ ID NO: 182041 - DNA, 601 bp, Human; identical to SEQ ID NO: 38009

SEQ ID NO: 182042 - DNA, 601 bp, Human; identical to SEQ ID NO: 181804

SEQ ID NO: 182043 - DNA, 429 bp, Human; identical to SEQ ID NO: 181805

SEQ ID NO: 182044 - DNA, 465 bp, Human; identical to SEQ ID NO: 181806

SEQ ID NO: 182045 - DNA, 601 bp, Human; identical to SEQ ID NO: 181807

SEQ ID NO: 182046 - DNA, 601 bp, Human; identical to SEQ ID NO: 181808

SEQ ID NO: 182047 - DNA, 601 bp, Human; identical to SEQ ID NO: 181809

SEQ ID NO: 182048 - DNA, 601 bp, Human; identical to SEQ ID NO: 38010

SEQ ID NO: 182049 - DNA, 601 bp, Human
tcccgccagcacccccgccccacacggccagggcacgtggtggagcagcagcagcacgaagcacactcgagggcgtgtctctttcagtcctgattctgcccaggagaaaggctcctccggtgcgggcaagggcacgtctcaccaccacaaatcgtgcctttcagctgcggggcaaaagcctgtccacttatcagaatcatgtctccaggtgccacgtggccctggttttccattaaggcctcggtgtaaagttctccttcaagtaagtcaaaagtgaactgccataaacaagtgtgtcagrcgcccacaccaagccaaccccgtgaggccaggacctggccctggtcccccacaggtgcacctcacgtctgtatcagctgacctctgctcccagaggccaggcctggcagagtgcacgtggaaaggccatctgctgctcaggtggggtggggatgcagcgcatgcagagggcagctgagcagccttgtggggcggggtcgccgtcccatctgcactgggctgacagttggacaattgtgcctcgccacagggccggcttgggagggtggcagggggtctgcagagggtctggatttgagaa

SEQ ID NO: 182050 - DNA, 601 bp, Human
ctgctgggcagtacctgtggcggtcagggggcacacctcaccccacaggcctgagggcagcccacgtgcctgctgctgctctagcggcacccaggtggcccagggagggcacaggcaggaacggacgctgctggaggccggggtcacaccacaggtggccagcggcgggtggctgcaggtaccagcctcaggtccccatcagccgcgtgccctggcaggagggcgtgcaggccaagcccacagtgagggaagggcagagggaaaagcaggtgtccttgagggggctgagagcagccagggktgaaacacgcgtgggagggaggatgggatggagccgaggcccagcccctgagcccagggaccccagcatccccggcggcaggttaccctagacgaaagcagctggcaggagccatgagtggacctgacacgttccagatggagcaccccagaccacaggacttcatccacgaggcaacatgcacccaaccttggggaccatcccgccagcacccccgccccacacggccagggcacgtggtggagcagcagcagcacgaagcacactcgagggcgtgtctctttcagtcctgattctgcc

SEQ ID NO: 182051 - DNA, 601 bp, Human
acagtggccctccactaagagcagagatgccatctggtcagtgggtggcagggagagggacggactggccaggagcagaaggcatttcatgaggggtcaaggagatggctccgccgctccagccccagccccgccaccgacagccggagccagggcaagaccctgtcctcgcctagaaagtgacccagcctggcggttagcagtgctggccgtgggacgagacacaatcacaccgcacggtgctctgagctgggcacgcgggaagggcagcacctccactgtcccaatagcacactcctcrgctgcacatcagtttcacaattctagggtctgggagggttggggtccggcttccggccaggagacacagggaacaagaggcatgccgagcgtcagccatgtgggagcagaggacggggtcagcggctgggatgggcaggtgagcaggcccagggccctgggatggggtgtcggggtgaccagctgggctggcagcctgtgagagcgcttttccaggctcttcctgtgcagatgtgccttatggacaaggaccccacagctccaggaggaaactgcttcggatacggccgctcccgcctcc

SEQ ID NO: 182052 - DNA, 601 bp, Human
ttctggaatctactttttaatccgttaatgtacaacatgagagggcaggcagatgggatttaaacatttttgctctagagacttttcttattttgttattttaagggaaacgccacacataatgctcacccctataaataaccttggcggtggacagtggccctccactaagagcagagatgccatctggtcagtgggtggcagggagagggacggactggccaggagcagaaggcatttcatgaggggtcaaggagatggctccgccgctccagccccagccccgccaccgacagccggrgccagggcaagaccctgtcctcgcctagaaagtgacccagcctggcggttagcagtgctggccgtgggacgagacacaatcacaccgcacggtgctctgagctgggcacgcgggaagggcagcacctccactgtcccaatagcacactcctcggctgcacatcagtttcacaattctagggtctgggagggttggggtccggcttccggccaggagacacagggaacaagaggcatgccgagcgtcagccatgtgggagcagaggacggggtcagcggctgggatgggcaggtgagcagg

SEQ ID NO: 182053 - DNA, 601 bp, Human
atgatatccaaggcctggtggaatggcttaatttctggaatctactttttaatccgttaatgtacaacatgagagggcaggcagatgggatttaaacatttttgctctagagacttttcttattttgttattttaagggaaacgccacacataatgctcacccctataaataaccttggcggtggacagtggccctccactaagagcagagatgccatctggtcagtgggtggcagggagagggacggactggccaggagcagaaggcatttcatgaggggtcaaggagatggctccgccrctccagccccagccccgccaccgacagccggagccagggcaagaccctgtcctcgcctagaaagtgacccagcctggcggttagcagtgctggccgtgggacgagacacaatcacaccgcacggtgctctgagctgggcacgcgggaagggcagcacctccactgtcccaatagcacactcctcggctgcacatcagtttcacaattctagggtctgggagggttggggtccggcttccggccaggagacacagggaacaagaggcatgccgagcgtcagccatgtgggagcagaggacg

SEQ ID NO: 182054 - DNA, 601 bp, Human
gaggctgagtgagcccgccgggtcacagagagcctcagggccagccatcggcttctgcactgtgtttacagcaatgtcctggggacatcaaacagcccctctgtgggcaagctctcctggctgatggcctgctcgactgggggaggctcctcctcagggccagcccagggaacccctgcagattccgaaagaagcggctcagaggcaggggtcctcctaggacctcagggacccccgacccccagacacaggaggctgcgtgggggcatgacagccccagcccctggccggggcacaggtyctgcccacagcccagagtcaaaatggtagacagccagcagagaggctctccccagaccccacggctctctggaaaagggcggccaggggtcctagaagcctcacccacctccgaatgaatggagcatgcctcatttcctcttccaccaggagctggctctgcaggctggggcctcatcaggcacctcctggtcttagttgagggtctgagcgcagagctcccccttggcagccacccagagccctcccgctcctctccctgcacctcctcaacggcccctactccctcttcctcagcctt

SEQ ID NO: 182055 - DNA, 601 bp, Human
cccgaccgtcccggcagcctgggagcgttcgcctgcggaaagctggcagtggccacagaaggaatcgttattaacaagcctgttcatctaagcttctctatttttatctctttcttgggacagagtcttgctctgtcgcccaggctggagtgcagtggcaccatcttagctcattgcaacctccacctcccaggttcaagcagttctcctgcctcagcctcccgagtagctgagattacaggtgcgtaccaccatgtctggctaatttttgtatttttagtagagatgggggtttcaccaygttgggcaggctggtctcgaactcctgacctcaggtgatctgcccaccttagcctcccaaagtgctaggattacaggcaccagccaccacacccagccagcttctctatttttaatagaatcaaaacatggttttatttcattttaaacaatatggaaaacacagctgtaacccatacacattcacaccagcacaagcttcttccatccttcctggagagagacaaaaacagaagacacagaaaggaagggcaggatcagggacagcaggttcgtgggagggactgttcgtgggggaacc

SEQ ID NO: 182056 - DNA, 601 bp, Human
cctctggctcccgaccgtcccggcagcctgggagcgttcgcctgcggaaagctggcagtggccacagaaggaatcgttattaacaagcctgttcatctaagcttctctatttttatctctttcttgggacagagtcttgctctgtcgcccaggctggagtgcagtggcaccatcttagctcattgcaacctccacctcccaggttcaagcagttctcctgcctcagcctcccgagtagctgagattacaggtgcgtaccaccatgtctggctaatttttgtatttttagtagagatgggggtttcaccatgttgggcaggctggtctcgaactcctgacctcaggtgatctgcccaccttagcctcccaaagtgctaggattacaggcaccagccaccacacccagccagcttctctatttttaatagaatcaaaacatggttttatttcattttaaacaatatggaaaacacagctgtaacccatacacattcacaccagcacaagcttcttccatccttcctggagagagacaaaaacagaagacacagaaaggaagggcaggatcagggacagcaggttcgtgggagggactgttcgt

SEQ ID NO: 182057 - DNA, 601 bp, Human
ctgcggcagacacagcccgcccgaggtgatggctgctgacggcttcctgccccaacactgcctggtgggacccctctccccaacacgcccctgtcccatgtcccactgcatcgtcctctctgaacagggacctctggctcccgaccgtcccggcagcctgggagcgttcgcctgcggaaagctggcagtggccacagaaggaatcgttattaacaagcctgttcatctaagcttctctatttttatctctttcttgggacagagtcttgctctgtcgcccaggctggagtgcagtggcacsatcttagctcattgcaacctccacctcccaggttcaagcagttctcctgcctcagcctcccgagtagctgagattacaggtgcgtaccaccatgtctggctaatttttgtatttttagtagagatgggggtttcaccatgttgggcaggctggtctcgaactcctgacctcaggtgatctgcccaccttagcctcccaaagtgctaggattacaggcaccagccaccacacccagccagcttctctatttttaatagaatcaaaacatggttttatttcattttaaacaatatggaaaac

SEQ ID NO: 182058 - DNA, 601 bp, Human
tctccaacctggccattccccttccaggaatccacctgagggtcattattagaatttggaaacaaaaatgtaggtagaagggcattcatctcagtgttttcctcgtgtaagaaaaatggaaatggtgactttacccatagactggggatgggttgtaaggcccaccactcatgaccgggagtgaccacctgcatctgtgagtgaccatctgcatctgtgtctggcatcaacccaacacagacaagcagaaaatgctgggattccccgtagcaaacagcagttttctgctttgcacgctgckgcaccgtgttggatttttttgcgatgggcatcaatgactttataactaaaacctttcaggcgttgtccccctggctgcagcaatgggacagcacaatggcagaggccctggccctttccacagtgctggcaggtcagtgggggggcccaagcaagatcacgctgggccttcacgagccagggacggcaagagcccagtgtgggcctcggggagcctggagaaggcggccacacaggagcagaaggggccccgagtatggcaggggcgggagagaggggtgggccgggctgcccatgccgg

SEQ ID NO: 182059 - DNA, 601 bp, Human
atgatacagatgaatgctccccagatcagcagggaggaaagcgagtcccaacagagtcaggagacacacaggggccactcagtccacagcaggccggccggcctcactctggttaaggaaaggctgggagcccagccggcccgtcaggggctcagggagggtggggaggccactccaccatcctgacggggaggaagcccgcatgccggcctgcaggatacctgcaatattgacagaaacctgctttcaaaagcacgtactctccaacctggccattccccttccaggaatccacctgagrgtcattattagaatttggaaacaaaaatgtaggtagaagggcattcatctcagtgttttcctcgtgtaagaaaaatggaaatggtgactttacccatagactggggatgggttgtaaggcccaccactcatgaccgggagtgaccacctgcatctgtgagtgaccatctgcatctgtgtctggcatcaacccaacacagacaagcagaaaatgctgggattccccgtagcaaacagcagttttctgctttgcacgctgctgcaccgtgttggatttttttgcgatgggcatcaatgactt

SEQ ID NO: 182060 - DNA, 601 bp, Human
ccgggcaggccctggaggtgagtggcagcgggcagggtgggcccaggaggtgagaggcagccaggcagggcaggccctggaggtgagtggcagcaggttaggacgggccctggaggtgagtggcagcgggcagggtgggccctggaggtgagtggcagccaggcagggcgggccctggaggtgagtggcagtcagttactgcgggccctggaggtgagtggcagccgggcagggcgggccctggaggtgagtggcagccagttactgcaggccctggaggtgagtggcagcagggcagggygggccctggaggtgagtggcagccaggcagggcgggccctggaggtgagtggcagtcagttactgcgggccctggaggtgagtggcagccaggcagggcgggccctggaggtgagtggcagtcagttactgcgggccctggaggtgagtggcagcagggcagggtgggccctggaggtgagtggcagccaggcagggcgggccctggaggtgagcggtggcatgaacatgtccaggaatgaaggcaccacattcctgacatggagaggtgacacgccaggcttctggtgctctgcaaaga

SEQ ID NO: 182061 - DNA, 601 bp, Human
aggccctggaggtgaatagcagctgggtatgcccgggcaggccctggaggtgagtggcagcgggcagggtgggcccaggaggtgagaggcagccaggcagggcaggccctggaggtgagtggcagcaggttaggacgggccctggaggtgagtggcagcgggcagggtgggccctggaggtgagtggcagccaggcagggcgggccctggaggtgagtggcagtcagttactgcgggccctggaggtgagtggcagccgggcagggcgggccctggaggtgagtggcagccagttactgcrggccctggaggtgagtggcagcagggcagggtgggccctggaggtgagtggcagccaggcagggcgggccctggaggtgagtggcagtcagttactgcgggccctggaggtgagtggcagccaggcagggcgggccctggaggtgagtggcagtcagttactgcgggccctggaggtgagtggcagcagggcagggtgggccctggaggtgagtggcagccaggcagggcgggccctggaggtgagcggtggcatgaacatgtccaggaatgaaggcaccacattcctgacatggagagg

SEQ ID NO: 182062 - DNA, 601 bp, Human
aggaattaataaagttccagccagtgcactaagtcaagaaaaagaaataaaagatatacagatcagaaaggaagaaatatttgcagatgacataattatctacgtagaaaatctcaaggaatttaaaaaacaaaggccaaaaaatggaaaagcctcctacaacaaataagtaatctcagcaaaattgcagtatacaagataaacacacaaatatatcaactacatttctatacactagcaacgaacatgtatacactgttatggaatgaattgtgaacccatcacccaattcatatgttgragccctaacccacaatgtcactgcatttgaagacagggcctttcaaaaggtaattacggttaaatgaggtcacaaggatggcatcttactccaacctgactggatgtccttataagaagacagacactagccgggcatggtggctcatgcctgtaaccccagcactttgggaggctgaggcgggtggatcacctgaggtccagagttcaagactagcctggccaacatggagaaaccccgtctctactaaaaacatgaaattagccaggcatggtggcacatgcctgtaatcccagctac

SEQ ID NO: 182063 - DNA, 601 bp, Human
acagaaactaaaaacagagaataaatgaaaaattaaaaacgaaatggcagacttaggccctaatatacaaattatcacattaaatataaatggtctaaatacaccaactgtaagacagagattagcaaagtcgatttaaaaacatgactcaactacgtgctgtctacaagaaactcacttcaaatataccaagataggaaggttgaaagtaaaacgatggaaaaagatgtatcatgtgaacattaatcaaaggaaagcaggggtggctatattaacatcaggtaaaataaacttctgagcmaaaaaaaaaaaaaaaaaaaaaaagaccagggacagcagagacagagaaggacattatataatcccactattacacaattgacaagagggtcagtccaccaaaacaaatttcaatccctaacgtgtatgcaacaaacaaaagagctgccaatatgtgaagcaaaaacacaacagaactgaaaggagaaacagatccacaattatacttaggagacttcaataccccctctcaataataaaactagacagaaaatccacaagaactgagaggaaatcaataccatcagccaacaggatctga

SEQ ID NO: 182064 - DNA, 601 bp, Human
tgtcagacaacaccagtgggcactagagctttcactcccactggttggtaaagacacccaccctcacccccaaggagtcagcagagaccacagggaagcccaagatgtcacccccaaagcctcatggagtcagtggagaccatgtggggagcctagtcacccccgaagcctcacggagtcagcagagaccatatggggagcctggcctcttatcctcacccagtagtaagagcgtgcctgtcctgtccccctccatgctggggggtgtcagaggaggtcaagcgggagtccagactttcayctacccagcaataatgagaatgtcccaaccccaggggcatcaagggggccacgaggggagctggactcccatccttgcctggcaacaagaaggagcccccacccagccacccaccctccctcaggtgtcacaaaggctgagtgagagcctggacttccaccccacctgcctgtagcgaggtgcacaccccgcttgacctgcaggagttgcgtcagccacaacaggatgctgaaattacatcatacccaaaatgcttgcatctcactaaaaaatcccttggcacactaaaccacaaagatc

SEQ ID NO: 182065 - DNA, 601 bp, Human
gcagagggttcaggaggctgcagtgccctcaggacatccgtgggcagagcccagtgagtcccgcccaagacccctgaggccccagctccacatccgcaggccagaatccctgcagcccatcggcaccggcacccttccaggacagctgtttttaaagcaaactgaggaagatggggctgacacgcttctccctgctcttctcctacccaagacactgagataaacacctgggaagactctgaaagcaggagcgaggaggacagactgaccaggccctcggggtctggggagctgtgccacrcaagggcagactggccgggccctcggggtctggggagctgtgccacgcaaggacagactgtgccacgcagagctccctgggggcttttcttttcacctcagatattttgaaactgaagaaggcagcaggctggaaaagacaacagatgcagaaaaaagagcccatggaagcagctctctctggcctaagacccagggaagggtcagcccaacatgaggaaagacctttcgacaggaatcgccctgctccccgcaaacaccagacctcggctccacccaccatgtcagcaaggacccccca

SEQ ID NO: 182066 - DNA, 601 bp, Human
caagaacccctcggaacctggcaggtggcctgcttctgcgtggcctgcggtgtctgctcccgagtcccctgcttggtggtgcttgctgcccccccatggtgctgagacagcggaagggtgcccatgagggccagaacgtcccgcctggcagagcagggtgaggagagccacagcaggtgaccaggagctgatccccagggcttcgcgcccagagcaacccccagcagcctgcacatggagcccgtctccatctcggcagcggaagctgtgctacgatgaccagaaggagcagcaccagcgktggccacatctctcctgattctcgcagctgccaggggcaggagggactggagatgtccctgggacaccagggagggacctgatcattcccggaggtgcagagggttcaggaggctgcagtgccctcaggacatccgtgggcagagcccagtgagtcccgcccaagacccctgaggccccagctccacatccgcaggccagaatccctgcagcccatcggcaccggcacccttccaggacagctgtttttaaagcaaactgaggaagatggggctgacacgcttctccctgctcttctcct

SEQ ID NO: 182067 - DNA, 601 bp, Human
gaggccagccccaggagcaggtgccacagtgctcaccacagcccccccgacctccaccacctggcacaggcctgaaggggggttcccaccatttcccaagaacccctcggaacctggcaggtggcctgcttctgcgtggcctgcggtgtctgctcccgagtcccctgcttggtggtgcttgctgcccccccatggtgctgagacagcggaagggtgcccatgagggccagaacgtcccgcctggcagagcagggtgaggagagccacagcaggtgaccaggagctgatccccagggcttcrcgcccagagcaacccccagcagcctgcacatggagcccgtctccatctcggcagcggaagctgtgctacgatgaccagaaggagcagcaccagcgttggccacatctctcctgattctcgcagctgccaggggcaggagggactggagatgtccctgggacaccagggagggacctgatcattcccggaggtgcagagggttcaggaggctgcagtgccctcaggacatccgtgggcagagcccagtgagtcccgcccaagacccctgaggccccagctccacatccgcaggccagaatc

SEQ ID NO: 182068 - DNA, 601 bp, Human
cgcctgctcccaggctcaccctcctccagctcagaggctgaccctgaacactgcacagcggtcagaggccagccccaggagcaggtgccacagtgctcaccacagcccccccgacctccaccacctggcacaggcctgaaggggggttcccaccatttcccaagaacccctcggaacctggcaggtggcctgcttctgcgtggcctgcggtgtctgctcccgagtcccctgcttggtggtgcttgctgcccccccatggtgctgagacagcggaagggtgcccatgagggccagaacgtcycgcctggcagagcagggtgaggagagccacagcaggtgaccaggagctgatccccagggcttcgcgcccagagcaacccccagcagcctgcacatggagcccgtctccatctcggcagcggaagctgtgctacgatgaccagaaggagcagcaccagcgttggccacatctctcctgattctcgcagctgccaggggcaggagggactggagatgtccctgggacaccagggagggacctgatcattcccggaggtgcagagggttcaggaggctgcagtgccctcaggacatccgtggg

SEQ ID NO: 182069 - DNA, 601 bp, Human
caggcaagcctggcacataccaaggccagcacgtccgcggtgaccgggaccagtcccctccgggctggcacaagtgtgggagcagctgaggacccgcaggtcaggatggacacacttcagaaggacagacaggaccatggagggctgcccttagggtgggagagaggaaccagctccgaggaccagagccgctgctcccctctgatgacaatgtgtctgccgccaacctgagatggcttttccacagagacagagaagccacatgcagttcttcattctacgtcagttaaaaaaaaaaaaagcatctttcaaaaaagcaagagcaccaaggatgaccagcaatgtcacagctcagctacacctgagggtcccggctcccaccctgccctagagggctcacaactcctgtggggccagtgtcccctgagctggtatccaagaggccacttcactagccctggggggcagaaaggatttgtctcaagccccccaaggggcatgagccagtgaggcctggtggacgcagaagcccaccacccacctcttccagcaacaaagcccgcggggcacagtgcagggacagcatggccaggcagctgcc

SEQ ID NO: 182070 - DNA, 601 bp, Human; identical to SEQ ID NO: 30663

SEQ ID NO: 182071 - DNA, 601 bp, Human; identical to SEQ ID NO: 30664

SEQ ID NO: 182072 - DNA, 601 bp, Human; identical to SEQ ID NO: 30665

SEQ ID NO: 182073 - DNA, 601 bp, Human; identical to SEQ ID NO: 30666

SEQ ID NO: 182074 - DNA, 601 bp, Human; identical to SEQ ID NO: 30667

SEQ ID NO: 182075 - DNA, 601 bp, Human; identical to SEQ ID NO: 30668

SEQ ID NO: 182076 - DNA, 601 bp, Human; identical to SEQ ID NO: 30669

SEQ ID NO: 182077 - DNA, 601 bp, Human; identical to SEQ ID NO: 30670

SEQ ID NO: 182078 - DNA, 601 bp, Human; identical to SEQ ID NO: 30671

SEQ ID NO: 182079 - DNA, 601 bp, Human; identical to SEQ ID NO: 30672

SEQ ID NO: 182080 - DNA, 601 bp, Human; identical to SEQ ID NO: 30673

SEQ ID NO: 182081 - DNA, 601 bp, Human; identical to SEQ ID NO: 30674

SEQ ID NO: 182082 - DNA, 601 bp, Human; identical to SEQ ID NO: 30675

SEQ ID NO: 182083 - DNA, 601 bp, Human; identical to SEQ ID NO: 30676

SEQ ID NO: 182084 - DNA, 601 bp, Human; identical to SEQ ID NO: 30677

SEQ ID NO: 182085 - DNA, 601 bp, Human; identical to SEQ ID NO: 30678

SEQ ID NO: 182086 - DNA, 601 bp, Human; identical to SEQ ID NO: 30679

SEQ ID NO: 182087 - DNA, 601 bp, Human; identical to SEQ ID NO: 30680

SEQ ID NO: 182088 - DNA, 601 bp, Human; identical to SEQ ID NO: 30681

SEQ ID NO: 182089 - DNA, 601 bp, Human; identical to SEQ ID NO: 30682

SEQ ID NO: 182090 - DNA, 601 bp, Human; identical to SEQ ID NO: 30683

SEQ ID NO: 182091 - DNA, 601 bp, Human; identical to SEQ ID NO: 30684

SEQ ID NO: 182092 - DNA, 601 bp, Human; identical to SEQ ID NO: 30685

SEQ ID NO: 182093 - DNA, 601 bp, Human; identical to SEQ ID NO: 30686

SEQ ID NO: 182094 - DNA, 601 bp, Human; identical to SEQ ID NO: 30687

SEQ ID NO: 182095 - DNA, 601 bp, Human; identical to SEQ ID NO: 30688

SEQ ID NO: 182096 - DNA, 601 bp, Human; identical to SEQ ID NO: 30689

SEQ ID NO: 182097 - DNA, 601 bp, Human; identical to SEQ ID NO: 30690

SEQ ID NO: 182098 - DNA, 601 bp, Human; identical to SEQ ID NO: 30691

SEQ ID NO: 182099 - DNA, 601 bp, Human; identical to SEQ ID NO: 30692

SEQ ID NO: 182100 - DNA, 601 bp, Human; identical to SEQ ID NO: 30693

SEQ ID NO: 182101 - DNA, 601 bp, Human; identical to SEQ ID NO: 30694

SEQ ID NO: 182102 - DNA, 601 bp, Human; identical to SEQ ID NO: 30695

SEQ ID NO: 182103 - DNA, 601 bp, Human; identical to SEQ ID NO: 30696

SEQ ID NO: 182104 - DNA, 601 bp, Human; identical to SEQ ID NO: 30697

SEQ ID NO: 182105 - DNA, 601 bp, Human; identical to SEQ ID NO: 30698

SEQ ID NO: 182106 - DNA, 601 bp, Human; identical to SEQ ID NO: 30699

SEQ ID NO: 182107 - DNA, 601 bp, Human; identical to SEQ ID NO: 30700

SEQ ID NO: 182108 - DNA, 601 bp, Human; identical to SEQ ID NO: 30701

SEQ ID NO: 182109 - DNA, 601 bp, Human; identical to SEQ ID NO: 30702

SEQ ID NO: 182110 - DNA, 601 bp, Human; identical to SEQ ID NO: 30703

SEQ ID NO: 182111 - DNA, 601 bp, Human; identical to SEQ ID NO: 30704

SEQ ID NO: 182112 - DNA, 601 bp, Human; identical to SEQ ID NO: 30705

SEQ ID NO: 182113 - DNA, 601 bp, Human; identical to SEQ ID NO: 30706

SEQ ID NO: 182114 - DNA, 601 bp, Human; identical to SEQ ID NO: 30707

SEQ ID NO: 182115 - DNA, 601 bp, Human; identical to SEQ ID NO: 30708

SEQ ID NO: 182116 - DNA, 601 bp, Human; identical to SEQ ID NO: 30709

SEQ ID NO: 182117 - DNA, 601 bp, Human; identical to SEQ ID NO: 30710

SEQ ID NO: 182118 - DNA, 601 bp, Human; identical to SEQ ID NO: 30711

SEQ ID NO: 182119 - DNA, 601 bp, Human; identical to SEQ ID NO: 30712

SEQ ID NO: 182120 - DNA, 601 bp, Human
ccggctgttcgaccagtttttcggcgagggcctttttgagtatgacctgctgcccttcctgtcgtccaccatcagcccctactaccgccagtccctcttccgcaccgtgctggactccggcatctctgaggtaagacgtggcccgtggtgctggcctctcctcgctgctcagagggtggtggcctcggtgggtggagagcgatggactctggtcttgctccgtcaggcaggtggcctcgtcccacttcatccccttgcagaggctgggcgagagcctgtgtccccactgcagccacgtggyagagcttcccctggcactggggagagggtggacaagggagcagcctgaatccacctttgctttcctccatcagctcatgacccatgtgtgctttgtaaggcaccagccacatactggaaaccccaagagcagcccatccaggcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggctagcaaagctctt

SEQ ID NO: 182121 - DNA, 601 bp, Human
tcccggagacctgggagcaggtgggggtcatagtcctgaaagccagagagcagggcgttcctagcacctcctccaatgagctcggcctgcccacggctagcaaagctcttggcaagtttacttaggtgccctgccaaggctaaaaggacaggcaatggacgccccccccccccacccaaccacaggcctcctctctgagccacgggtgagcggtgcaggttctgctgttctggagggcctgagtcccacccagcacctcataaacagggtcctccccagggctgctgcagtaggcatcaaygccagggtgcaaaatgcctcagggagccaaggctgagccaggggagtgagaaggagcatgtggaagtgcgttttggagaggcagctgcgcaggctgtcagcaggctccggccgcttctatagacagcatgacaccaagggcagtgacctcattccacaggctgagtccagccagccagccaagcatcaccagccagacgattgaccctaacggaccaaccaacccgtaacgacccctcctaccataaccagtagccagccagcccataaccagccaacttatctataaccagccacctga

SEQ ID NO: 182122 - DNA, 601 bp, Human
gaatgctttacaggcattgacaccttcgcctcacagcagcactttggaaccagtgtcctcattattccagggcacggctggggaacaagggggtcctcagcctgctgggtcccacagctagtaccgggcaggtggacgggagcttctccccacagtcaccctgatgccccgctcttgctcggctggaggcctcggatctccgtggtgttgagggagccggggcactggagccctggtgacctgcatctcctggcggagccgggaagagctcatggactgtcacagatggacagtgccccgygggggctggagagcagagtggggctggaaggtggaactcttagccaaagtcttggtttcttttggccagggtcctctttcaatggctggagaaggtggtgctggggggtgaacgctgacctcctcatgtgctgcccctccctcgcctgggcccggtaaagcccccacgtagccccagccagcctggaacatgcttcctgagctcccagctcttggtctttgcacccagtggaggaggaggtcagcccagggagctgagtctgcggtttagggcgtccaggggacgtggaagcatgtgggt

SEQ ID NO: 182123 - DNA, 601 bp, Human
aggtggacgggagcttctccccacagtcaccctgatgccccgctcttgctcggctggaggcctcggatctccgtggtgttgagggagccggggcactggagccctggtgacctgcatctcctggcggagccgggaagagctcatggactgtcacagatggacagtgccccgcgggggctggagagcagagtggggctggaaggtggaactcttagccaaagtcttggtttcttttggccagggtcctctttcaatggctggagaaggtggtgctggggggtgaacgctgacctcctcatgygctgcccctccctcgcctgggcccggtaaagcccccacgtagccccagccagcctggaacatgcttcctgagctcccagctcttggtctttgcacccagtggaggaggaggtcagcccagggagctgagtctgcggtttagggcgtccaggggacgtggaagcatgtgggtcgtctggccacattaggtagggctgcagagacctgggctagagcagtcctgcggggtctggaaggggaagactggctgaggtgcggggcctggtctggaatgatcctgcgattttggagtgaagccatg

SEQ ID NO: 182124 - DNA, 601 bp, Human
aagatcccaactctgctaccagctgcttgggcttgggcaagtcaccctagctctcagatgtcatctgtaaatgatgacaatgccaatgtggcactgttctgagagtcagacagaacgtatgtgtgcttcacatatggtgctcatgaagtgctatcattatctaaggaaaacagaaaacgaagttcagagtctctctaaacgcatgacaccagaccaacagggagtttcaaaaaataggtctgaagtaaatcaattctcctggtctcaatacactgaaaacaaactattaggggactgaccraacccaccttaggaaccaccttacgtcaccttctgtctctactgcaaaaccctcccttaatactgttcaaatacgctgacaatccagatccatatccaatggaaccagcaatcatgcctgtgtgccagcaatgtcagggagggaagccgatctctgatgaattaggacatcttaccagacagactttgttcaaaattcaatttttttttaaccaagtgccattatgttttaaacagtcaatccagagttaagattgaagggcctcaacctcagtgaaatctaatggaccatgaagactga

SEQ ID NO: 182125 - DNA, 601 bp, Human
actacttgttcagcaaagacggttctaactctaacccgcctcctcctcattcaaatcccctccactttcctaactgcacagctgttctgtttgtttcttaaatggagtattaaattagtctaaaactaaatgtaacttaggcagtatctgttctccagttctccacgaccaagttctctcttgaaaacaccggtgtggtgagggttaagatcccaactctgctaccagctgcttgggcttgggcaagtcaccctagctctcagatgtcatctgtaaatgatgacaatgccaatgtggcacygttctgagagtcagacagaacgtatgtgtgcttcacatatggtgctcatgaagtgctatcattatctaaggaaaacagaaaacgaagttcagagtctctctaaacgcatgacaccagaccaacagggagtttcaaaaaataggtctgaagtaaatcaattctcctggtctcaatacactgaaaacaaactattaggggactgaccgaacccaccttaggaaccaccttacgtcaccttctgtctctactgcaaaaccctcccttaatactgttcaaatacgctgacaatccagatccata

SEQ ID NO: 182126 - DNA, 601 bp, Human
tacttttaacctcacagaaacatgacacagacttttttccgtggtattaagcacctcctcttccttgctgtattttaggacaacgtaacttcaacttccctttctgcaaacacactacttgttcagcaaagacggttctaactctaacccgcctcctcctcattcaaatcccctccactttcctaactgcacagctgttctgtttgtttcttaaatggagtattaaattagtctaaaactaaatgtaacttaggcagtatctgttctccagttctccacgaccaagttctctcttgaaaasaccggtgtggtgagggttaagatcccaactctgctaccagctgcttgggcttgggcaagtcaccctagctctcagatgtcatctgtaaatgatgacaatgccaatgtggcactgttctgagagtcagacagaacgtatgtgtgcttcacatatggtgctcatgaagtgctatcattatctaaggaaaacagaaaacgaagttcagagtctctctaaacgcatgacaccagaccaacagggagtttcaaaaaataggtctgaagtaaatcaattctcctggtctcaatacactgaaaacaa

SEQ ID NO: 182127 - DNA, 601 bp, Human
ggtcaagtcagccagcaaccaagaagaaactgtattgttttgattagtcccacgttttcaatgttaaagtgttttaatgcaagataaatagtagaatactaatattttcttgtacttcaagctagcagacaccaagatgtggaaaaattcacgttataatcatattcctcacacaagataatttttcaaaaccaaatgcgtaactcagctgtctgcagtacatcaagttctctggtctcctagcaaaacaggcacaccaaacaggtctgtcaactgtcatggacacccggctctgatttayactttcttggtgggatctctgtttacataatacaatagcttaaaacatttgctcttttccgatccttcttttaaggaaaaaaaatccttttagcccttgtgctttaaactggatcaggcagacttgaaaccttacactgtaccgttcttcttaaaatcaagttgtctgaaaaaacaaaccatgtttaagttagtaggctaatatattacatgaatcttaacgtccatatcactgtaagcagcttataaagaaacccaccctgaattatgctagagatttacaagctaaagcaatcactcg

SEQ ID NO: 182128 - DNA, 601 bp, Human
gaggaactcaggggtcagtgcaagctgcagaccctcatttggggaacgctctcagcacaatgctcttacaactacagggtgcactccaaaatggagttcaaggaaaaaaggctaatgagaaataaaatctgaaaaaataacttaaaaagtttgctttttaaaaattccagaaagtgagagaaacattcaaattttgttgctctaagagggaagaatatgactcgacgtttaattccagtacattccctctaggatgacggccaaagtaaaggaagaaggggcagcagcagctccagactgtttttttttttttttttggagacggagtctcactctgtcgcccaggctggagtgcagcggcacgatctcagttcactgcaacctccgcctcccgggttcaagcgattctctgcctcagcctccctagaagctgggattgcaggcatctgccaccacgcccagctaatttttgtatctttagtagagatggggtttcaccatgttggccagattggtcttgaactcctgacctcatgatccacccgcctcggcctcccaaagtgctgggattacaggcgtgagccaccgcgcccggcccagc

SEQ ID NO: 182129 - DNA, 601 bp, Human
taaatggagcaaaccaattccatctcctagagctggagactgtatccaggcagtgtgtggacagaacggacaatcttttctgccaagggcctatttgagtggagcacccccacacgggttagacgggtcggcacggggctggtgggtgaggaactcaggggtcagtgcaagctgcagaccctcatttggggaacgctctcagcacaatgctcttacaactacagggtgcactccaaaatggagttcaaggaaaaaaggctaatgagaaataaaatctgaaaaaataacttaaaaagtttgstttttaaaaattccagaaagtgagagaaacattcaaattttgttgctctaagagggaagaatatgactcgacgtttaattccagtacattccctctaggatgacggccaaagtaaaggaagaaggggcagcagcagctccagactgtttttttttttttttttggagacggagtctcactctgtcgcccaggctggagtgcagcggcacgatctcagttcactgcaacctccgcctcccgggttcaagcgattctctgcctcagcctccctagaagctgggattgcaggcatctgccacc

SEQ ID NO: 182130 - DNA, 601 bp, Human
cgcctattgatcttatttccttaaaaaacaaaagaaaacaaacaaacaaaaaaacaggtattttaaaccaagggttaccaagtaaatcctgctaccatccgactcagggaaagaaatctctactatcaggtcagtattagcactgaaaagcatttagtgtcttggcaggaaaagttgacaagaaaatctcatccacacatagaaatgtgcaccactgtgcaaggaagcacaatccccaggccacccagtgcagggccagctcgagaggggaatgccccctgggatcagctaccccatgtcrgtcaccccattaactgaggggctctggttcaagggtgtactcaatttaggcttgtggatatccaagggcacctcaatttttactgctttaaaacagaatggtgaatgggaagtgcctatctttggtttggactttctgattttaacaagagtccaggtgttcattttaatttatccataaatgactaaattctaatgattctatagttggatggctgtaaaaatcaaattttagttttctgaacttcccaatcatactcatctatgatatctccttctctaaaaattatcattaggtaaa

SEQ ID NO: 182131 - DNA, 601 bp, Human
gcattaagatacaattaaaaacttatttgtgactcagcctatgttaaatactacaacttggaaaataaagcagttttcttacagaaatatcattcttaaactgggattgatagttaactttaacccacgcatttgaagcttatttttttacatactaaagggtatgttgaaaagagccagtaattttaggtaattgatttcttcctaaaatgacgaattagaatttcatctaatttgtacaatctggactccagaattggaatataacgtaattgctaaacttttagtttgtagcatatgsaaaacaaaagtgctgtgaactgcaaataaagacacaatgaaaactaatacaacattctattgtcagtcaagaaagcatatacagtccccaaataaacgatcagggcaaagaattaattactgttactcagtcatgtacttccattcacttttatcccagggcagggttgttaacaaaaattatttaataagtgcatatagaaacaatttccctccgcctattgatcttatttccttaaaaaacaaaagaaaacaaacaaacaaaaaaacaggtattttaaaccaagggttaccaagtaaa

SEQ ID NO: 182132 - DNA, 601 bp, Human
ggctggcaaaagcctgactggtttccagattgggccggctgccttagcctgtgcacccaacgtgggcatctgactgctggcacacgggtctttgagcttgctcaaaactctttttatcttttttttttttttttttgagacggcgtctcactgtctccaggctggagtgcaatggcgtgatcttggctaatttttgtagttttagtagagacggggttccaccatgttggccaggatggtctcaatctctcgacctcgtgatccacttgcctcggctttccaaagtgctgggattacaggygtgagccaccgtgcccggccccctttttatctttgaagataaaaaataacttcttattttctaattctgagaatgatttaagttcactttctaacctatccggggctgttttagttatttttgaacttccaggaatctgctttcgaacccaaattttattaagtgtaactactcggacagcctgccaatcatatcacaggatatcccaattggaaagctattgggaatgtaccttcctccccgagtagaaatcaagttataaacggccaaagtagcctattccaaagggcagattttaat

SEQ ID NO: 182133 - DNA, 601 bp, Human
tgacctcacgtgatctgcttacctcagcctcccaaagtgctgagattacaggcatgagccactgcccccggcccactctatcaaattctagagttctctaaacctgagaaatcacagagctggtgtatcaacaaacatgttccaatcagctagattaggggctggcaaaagcctgactggtttccagattgggccggctgccttagcctgtgcacccaacgtgggcatctgactgctggcacacgggtctttgagcttgctcaaaactctttttatcttttttttttttttttttgagacrgcgtctcactgtctccaggctggagtgcaatggcgtgatcttggctaatttttgtagttttagtagagacggggttccaccatgttggccaggatggtctcaatctctcgacctcgtgatccacttgcctcggctttccaaagtgctgggattacaggcgtgagccaccgtgcccggccccctttttatctttgaagataaaaaataacttcttattttctaattctgagaatgatttaagttcactttctaacctatccggggctgttttagttatttttgaacttccaggaatctgct

SEQ ID NO: 182134 - DNA, 601 bp, Human
ctgatgaaagcattcttttttttttcttttttttgagacggagtctcactctgtcgcccaggctggagtgcggtggcgcaatctcggctcactgcaacctccgcttcctgggctcatgcgattctctgcctcagcctcctgagtagctgggattacaggcgcccacaaccacgcccggctaatttttgtatttttaatagagatggggtttcaccatcttggccaggctagtcttgaactcctgacctcgtgatccacctgcctcggcctcccaaagtgctgggattacaggtgtgagccrccgtgcccggcgcaagtattcttaagttttatattcccaaactattttcatcagtttattcttcataattcacatgtattaggtaaaatcatgtctgttgcgtgggtaaatttggcaaatttacactctatccccatcatcattctatcaaatttaattaatttttttttcttttgagatggagtctctgtccactccaggctggagtgcagtggcgtgatcttggctcactgcaacctccacttcctaggttcaagcaattctccttcctcagcctcccaagtaggtgggactacaggc

SEQ ID NO: 182135 - DNA, 601 bp, Human
gcctgagcatccaggatctcaaggtgcatggcgacaggcaccccatcctctgtcggccttggccccggcacactaagcggctgcaccactgtctcgctttcgcctgttggccttggccctggcacactaagcggccacgccgccgtctcgccctggctcctaccttgacgtacacgttccccaccaggtggtctcccaggttgtcacagacgttcatctcctctacttccccatacttctcctccatttctgtaaaaacctcctgaagggagaccacagtggtttaagactcgttatacaytacaaagtgtcattagatataactcatgtatgtttattagcagagaaacattttaaatccttccaaacagatacagaagatcaacaggtctatcagtcacagagttcagttctctcacctcaaaaaactcatcatagtgttcctgcatctccacatcgctcacggcacctgcaaacaacagaaatcttgctggttagaacatgttaaccgagtgaactcttgtgtttaaactcaaactgctacagtaacacacacgagattatctagagaaaagcctggcagagctgcactctgcaggag

SEQ ID NO: 182136 - DNA, 601 bp, Human
tttccttagtccacacagcttctaaaccaacaggtactaaatattctacactgaaataacgatggctgtggtgtacggtccgtccttcagttctgctggctgggcgcacgtgtgggctggccaccgccacatatgacgcagctggtaggcgccgagccagtgcacctgagccctgctgtgcgcctgagcatccaggatctcaaggtgcatggcgacaggcaccccatcctctgtcggccttggccccggcacactaagcggctgcaccactgtctcgctttcgcctgttggccttggcccyggcacactaagcggccacgccgccgtctcgccctggctcctaccttgacgtacacgttccccaccaggtggtctcccaggttgtcacagacgttcatctcctctacttccccatacttctcctccatttctgtaaaaacctcctgaagggagaccacagtggtttaagactcgttatacattacaaagtgtcattagatataactcatgtatgtttattagcagagaaacattttaaatccttccaaacagatacagaagatcaacaggtctatcagtcacagagttcagttctctcacc

SEQ ID NO: 182137 - DNA, 601 bp, Human
tcaatgagattaacttcaagatagtccaagattttgccaaatgttgccttcatttttcaaattcaactggttaaaggagcaaatatggctgtgtaggcaaataaagttttattcactaaaaaagaaaaaagaaaccaaacatgtgagtaaacctaacttttccttagtccacacagcttctaaaccaacaggtactaaatattctacactgaaataacgatggctgtggtgtacggtccgtccttcagttctgctggctgggcgcacgtgtgggctggccaccgccacatatgacgcagcyggtaggcgccgagccagtgcacctgagccctgctgtgcgcctgagcatccaggatctcaaggtgcatggcgacaggcaccccatcctctgtcggccttggccccggcacactaagcggctgcaccactgtctcgctttcgcctgttggccttggccctggcacactaagcggccacgccgccgtctcgccctggctcctaccttgacgtacacgttccccaccaggtggtctcccaggttgtcacagacgttcatctcctctacttccccatacttctcctccatttctgtaaaaacctc

SEQ ID NO: 182138 - DNA, 601 bp, Human
tgcacacggccccgaactgtgctcagtcacgtcactggccactcctcactcaccccatctcatactgacggcagcaggcttctctgaagtccgtcacgggtgacagctcggcgtggatcggctgtccattaaaccaacggttattcaagtcaatcacagccttttccgcatcttcctcacggcgaaactgaaaagacaaaaacagaagtgcttgccatccacgctttaataagactttctcaattaccaatccaagtatatcagagagagatatacacactcaggtatagtaaggtggaayagtattacaggataattgaaaaatcctttattttcaatgagattaacttcaagatagtccaagattttgccaaatgttgccttcatttttcaaattcaactggttaaaggagcaaatatggctgtgtaggcaaataaagttttattcactaaaaaagaaaaaagaaaccaaacatgtgagtaaacctaacttttccttagtccacacagcttctaaaccaacaggtactaaatattctacactgaaataacgatggctgtggtgtacggtccgtccttcagttctgctggctgggcgcac

SEQ ID NO: 182139 - DNA, 601 bp, Human
ttctctgtgggtgggttggaaggagacatttactacctcgtgtgcacacggccccgaactgtgctcagtcacgtcactggccactcctcactcaccccatctcatactgacggcagcaggcttctctgaagtccgtcacgggtgacagctcggcgtggatcggctgtccattaaaccaacggttattcaagtcaatcacagccttttccgcatcttcctcacggcgaaactgaaaagacaaaaacagaagtgcttgccatccacgctttaataagactttctcaattaccaatccaagtagatcagagagagatatacacactcaggtatagtaaggtggaatagtattacaggataattgaaaaatcctttattttcaatgagattaacttcaagatagtccaagattttgccaaatgttgccttcatttttcaaattcaactggttaaaggagcaaatatggctgtgtaggcaaataaagttttattcactaaaaaagaaaaaagaaaccaaacatgtgagtaaacctaacttttccttagtccacacagcttctaaaccaacaggtactaaatattctacactgaaataacgatggct

SEQ ID NO: 182140 - DNA, 601 bp, Human; identical to SEQ ID NO: 35525

SEQ ID NO: 182141 - DNA, 601 bp, Human; identical to SEQ ID NO: 35526

SEQ ID NO: 182142 - DNA, 601 bp, Human
tccttaacttacacagtaagtacttaattttcagaatagagcttttcagttatcaaaagtataaaattcttctgccaatgaagagagagagaaagagaagctgttaatagatgctcagaaaactggcaaccaacttataccaacttacatatgtccaagtcactacactgaggaaacctccctttcttaggtcatcagactctcccaaatatcatcacaaggactgtaagagtaccttaaaattcgtttacaattatttacctagggtaaatctgctagaacaaattactgttaccaccartgactgctgaaaatgaagactcacttttttctacaatctttaatttctggaagctctccagcacctccccatttagtattctgggtaagaagtcccgtatttgcatcacttcagttgtcagccgttccagatccttctttctgactttaacaaattcctctttagttcccatgtgctaaaagaacaagcagatcttattatatttctcttcacatgagaaaaaaaacaacagctcaagttaacttgcttttctttcacacctcttatgtgcatcgttgtttcaaatcatgtctctaccta

SEQ ID NO: 182143 - DNA, 601 bp, Human
gataagtgaacacacttccagctatctctactgacaagtaaactccatgcaaggtttccatttggcaagatccttaacttacacagtaagtacttaattttcagaatagagcttttcagttatcaaaagtataaaattcttctgccaatgaagagagagagaaagagaagctgttaatagatgctcagaaaactggcaaccaacttataccaacttacatatgtccaagtcactacactgaggaaacctccctttcttaggtcatcagactctcccaaatatcatcacaaggactgtaagrgtaccttaaaattcgtttacaattatttacctagggtaaatctgctagaacaaattactgttaccaccaatgactgctgaaaatgaagactcacttttttctacaatctttaatttctggaagctctccagcacctccccatttagtattctgggtaagaagtcccgtatttgcatcacttcagttgtcagccgttccagatccttctttctgactttaacaaattcctctttagttcccatgtgctaaaagaacaagcagatcttattatatttctcttcacatgagaaaaaaaacaac

SEQ ID NO: 182144 - DNA, 601 bp, Human
ctattttgatggttatttccatgtggtaatttccagttgactctcatctcaaattaaaaacaatctatgattgtcttccataaactgttcattttccatccctaattctgctatacccccaatccttattccatacagcaatcaaacactagctgatgaacctgcaatcggtcctgctcaatcccatgtgtgactttcacatgccaccgccctggcctagaatatctccccttctcctcctaacaaatcatgcctctccccagtacccatcaactccctaagactctcaggcaacaccttygtcagtattattgcaaactgccatttaccttgcccagtcctcccaaagggagatgctgggctagagtcaaaatcaagccccattcgctacttgatgtgtcacctcaatcctctagctggcttacaagttactgtatagcccaagcccatccaaacaaaactatatccacactctaaaagaaacttctcaaatcaggtctactccttccctgcctgtattcattcctaccttcaggttgcctttagtcactgcttaagattggaagcacatggtgactcatgcctgtaattccagcacttt

SEQ ID NO: 182145 - DNA, 601 bp, Human
tggcacacaccttacagagcttatctcattttaagctttgccatagcctatgaggtaagcattactgtccacattttgtagacactaatcagcaggcagtatatagatgatcctgtatctccatactctcactgccgatcataaatcatgacactttgtcctgacttaaccaccaagactaatcaaacgtcccttccattccatccatacagccacagtcccacacactaatggaactcacgaccttccttgatgaatgctctaattcatcttccacccaattcttcaaacctatcctacmctcacctataaaaaccattctcctaaaaaacgtcattttgatcactattttgatggttatttccatgtggtaatttccagttgactctcatctcaaattaaaaacaatctatgattgtcttccataaactgttcattttccatccctaattctgctatacccccaatccttattccatacagcaatcaaacactagctgatgaacctgcaatcggtcctgctcaatcccatgtgtgactttcacatgccaccgccctggcctagaatatctccccttctcctcctaacaaatcatgcctc

SEQ ID NO: 182146 - DNA, 601 bp, Human
attatttctctccaaaatgaacaattgccaatcaaggaaagcaaagaattgctcgatcttagcgatttaattgtaaaacaaaaatatctgactcctcttatttcaagcttcatatcagtttaattagaaagtgtcttcatgttgctaggtgaactacttcaaaaccaccatctgcaactccttatctgtgggattgtgtcttcttgcgacttcacaagcaaaactaaaaacaaactggatgctgaaagtgatcatccaagtaccttccaaaatccctgatactaaatttgtgttttcatcrcaccaccttcattgtacttactgattttataagtcaatgttctaaaacttaattttaaaaacaaatacccagaagatacagttttcatctattttacatctagaaccatcatatactattatataattttttttttgagacagagtctcgctctgtcgcccgggctggagtgcagtggtgcgatctcggctcactgcaagctccgcctctggggttcacaccattctcctgcctcagcctcccgagtagctgggactacaggcgcccgccaccatgcccggctaatttttgtatttttag

SEQ ID NO: 182147 - DNA, 601 bp, Human
gcctcgccgggcgtgatggctcacgcctgtaatcccagccctttgggaggctgaggcgggcagatcaagaggtctggagatcgagaccatcctggctaacacaatgaaaccccgtctctactaaaaatacaaaaacttagccggccgtggtggcggccacctgtcccatctactcgggaggctgaggcaggggaatggcgtgaacccaggaggcggagcttgcagtgagccgagattgcaccactgcactccagcctgggcgacagagcaagactctgtctcaaaaaaaaaaaggaaaaaraaaattaattactcagtatcagatattttgttatagcaacacaaaatgaactaagataattatgaacctttatgttgtagggcagatttttaaacataaaagttaaaagataccaagtgaatgatctacgtgttaaatggttataaaatccatctgttcaactacattccaacccactcagaatacatacatttacaaatacaatttattgaggattaagagtaaaaaattcagtcccactgcttatcataagtgaaaggctgtaagccagccccactttctggcttggtgagagtctgt

SEQ ID NO: 182148 - DNA, 601 bp, Human
ttactcagcctcgccgggcgtgatggctcacgcctgtaatcccagccctttgggaggctgaggcgggcagatcaagaggtctggagatcgagaccatcctggctaacacaatgaaaccccgtctctactaaaaatacaaaaacttagccggccgtggtggcggccacctgtcccatctactcgggaggctgaggcaggggaatggcgtgaacccaggaggcggagcttgcagtgagccgagattgcaccactgcactccagcctgggcgacagagcaagactctgtctcaaaaaaaaaaargaaaaaaaaaattaattactcagtatcagatattttgttatagcaacacaaaatgaactaagataattatgaacctttatgttgtagggcagatttttaaacataaaagttaaaagataccaagtgaatgatctacgtgttaaatggttataaaatccatctgttcaactacattccaacccactcagaatacatacatttacaaatacaatttattgaggattaagagtaaaaaattcagtcccactgcttatcataagtgaaaggctgtaagccagccccactttctggcttggtgag

SEQ ID NO: 182149 - DNA, 601 bp, Human
gatgtcatggcacatctctgtagtcccagccactctggaggccaaggaggaggatcgcttaagcccaggaggtcgaagctactgcaactattattgcaccactgcactccagcctggcaacagagcaacaccctgtctcaaaaaataaataaataaataaaataagtttctagagtccctcctcatgatccgtacaggcctcaacagagactacagcaaaggctacagataaggcagctgctagaagagaaatggccttgttacagcaaccttgcaggagctttcctctgtattcaccttrcaggagcttccctctgtattcaccttgcaggagcttccctctgcattcaccttgcaggggcttccctctgtattcaccttgcaggggcttccctctatattaaattggactattcaacaagatttttaactataaatagggaatagttgggtaaaatattcccacattttaaggtcaaagttccagggcaacaaaaccctagcgatttcaatgctactttaccatggctgtttccttcttctcagtatgcatttactggaatggcttcttttctttttttttttttttttttttgagaca

SEQ ID NO: 182150 - DNA, 601 bp, Human
atgtcataaaattgcacagaactatgtacatacatgcacacacaaatgagtacatacagaattgatgaaatacaaagaagtccaggtgaaactggtgaaacctgaaagttgttaattgtaccaattccaatttcctggtttttatcttctactatagttacgcaagatatcaccactagggaaaaccgggtgaagggtatagataacttccctggactttttgaaacttctagtgaatctataagtaaacacaaaaaaatttttttgtttccagtgggattggaccaaaaaattttaaccaaaaaaaaaaaagctgtataaatttactaaaaactatcaaactatacaattacaatgcaaaaaaatttttgtggtacaaaatatacctcaataatgctgttttaaagaaacaataatcaaaccctgatatattttcctgtttaaaggaatactcatacataacagtttatcaagcacaaaactcccaagatttcctcaatatctttctgtagttcattctgtattttagcttaactacaatttttcttttaaaagtttcttggctcactgcaagctccgcctcccaggttcacgccattct

SEQ ID NO: 182151 - DNA, 601 bp, Human
aaaatctaacacaaatctagatgctgaaaataattgtaaactgctgatgaaagaaattaaagacaacttaaagaaatggagagacatgctatgtttatgaattgaaagattcaacatagtaaagatatcaattctctacaaactgatctacaaacgtaccacaatttctattaaaattccagcaaggtttttgtagacataaacaagcttactctaaaatttatgcggaaaagcaaagaagctagaatagttagggcaactctgaaaaagaggaatgaaatgggaagaatcattttatccrgtgttaaggcttactatgtcgctacagtaatcagaataatgtattattggtgcaggaacagatcaaagtacctgagtagagaacccacaacagacccaggccagtatgactgaattttgacaatggtgcaaaagcaattcaatgaaggagagagagtctttttgagaaacagtgctgaagcaactggacaacgataagccaaagaaaaaaatattaacttgaacttaatcctcataccttctacaaaaattaactcaaaatgaatcatagacttaaatgtaaaatgtaaaactataaaac

SEQ ID NO: 182152 - DNA, 601 bp, Human
ttaaccaaagaaaacatataaatgtgtccgggcgcgatggtaatcccagcactttgagaggccgaggcaggcggatcacttgaggtcaggagtttaggaccagtctggccaacatggtgaaaccctgtctctaataaaaatacaaaaattagctgggtgtggtggcgtaagcctgtaatcccagctgctcaggaggctgaggcagaagaattgcttgaacctgggaggtggaggctgcagtaagcggagatcacaccactacactccagcctgggcgagagcgaaaccccgtctcaaaacmaaaaaaaaaaaaaaaaaaagaaataaagaaaaatgaaaacatacgaccgcagaaaaacctgtacacaaatgtttatagtggcattattcataacagtcaaaaactggaacaggacgagcgaagtggctcacgcctataatcccagcactttggaaggccaaggcgggcagatcacttggggccaggagttcgagaccagcctggccaacatggcgaaaccctgcatctataaaataaaaaagaaaaaaagaaaactggaaacaatctaaatgcccatcaactggtgaatggatgaagaaa

SEQ ID NO: 182153 - DNA, 601 bp, Human
atctcaaaaaaaaaaaaaaaaaaacagaatcataggccaggcacagtggctaattgtaccttgggaggctgagacgggaggatcgagaccatcctgggcaccatagtgagaccccatctctacaaaaaaaaaaaaaaattttttttaaatagccaggcatggtgaggctgaagtaggatcacttgagcctggaaggtcgaagctgaagtgagccatgatcacaccactacactccagcctaggtgacagagcaagacaccatctcaagaaagaaaaaaaagaaagaaaagaaaagaaaagaaaagaaaagaaaagaaaagaaaagaaaagaaaagaaaagaaaagaaaaaacgaaggggaaaaaaagagaatcataaacataaatgtaaaatttctcaaaaaaatcgttatgaccataggttaggcaaatatttcttagatatcacaaaatcatgacctattaaaaaataataataaagtaagtttcatcaaaacttaaaagttctactcttcaaaagataccttataaagaaagtaaaaagacacgccacaggctaagagaaagtacttctaatcacatatctaaaaaaggacttgtgtc

SEQ ID NO: 182154 - DNA, 601 bp, Human
gactccatctcaaaaaaaaaaaaaaaaaaacagaatcataggccaggcacagtggctaattgtaccttgggaggctgagacgggaggatcgagaccatcctgggcaccatagtgagaccccatctctacaaaaaaaaaaaaaaattttttttaaatagccaggcatggtgaggctgaagtaggatcacttgagcctggaaggtcgaagctgaagtgagccatgatcacaccactacactccagcctaggtgacagagcaagacaccatctcaagaaagaaaaaaaagaaagaaaagaaaagaaaagaaaagaaaagaaaagaaaagaaaagaaaagaaaagaaaagaaaagaaaaaacgaaggggaaaaaaagagaatcataaacataaatgtaaaatttctcaaaaaaatcgttatgaccataggttaggcaaatatttcttagatatcacaaaatcatgacctattaaaaaataataataaagtaagtttcatcaaaacttaaaagttctactcttcaaaagataccttataaagaaagtaaaaagacacgccacaggctaagagaaagtacttctaatcacatatctaaaaaaggact

SEQ ID NO: 182155 - DNA, 601 bp, Human
gactttgctcactacagtcacatttggtagttgcaggaggatattccccaacgcagggttccacacatagtataataatatcaaaaaaaaaacaaacaaacctcaaagaaaatcatagcattcccagtaacatcaaaaataagaataattttttaaggtgcaagacctatacaatgaaaactacaaagcattactgagagaaagtagagctaaataaagagatacaccatgttcaaaaattggcaggatgtcaattcttcccaaactgatctacagattcaacacaatccctatcaaaatgtcagcagacttctgtacaaagtgataatctgattctaaaatttctatggaaattcaagacagaatatctaaaaaattgtctgaaaaagaagaacaatgttagaagactaacagtgcctgatttagaggaaaaaactaactataaacctaccgaaatagaaccattgtggtattgctataaggatggacatatagatcagtgaaacactgacatgtcaactgattttaacaaaggtgccaatgcaattcaatggaaaaaggatagtcttttcaacaactgatgctaaaacaaccgaatatt

SEQ ID NO: 182156 - DNA, 601 bp, Human
aacatactaccacattatggttgataaacccacagagctgaattcatctgctttaagtaactacatgaaatatctcaagccccaagtaactatacccagaaccagcaccaaccgaggcttctgaacaaaaacaacctcacaaagcaatttacccagaaagcaacatttctaagacaggagactgcctcctccaaatggctcactccattgaaaaaacgccatctgccagaggcagacaccaaataaaaggcacttggacatcaggatttgtaaaaaaacaagtactttagaaaaactcatyctgtataaacgtatccttaactcctcatgagaatattgccaaaggtgccagtaaatataaaatacaatctgtgaagctaaacagggaaagaaaacctaaaacctaagaccaggtaggaaagatgggaggaggggcaaaaagaagtgtgaaggctgggagtcctattcatgccctggtgcagcaagccagtgccagtctaagaagaagatggaggctaggaagagtttcctactctcccaccagcagtgtctgaggtgacctgtagctgggcaagtctccaccatggcactcttcacaagg

SEQ ID NO: 182157 - DNA, 601 bp, Human
tgatatatctttattacatttcctctttcacaaagatatttattaaagaaatgcatgtataattatagaaaatagttgcaaatgaaagctagtcctaagagaaccataatctgtatctacaaaagaaatttcaaaggcaaaaatatttgagaaatatctgaggaaagaacatactaccacattatggttgataaacccacagagctgaattcatctgctttaagtaactacatgaaatatctcaagccccaagtaactatacccagaaccagcaccaaccgaggcttctgaacaaaaacamcctcacaaagcaatttacccagaaagcaacatttctaagacaggagactgcctcctccaaatggctcactccattgaaaaaacgccatctgccagaggcagacaccaaataaaaggcacttggacatcaggatttgtaaaaaaacaagtactttagaaaaactcatcctgtataaacgtatccttaactcctcatgagaatattgccaaaggtgccagtaaatataaaatacaatctgtgaagctaaacagggaaagaaaacctaaaacctaagaccaggtaggaaagatgggaggaggg

SEQ ID NO: 182158 - DNA, 601 bp, Human; identical to SEQ ID NO: 35527

SEQ ID NO: 182159 - DNA, 601 bp, Human; identical to SEQ ID NO: 35528

SEQ ID NO: 182160 - DNA, 601 bp, Human; identical to SEQ ID NO: 35529

SEQ ID NO: 182161 - DNA, 601 bp, Human
tgggactttaaattatcccaaccattgtgaggaatgtagatatgcggctgcaaattctgcatttttctttcctgtaaataattaagaccaaactgctgaagataagacttcctcagataaccctccttggaatgtagcaatctataaacagtcaaatcactgtggcacacacactggtcttgtatggaaaatgttctaatcctgctggaacttctctgtctctgcctatatcagtgatatcttcttcactttggaaccctgaccccactggtttgaagttggtgtttctgagtggccaccrtcaagctctgtgcacaaataaactctgtacttagtcatattttctgaatctcgttaaggctgataagtcacagcaatgtattgaaccatttcactgacttcagaacaaagagcctcaatactcactagtacattccacctctttctataccaagaaattttttttttttttttaagagacggagtcttgctctgtcacccagggtggagtgtagtggcacgatctcagctcactacaacctccacctcccaggttcaagcaattctcctgcctcagcctactgagtagctgggattacag

SEQ ID NO: 182162 - DNA, 601 bp, Human
actggaaacaatcacattgatatcaatgtgctatcatttactacggttcagtagaaaattcacaatatgtaaagtaataagagcagatgttactattccaccttacagatgtccagagaactgacatcctgggaagtagattcactgagccaaacctctgcactacactaacctatcattaaagaacagtgactacagttgagtagaaatttaacaatttcaaggtttaaataaatttctgatttccagctttagcttaggatacagaaaactggtaacagctaccccattctttccgggsgcagagggagagataatttaccaaaatcacaggtcttcttgaacacattagagagctaaggctggacatcagccaaccaatctgaaaaatgacgaaagacaacagcctccaagcagatacatgaagcaagcacttgctcacctggggcatatgctggacaccatacaaggcagcaaaaaaaataaaaaataaaaaaaccccagctaaaatactgaacaaatcacaaaatcagtggttgccttgggctggtgatgagtggagaactggactacagaaggatggcgtgcaggaagtctgggg

SEQ ID NO: 182163 - DNA, 601 bp, Human
gcacgccacactgcctccatgtgttggtgtgagcgtgtggaggaggagggattggcaggccaagagcagccacggtcactgacacaaaggtgctctgctggtaactttgtgtaactaggaaggtccctggaagactaagctggatccagtcctgcccccaaattatcaatcatcaaaaagtaattttgatgctgcaattattatctaacattatttgaatacataaaccagagacaaggagtacaatcatgattttcaaatcactgaaaagcagaaaaagcatttaaaagatttcactagsaagttaagcagttaatcttcacaggactgtgaagatttccgtctctttcacactcttcatttgccctcttatccaagttactggaaacaatcacattgatatcaatgtgctatcatttactacggttcagtagaaaattcacaatatgtaaagtaataagagcagatgttactattccaccttacagatgtccagagaactgacatcctgggaagtagattcactgagccaaacctctgcactacactaacctatcattaaagaacagtgactacagttgagtagaaatttaacaatttc

SEQ ID NO: 182164 - DNA, 601 bp, Human
tactaagagggaagtttatagcaataaatgcctgtatcaaaaaagtagaatgactccaaataaacaatctaatgatgcaccaaggaaatagaaaagaacaaactaaactcaaaaatactagaaggaaagaaataataaagatcagaccataaatacatgaaattaaaactaaaaaatgcagaaaattaatgaaacctcgagagcctcaaggttatctccgtagtccaacaagtgtccatgcccagaagagatcttgtagacgacactcccataccaaagcctgactttatgctgtttgttragagggtctcatcttaaaagtacagagtcaatacaaggctggtgatgaagtcacctgggtcaaggttccagagtggtcttccttcttatagtgcctcaaattatatttgtttgctacctgttgcattaaaagtttctgttcagctattgtcctgacagatgattcaacaggtgattccgcaaaaaaaagacgaaaaaataatgttgatcagtgctcaagttgtaaatcaactctctccaaactaacctcacctttcaggaggttcaaccacaatgggggaaacaggacaatgctaatgat

SEQ ID NO: 182165 - DNA, 601 bp, Human
atgacagtaagaaagcaagaaaaaagaagaggagttacaaaacaaccaggaaacaagcaacaaattagcagtaataagtccttacttatcgatagtaacattgaatataaacagattcaattttctaattaaaagaaatatggagtggctgaatggaaagaaacaagacttaactacatgctgcctacaagaaacccacttcacccataaaggcacatacagactgaaagtgaagggtggaaaaagatatctatgcaactggaaaccaaaaaaaacaggagtagctacatctatatcagayaaaatagactacaagtcaaagactgtgaaaagagaccaagtcactatataatgaaaaatggaccaactcagctagaggatataacaattgtaaatatctatgcacccaacacagcattatccaagtatataaatcaatcattaataaatctaaagggagaaattgactgcagtacaataacagtagagacttcaacattccactctcagtaatggccggatggtccagaccaaaaaaaaatcaacaaagaaacatcagaggtaaactacacactagaccaaatagacctgaatctttaca

SEQ ID NO: 182166 - DNA, 601 bp, Human
catctctttaaaataacctgttatatctaaagatttttttgtaagcctcatggtaaccacaaagcaaaaatctgtaatagatgcactaaaaataaaaagcaatgaactaaaacacaccagagaaaatcacttaaccataaaggatgacagtaagaaagcaagaaaaaagaagaggagttacaaaacaaccaggaaacaagcaacaaattagcagtaataagtccttacttatcgatagtaacattgaatataaacagattcaattttctaattaaaagaaatatggagtggctgaatggaragaaacaagacttaactacatgctgcctacaagaaacccacttcacccataaaggcacatacagactgaaagtgaagggtggaaaaagatatctatgcaactggaaaccaaaaaaaacaggagtagctacatctatatcagacaaaatagactacaagtcaaagactgtgaaaagagaccaagtcactatataatgaaaaatggaccaactcagctagaggatataacaattgtaaatatctatgcacccaacacagcattatccaagtatataaatcaatcattaataaatctaaaggg

SEQ ID NO: 182167 - DNA, 601 bp, Human
caaaggtgccaagacaaatcaatggagaaatgataaaagaataatcttttgaacaaatggtgctaaaacaactggatatccacatgcaaaggaaggaagttgaatacctaccacacaccatatacaaatattaactcaaaatggatcaaagatctgaatataagaattaaagctggccgggcgcagtggctcacgcctgtaatcccagtactttgggaggctgaggcgggcagatcacgaggtcaggagatcaagaccatcctggctagtatggtgaaaccccgtctctactaaaaatacaaaaaaaaaaaaaaaattagccaggcgcggtggcaggtgccttagtcccagctactcaggatgctgaggcaaaagaatggcgtgaacccgggaggcagagcttgcagtgagtggagatcgcactgctgcactccagcctgagcgacagagcaagactccgtctcaaaaaaagaaaaaaaaaaaagaaaaaattaaagctataaaattctttatttatttttttgaatcttacgctgtcacctgggctggagtgcagtggcacaatcgcagctcactgcaccctcaacctcctgagtagctg

SEQ ID NO: 182168 - DNA, 601 bp, Human
gaattatgatcaggccactgtactccagcctgggcaattaaagtgagaccccatttaaaaaaaaaaagaatctggtgtcaattatttgtgctgaaaaggatatacagagttgagacgtactatgtctgatacttttgctttagactgtaatagtttcatcttattttgagcaaaaaaagtaataatagggtattggcagaatgatagacatataaatcaatggtagaattgagagtacagaaataaatcctcacatttatggtcaactgaattccaacaaaggtgccaagacaaatcaatrgagaaatgataaaagaataatcttttgaacaaatggtgctaaaacaactggatatccacatgcaaaggaaggaagttgaatacctaccacacaccatatacaaatattaactcaaaatggatcaaagatctgaatataagaattaaagctggccgggcgcagtggctcacgcctgtaatcccagtactttgggaggctgaggcgggcagatcacgaggtcaggagatcaagaccatcctggctagtatggtgaaaccccgtctctactaaaaatacaaaaaaaaaaaaaaaattagccag

SEQ ID NO: 182169 - DNA, 601 bp, Human
atgcagcccaacaggaaagtgggcacaagacacagacaggtgactcaaaggaaaaactggaatggtacaaacatgtgaagagcctcaacctcactggcaatctaaatctgaaggaagggagagaaggacaaagacagacagatgataggtggatgataaaaatactctttaaggccaggtccagtggctcacgctgtaatcccaacattctgggaggctgaggcaggtggatcacttgagcttaggagtttgagacaagcctgggcaacaaggtgagaccctgtctctacaaaaaataccaaaaaaaaaaaaaaaattagctgcgcatggtggcgtgcagagtagctgggaccccagttacttgggaggctgggatgggaggatcacttgagccccagaggtcgcggctgcagtgagccgtgattgcaccactgcactccagcctgggtaacacagcaagaccctgtctctccccctcttcccccggcacctctctctccatatacacatatattttttctctttagaggaatataataaatagcaaagtgctgacaaggacgtgggaaacacgaacactgacatggtgcaggtagaaatg

SEQ ID NO: 182170 - DNA, 601 bp, Human
acttatcttaagtgaattaatccagaagtagaaaaccaaatattgcatgttctcatttataagtgggagctaaacccttggtatacgcggacataaagatgggaacaagagacactggagactccaaaaggagagagggagggagaggaacaaggactgaaaaatctcctattgggtactatatctactatctgagtgacagattcaacagaagcccaaaccttggcatcacgcaatatactcttgtaacaaacctgcacatgtaccccctgaatctaaaatttaaatttaaatttttttwaaaaatgggcaactaggaaaaaaataacccctatctctgggtctaaggtactaactgctgaaaatgagtgaccttcgatcatgaaagtggcagtgaaagtgtagttccccagagagaggcaagctatacacaaggcagggggaggccaggaagaaaagaggctgatttatagtatgagaaaggtcttggggctccagaggactcaagggtgggcgttagtgaagtgggggaggtgaaaagaggggagaagagtgccttggagatgtggtgagacggaacaagccatgagcatgttggaag

SEQ ID NO: 182171 - DNA, 601 bp, Human
tctggagatttctcaaagaactaaaaacagacctagcattcaacccagcaatcccattacttggtaaatagccaaaggaaaataaaattgttctaccaaaaagacacctgcccttataagtttatcacagcactgctcacaatagcaaagataagtggtggctcatgcctgaaatcccagcactttgggaggctgaggtgaaaggatcacttgagttcaggagttcaagactatcctgggcaagaaagtgagacccctatcgctaccaaaaaaaaaaaaattttttttaattagccaggcrtgatgtcacatgcctgtaatcccaagtacttgggaggccgaggcagaaggattgcttgagcccaggattttcagactgcagtgagataagatagcaccactgcatgccagtgtgaatggaacagccagaccctgtctcaaaaacaaaactaaacaaaacaaaaatagcaaagacatagaatcaacccaggtgtccatcaacagtggattggataaagaaaatgtggtacatacaagccatggaatacttcgcagccagaaagaaagaccaccaccatgtcctttgcagcaacatggatgc

SEQ ID NO: 182172 - DNA, 601 bp, Human
acagtccacctgatgacaatgtgcagggtctggcccaaggcagactactgccacagtgaagggcacagcaaatcttgggagctgagaaaggcaggtggccttgaaattagattgttgaatgaatcacccctaaacatgttcaagtcattcaagatagcaggaaatggggagggggacaccaacaagccagtactcagtgaacaagggaaatgcctggatggtcagaaaagtacagtgatgagaaaggctggatgtgaagagagcaactggttgcttgaattttcaaggaggaaaaaaattygcatgagattggaagagaaacagccttttaaaaatgagcattctgggacatttcattaaaaataaaaatgggcagctagaagaaacacttcccctaagaactggaataagacatagagatatccactcttaccgcacctattcaacacagaactggaggccaggtgtggtggctcaagcctgtagtcccagcactttgggaagagccaaggaaggcggatcacttgagctcaggagttcaagaccagcttgtgcaacatggcgaaaccctgtctctacaaaaaactacagaaattagtca

SEQ ID NO: 182173 - DNA, 601 bp, Human
ctacacaccacacacatcacacacacaccacaaagacacatcacataccacagacatcacacaccatacaccacacacacactacacaccacacacacatcacacatcacaccacacacatcagacaccacacacacatcacacacaccacatacccaccacacacacaccagacaccacacacatcacacgtaccacataacacaacacacatacatcacacacatcacacacacaccacacagataccacacacacatcagacacaccacacacacaccagctgactgcactaattgcgccagccttggctgacagagcccacacacccacaccacacacataccagacacacaccacacaccacgcacccacatcacacaccacagatcacacacacatcacaccccacacacaacacaccagctgactgcactaactgccccagccttggctgaaagagcccacaaacacacatcacccaccccccgacacacacaccacacacacaccacacattccccacaccacacacacactccaacacacacacatacacacacccccacatatgcagcccacacacccccacacgccacac

SEQ ID NO: 182174 - DNA, 601 bp, Human
ttaaaagaaaatataacttgcaacctacgagtaacagaataaacacgcccagtacttcaaaacaaactagcaataaaaataagcaagaaaaaggagtatctgtgaagttcactgctcagaaacaagccaatcagtgatgctaaactgaccaaaatctaaggtagtcaaattagcaccataaagtaattctactgtacaataagtaataaaattcttacaaaagactgcatgtaatttgagaaagcaattggcacagcaatattacatttttagaccaaattattcttgacagaaacttaakaggcctaccaatttttcattagacagagtacagtaagtaatgacttaacagactttagattctgtgcctctttcctcagtcaagttagaacctaaaaacctgtggtctatatcatgtcatcctcaaatatctgtatgtcaatttgtatctattatgttacaatgaagacatacaaaaagatataaagaataatacaatacccacctccctggttaagaaagaaaccctataaccagagttgaattcccttggtgaacgctacccaaaggcgtgcttcagggaggtgtaaccacagctatg

SEQ ID NO: 182175 - DNA, 601 bp, Human
catgatggcacgcccctgtggtcccagctactggagcagctgaggtgggaggatcacttgagcccaggaggtcgaggctgcaatgagctgtgacagtgctactacactccagcctgtgtgacagagcaagaccctatctcaaaaataataactaaaaataataataatgttaaaagaagggaaagcatctttaaaaattaagaggctaattttttttttttttttttttttttttttttttttgtgaaacagagttagagtgcagtggcgccatctcggctcactgcaacctccgcctccygggttcaagtgactctcctgcctcagcctcctgagtagctgggattacaggcatatgccaccacacccagctaattgttgtatttttagtagagatggggtttcaccatgttggttaggctctcgaactcctgacctcatgatccgcccacctcagcctcccaacgtgctgagattacaggcatgagccaccacgcccggcaaggctaaatatttcatactgaaaagttcagttcatcaggagggtagcattttaaacttgtatgtacctaataatatagcctcaaaaatacataaaggc

SEQ ID NO: 182176 - DNA, 601 bp, Human
ctgtttcaaagaaacacacctgaaacaaaagtttccagaaaggggccaggagtggtggctcacacctgtaatcccagcactttgggaggccagggtgggcaaactgcttgaggccaggagtccaagaccaccctggccaacatggcaaaaccctgtctctgctgaaaatattaaaaaatagccacatgtggtgatgtgtacctgtagtcccaactactagagaggctgaggcaggagaatctcttgaatgcaggaggcagaggttatagtgaagcaagatcgcaccactgcattccagccygggcaacagagtgagactctaaaaaaaaaagtttgcagaaagttgaaagtaaaagaatgggaaaagatatatcaaacaaatactaatgaaaaaagaagaaagagaaggctgaggtagctacattaacagaaaagaaaacagactgagtgcagtggctcaggcttatcatcacaacactttcagaggctgaggtgggcgggcagcttgagcccaggagttggaggtcagcctgggcaacatggcaagaccccgtctctgcaaaaaatacaaaaacagctgggcatgatggcacgcccctgt

SEQ ID NO: 182177 - DNA, 601 bp, Human
atgtatactcattaaacaacatatagtgttaaaaattatgatgaaattgggacagaactttaggttagattggtagttaagggtgaagaggaaaggatgcagtaaagatagctttttaaagaaattttaaaacacacacatactatacatgtgtacttctcttcatagctgcagtgtctttccaatttctttttacccaaattatttaacaatgggtcttctcttttatctgacagaaccacatacccacatagagtactgtgctgtaatagagaatgggataggctgatgctgtttaccwgctgttttataagagacaatttctctttgtgttgtagggacaccagtaaattataaccaaattgaaagcaatacttcagaaacagaactagagtaaacttaacataccaagaaattttctaaaatttgactttttttaaaagaaagaacatcttacaatcaatcctactttctaatactttaaaatttccttcagctacagaagaacaggtatacagtaggcccctcttatccacagtttcaccttccacagtttcacttagccagtcaaccatggtctggaaacatcaaatggaaaaat

SEQ ID NO: 182178 - DNA, 601 bp, Human
cttgttatagcaacagccatagccagagcatttatgccagtttaagacccaattccacaaggccacatacatgctgtgtgggctgtgtcacaggagaggaaccccaagctctggctgaactttgccctagagggaaacattatctttactacataagggtaaacaaacctaccctttttgctctggaaggagacagtatctctgtcctctaaggatgtctgctatacacacatccttgaaaagctagccagaaacaaaggaggtcagttcctctgctcttaacacatgaagaaacaggagwgacccttgtgtctcgacaatatctaaataaatgaagacatatacttgtgttcatggattgtaagtctcaatattgctaaagtgtcaattatcccccaaaatgaactgttgattcaacacaatcccaataaaaattccaacaggattctttttggtagcaagtgacgagctgatttttaaattcatatggaaaggcaaagggcttaaaaatagccaaaacaaccttgaaagagaacaaagttggacgacttatactacctgactttaagatttattataaagctatcaagatttattataa

SEQ ID NO: 182179 - DNA, 601 bp, Human
gagcagagatcacaccattgcactccaacctggacaacaaaagcgaaattctgtctcaaaaaaaaaaaaaaaaaaaaaggaaagcctgggatgatgtcccagaagcaaaaaaaaattgcattaacacaacttaacaagcacctcatattatccataagccaaagcttaagcaggaaaagtccacctgagtcaaagaacacactctctgatgagtggcagaaacttgggttgcttgctactgacagaactgcataaattaagatgaaactcattacaattttcactcacccccggaaacttscggaggaccagagctaaaagggccatagagaacatttaggctaaactcctctttttatgagaaagtaggattactggctgcaaattagcctaagtagagactggcatattgtttcagggcaactgacccagaagccaagcaaagccagacctaatgtcaactaaatgtgagaagtcatccagtactggcccggcacggtggctcacgcctgtaatcccggcactccgagaggccgaggcgggtggatcacctgaggtcaggagtttgagaccagcctggccaacatggtgaaaccttgtc

SEQ ID NO: 182180 - DNA, 601 bp, Human
gaggttgtggtgagcagagatcacaccattgcactccaacctggacaacaaaagcgaaattctgtctcaaaaaaaaaaaaaaaaaaaaaggaaagcctgggatgatgtcccagaagcaaaaaaaaattgcattaacacaacttaacaagcacctcatattatccataagccaaagcttaagcaggaaaagtccacctgagtcaaagaacacactctctgatgagtggcagaaacttgggttgcttgctactgacagaactgcataaattaagatgaaactcattacaattttcactcaccyccggaaacttccggaggaccagagctaaaagggccatagagaacatttaggctaaactcctctttttatgagaaagtaggattactggctgcaaattagcctaagtagagactggcatattgtttcagggcaactgacccagaagccaagcaaagccagacctaatgtcaactaaatgtgagaagtcatccagtactggcccggcacggtggctcacgcctgtaatcccggcactccgagaggccgaggcgggtggatcacctgaggtcaggagtttgagaccagcctggccaacatggt

SEQ ID NO: 182181 - DNA, 601 bp, Human
gatcttgttttgtttgactttagaacaaatgattctaaagattctaaagtaagatgaccttgcaatggatttatgaggggttgggctgtgctcactgtgttgaaagaaccagtaattattttcacggataagaaagcctgggatggccaggcacggtagcttacgcctataatcccagcactttgggaggctgaggcgggcagatcacctgagggcgggagttcgagaccaacctgaccaacatggagaaaccgcatctctattaaaaatacaaaattagccgggcgtggtggtacatgcytgtaatcccagctactcaggaggctgaggcaggagaatcgcttgaagccgggaggcggaggttgtggtgagcagagatcacaccattgcactccaacctggacaacaaaagcgaaattctgtctcaaaaaaaaaaaaaaaaaaaaaggaaagcctgggatgatgtcccagaagcaaaaaaaaattgcattaacacaacttaacaagcacctcatattatccataagccaaagcttaagcaggaaaagtccacctgagtcaaagaacacactctctgatgagtggcagaaacttgggttgc

SEQ ID NO: 182182 - DNA, 601 bp, Human
aaatgagttttcattgcagcatgagattttttttttcatttcaagtcttttatccctaaagcatgagatatttagactagaaataaaagaggaaaactagcacctatttaacacctactacattaggtgttggcctaaacactattgcattttaatatacattaagatccttgaggtagaaattctcattttatacatcagaaaagcaggattctaaaaggttaggtaagttcacaagcaggaaagctgcaattcaaatctgggttgaatgagtccaaagctcgtgtacttattaaaatayatcaaatttcttaacagaaattgataaaagtaggaactgattactgaaagggataatgagatcttttttttcctcgatcttatttttttttttaatgaagtttcactcttgttgcccagactgaagtgcagtggcacgatcttggctcactgcaacctctgcctcctgggttcaaacaattctccttttcctcgatcttttaaaaattagaagagcttcttatctgtccagtatattttcataaactagatctacctaaaaccaaaggaatagaagaagccagttttcaaattatctctt

SEQ ID NO: 182183 - DNA, 601 bp, Human
tgagggagatgagggagtcccaatatctgcagtccatgcactggagactctggacagccaatgtgtagtgccagtgtgaaagccagcaggctcgagacccaagagctggtgtttcagtttgagttcaaaggcaggaaaaggcccacatcccagctcaaacagtcaaggcagagatcccttttattcagcctttttattctgttggggctccaactgactggatgagagccacccaactggctgaaggcaatctgctgtactcagtctcctggttcaaatgttaatcttatccagaaacatsctcatagacatacccagagttaatgtttggccaaatgtctgggcatctcatggtccaatcaagttgatataaaaattaactctcttagggaccacctaggtggcttgaataaaagcttcaaacctgcatgaaaaccagcctactaattctcagaagagattttccccccactacactcaatgccaaaggtcaaaacaattttccttaaaaaactttcggattaagcgagtatcttcagtttaccccgacactgctgggaaagacccttgggagtttcctctcaggatgctcacctgaggt

SEQ ID NO: 182184 - DNA, 601 bp, Human
aagttgggggagtgggcacactgccctcaagggaaggaagatgatgcttaagttagcttaagaaaggtaaaaggcagccggacgcagtggttcacgcctgtaatcccagcactttgggaagacgaggcgggcggatcacgaggtcaggagatcgagaccatcctggctaacacggtgaaaccctgtctctactaaaaatacgaaaaattagccgggcgtggtggcaggtgcctgtagtcccagctacttgggaggctgaggcagaagaatggcgtgaacctgggaggcagggcttgcagtkagccaagatcacgccactgaactccagcctgggtggcagagtgagactctgtctcaaaaaaaaaaaaagaaagaaaagaaagaaggataaaaggagtcacttatgaaagatgctgggataactcaaaatctgaggaaaagctatacagcccacctggacagggataaagctgactgcaagccatagggctcctctgcatctcaggtcagcatttatgtcttggcttcagcaactgacaacacagataaattttctccaggtggccaggaacacggccacaggcagctctagagtcacatc

SEQ ID NO: 182185 - DNA, 601 bp, Human
ccctctttcttctctgctcattcctcctaagccacccttgtgcctgaccctgtgctctatgggaaccttttcagagttcatcaataactctctgttgccaaatgcttctcttcactcttgttttctttgagttccgactctaacagccattgtattcttctcaaagaaatggtttctgtccctctttttaaaatgtataaagcatttccaattgctgttccactcaattctcacagccaccctgttccaaacagacaggaacagtgtttatatctctattttgtggatgacagaatatcayggaagtgaagggactcacccagaatcacaaaccagaatacaggaggagaggggccagcctgctttctgatgcctcgacctgtctcctagctcagggctctcatgagccctacatccctctgctcaggcctctcggccagcctccccgtgtcatgttccctacactgccagtctttctgtttgtcacctttttcagaatgactcccaaacccatgtcactagcaagtttcttgtgaactctaagcttcttgtctccaactacttcttggacatttccatttggattttttttactatgtca

SEQ ID NO: 182186 - DNA, 601 bp, Human
aagccatccatggtgtccattctacacagacacaaccaaatcaatcatgaagaaaggcaacataggtccttctccatgctgcgacgagctcggcactgtaccaccctcatcgctctctcatggatggctctgtgttgcacaacacacaggtgataaccttagcatgctgtcactgacacaactataagaaagcctctgaagggtcctacagccccacagaatgtaagcagaggtctcctacacagcctcccaggttagatggggctagggcgcctaccctgtgctgtttctgggctgaagytgtgtggctgtccagggccatggctgtctgctccacccaggtctctgtggcctggcagggcactctggcttaggaggggcatgagccagaagagaagactagttgtgtaccttccagcccggccaggaccgcctctgggatgtcaggactttgacagggcccaggatgtccaagtttttcttaacaatttcagcacttacacaaatggtatatttgtatccaagaaacataacccacaaatatttgacaaatgctaactccccaattttcatctcctaaagggtttcttttgacatctga

SEQ ID NO: 182187 - DNA, 601 bp, Human
ggaggatggagcccggaataaagttggggttctgttagaaatgaagaaagggaaaaagggtgcagaacaagccatccatggtgtccattctacacagacacaaccaaatcaatcatgaagaaaggcaacataggtccttctccatgctgcgacgagctcggcactgtaccaccctcatcgctctctcatggatggctctgtgttgcacaacacacaggtgataaccttagcatgctgtcactgacacaactataagaaagcctctgaagggtcctacagccccacagaatgtaagcagagstctcctacacagcctcccaggttagatggggctagggcgcctaccctgtgctgtttctgggctgaagctgtgtggctgtccagggccatggctgtctgctccacccaggtctctgtggcctggcagggcactctggcttaggaggggcatgagccagaagagaagactagttgtgtaccttccagcccggccaggaccgcctctgggatgtcaggactttgacagggcccaggatgtccaagtttttcttaacaatttcagcacttacacaaatggtatatttgtatccaagaaacataa

SEQ ID NO: 182188 - DNA, 601 bp, Human
atttcttaaaacgagaagtccagggctggatccaatgtctcaattatgttatggaaggcctgggttattttctctgcctgccccaacagcatcaactgtaaggctggcattcggggccacaggcttcctcattcaactccagtgaagaagtctctcccccatcccttggatctggatgtagctactcaggtcatgtgcccacctctggactgtcaggcctctgagcccaagctaagccatcatatcccctgtgacctgcacgtatacacccagatggcctgaagcaactgaagatccacaraagaagtgaaaatagccaggtcctgccttagctgatgacattccaccattgtgatctgttcctgccccaccctaactgatcaactgaccttatgacaatacaccctccctgcccttgcgataatggactctgtgatattcccctgcccttaagaaggtacttcataatattctccccgcccttgagaatgtactttgtgagatctactccctgcccacaaaaaattgcttctaactccaccgcctatcccaaacctataagaactaatgataatcccaccaccctttgctgactcctttt

SEQ ID NO: 182189 - DNA, 601 bp, Human
gcagggggctctgttcacctctttatttgcatttggtgtcttcacattttaagaaaaccaaagcaagtaagttggtgctggcaggatatgtttttaagaaaatgaagatgttacctccaattatcacgccttctttatttccctttattctgcatatcaataaatctggaattgacttaggacacttagtgactgtattactacagaaacagtcaaaatacttcaactggaagtacaaaatacttcagctaaaagtacaaaacttcagctcaaagtggcttaaacgtaatcacatttattrtttcttaaaacgagaagtccagggctggatccaatgtctcaattatgttatggaaggcctgggttattttctctgcctgccccaacagcatcaactgtaaggctggcattcggggccacaggcttcctcattcaactccagtgaagaagtctctcccccatcccttggatctggatgtagctactcaggtcatgtgcccacctctggactgtcaggcctctgagcccaagctaagccatcatatcccctgtgacctgcacgtatacacccagatggcctgaagcaactgaagatccacaa

SEQ ID NO: 182190 - DNA, 601 bp, Human
gggcaatttattttgaagcctgcacatctccgtggaaaaattcataaacctgtcacagagaattacacccgccacctaagctttcagactccctttaaaaacttgagaagacactgtagctcttcaattgcaagaagtggggagctgatacctaacactgtgggacaaactgccggcctgattctttccagaaggagaggatgataaaaataacttacacttgactagcaattcaccacttacaaactactttcacacatattactgcatttttactttgggaggaaagtctttagcccawaagaaaatgaaacacactactgttgagtaatcctgccaaataaataggaagtgcatcttaacaaacccagctggacaacagcgtgagctaatgttaggatcccactatagactaaaaaactcctaaaggtagctttcttcctatttatagttaaaagaatagccaagattagtgcacactaaaagacagtggtaagtgctaaggatatttaaaatatcattcaaaagtcggccaggcgcagtggctcatgcctgtaatcccaacactctgggaggctggggcgggtggctcactgaggct

SEQ ID NO: 182191 - DNA, 601 bp, Human
cagctgcttcctcttctctcccgatgaagggatggctcaaaagtgccagcagcacgagccatggcagacacacagctcagggcctcaggctctgcttccttccactcccaggcctgacagaacccacagggctcaccgcatgcgcacaggcaaccagggcacaggagcagcagggccttccctcccctcctgctgctcacgcagctcctgctgtgcttttcaggcagctccttcatgtcttattcccattttaagaaatggaactcaaaatgtttggacctccgggatttggaattcctcraatgttacaggatatttatatcacagttctgataacaggtgcactaagtcagccacaaaagttacagaatatgaaaacacgacgctccactgggctgcatgagcatgctcgcctttcgaggtgacgcagcctcatcccttcatgctgaaagggcaatttattttgaagcctgcacatctccgtggaaaaattcataaacctgtcacagagaattacacccgccacctaagctttcagactccctttaaaaacttgagaagacactgtagctcttcaattgcaagaagtggggagctgata

SEQ ID NO: 182192 - DNA, 601 bp, Human
tttttctctttttttttttgagacggagtctcgctctgtcgcccaggctggaatgcagtggtgcgatctcggatcaccgcaagctccacctcccgggttcacaccattctcctgcctcagcctcccaagtagctgggactacaggcacccgccaccacgcctagctaattttttatatttttagtagagacagggtttcaccatgttagccaggatggtctcgatctcctgaccttgtgatccgcccgcctcggcctcccaaagtgctgggattacaggcttgagccactgcgcccagccytaagcactttttcaattctggtaaaagctgtggcctagtcctccccgaccccaacatccacgacgcacactgagaccacagggcacacagggccgccctccatggggagcagctgtcctcgaggctgatcttgcttttccttcctctgagacggcttcctctcggctcagcctccttgggacgggggtgccgtcaacccagctgcttcctcttctctcccgatgaagggatggctcaaaagtgccagcagcacgagccatggcagacacacagctcagggcctcaggctctgcttccttc

SEQ ID NO: 182193 - DNA, 601 bp, Human
tattagagtttgtgtcagcaaatatgtttttgtttattgtgataacacaatgtgggacaaagcaatacttacgtcccttactttaaatatatgtacatatgccattagtcatgtatactgaattatttgtgtatatttaaaacaaagacatataagcattctcttcatcgcaaattagatcagaaatcctccagaggtacccagatacaaatgctgtccccacaaagtccacgaagcctctcccctccacagcactctgtggaagcccctctgctttgactcactcctggacagcccctcygccctctgtccacgcagctttgccctgacactgtgtcatttcactcctacctgctgccactgcatacctcgtggggccctccctccgtgcttgtcatccctagccttccttcaatatggcttctagcaccacaatgctactggttctgctttcttcaaggagcccagacatctggacactggctctcggggcctctactcagtcctcagcctcttggtcttgttttctgctccttttccaggctctcccttcaccaagcaactccgaacccctcagcaactctgccttccctttctatag

SEQ ID NO: 182194 - DNA, 601 bp, Human
aacagaattctcagaattcctcatctattaaaatgaaggcaacacataatttttacgtttcaaattaaacgtaggtttaatttataaattcggcatggcacaggagaaaacacacaagctgaggtagagggtttatagtcaggggccaggatatgaatgccaaatggggtactgcctaactgactggccttggcaagtaaatctttcacattctctgagcctgtttccttgtcaatataatacaaagtacatccatctcaaagagttttatacagcacattgtataatacatgtaaaacargtacaaatgtaataataactattagggctctcattggctactctgcttcctttggccatgcagattatcacatacttatggcctgaaagaattaccttttcaagaattaccttttggtttggttttctgggaagttcagtttatggagaatacgttttaaatattagagtttgtgtcagcaaatatgtttttgtttattgtgataacacaatgtgggacaaagcaatacttacgtcccttactttaaatatatgtacatatgccattagtcatgtatactgaattatttgtgtatattta

SEQ ID NO: 182195 - DNA, 601 bp, Human
ggtcagctctgatacatatgcagagcctgaatcacaaccagattagtcccacttccacacatgtcaaaatacattaaaataagcagatgtcagtaaccataacagaaataccactggcaaacagaattctcagaattcctcatctattaaaatgaaggcaacacataatttttacgtttcaaattaaacgtaggtttaatttataaattcggcatggcacaggagaaaacacacaagctgaggtagagggtttatagtcaggggccaggatatgaatgccaaatggggtactgcctaactractggccttggcaagtaaatctttcacattctctgagcctgtttccttgtcaatataatacaaagtacatccatctcaaagagttttatacagcacattgtataatacatgtaaaacaagtacaaatgtaataataactattagggctctcattggctactctgcttcctttggccatgcagattatcacatacttatggcctgaaagaattaccttttcaagaattaccttttggtttggttttctgggaagttcagtttatggagaatacgttttaaatattagagtttgtgtcagca

SEQ ID NO: 182196 - DNA, 601 bp, Human
ttcaagcgattctcctgcctcagcctcctgagtagctgggactacaggcgctcgccaccacacccagctaatttttgtatttttagtagagacagggtttcaccatgttggccaggctggtctcgaactcctgacctcaggtgatccacctgcatcgccctctcaaagtgctgggattacaagcatgagctaccacacccagcaagggattttacaatgaaacagtttcagaaggtacaactatgactctatttgtaatattcaccatgggatacagaagaaggaatgatcagacttgagracgtgaaatctggaaaggccctctggaaggtggtttcaagctggattttgaaggtataggaacataaagtatctacccatttaaatgattatgagatggagtcataaaactttatatagtaggctattttatatttctgacttttttctttccaaaaagatgctattccctcaaccttcacagtaaattacaactcccttataatggaatgtaacatcttggcttcttccattagctcatctgtttctcaattacactctggcaacagattcctcacttctctctttccaaaatcgcttc

SEQ ID NO: 182197 - DNA, 601 bp, Human
ctaactctcatgagtgtactccaagctgaagcgcaccctcccacggcaccatccccagccagggcaggttcagcacgctggctcggcagcattgtctgaagaggggacacaaagctccctcactgtattctgtggaagacaaaaaagaaacacaactgctctcttaccaagtccttactttcttacctagttagggatttttctttttttttcttttttttttttttttttttgagaccaagtctccctctgtccccaggctggagtgcagtggtgtgatcttggctcactgcaacctccrcatcccaggttcaagcgattctcctgcctcagcctcctgagtagctgggactacaggcgctcgccaccacacccagctaatttttgtatttttagtagagacagggtttcaccatgttggccaggctggtctcgaactcctgacctcaggtgatccacctgcatcgccctctcaaagtgctgggattacaagcatgagctaccacacccagcaagggattttacaatgaaacagtttcagaaggtacaactatgactctatttgtaatattcaccatgggatacagaagaaggaatgatc

SEQ ID NO: 182198 - DNA, 601 bp, Human
tcctacaatactcctttgcccatagctgcctcagacccttcccctgccacccttggcctgtgatgctctgctcaaagatctcagcacaggctgtccttcgcttccttcaggtatccactcaaatacccaaaagagcagctccgcccaacactctctagcctgctcctcatgccactccatttttatttgcattactatatgatatatgccattatatttgtttactatcaagtctcctcacctgaatataagttccatagggaaagaactctgtcttgctcactcctgagcctgacaactrtaacaaatggggctggtccactccctgcattctgacccacccgagtgctgggagctcaacaacaatggtaataaacaggccggcccactccctgcagactaactctcatgagtgtactccaagctgaagcgcaccctcccacggcaccatccccagccagggcaggttcagcacgctggctcggcagcattgtctgaagaggggacacaaagctccctcactgtattctgtggaagacaaaaaagaaacacaactgctctcttaccaagtccttactttcttacctagttagggattttt

SEQ ID NO: 182199 - DNA, 601 bp, Human
atcaggattctaagactgagagtgtcttaaaagtcacgttggtggccaggtgtggtgactcatgcctgtaatcccagcgctttgggaggccaggaggtcaggagttcgagaccagcctggccaacatgctgaaaccctgtctctactaaaaatacaaaaaaatttgctgggcatggtgacacatgcctatagtcctaactactcaggaggctgaggcagcagaatcacttcaacccaggaggtggaggttgcagtgagccgagatcgcaccactgcactccagcctgggcaacagagtgasactccgtctcaaaaaaataaataaaataaaaaataaaagtcatgctggctactgtgagcttcatttatgagccactaatgatggtgaagagaccaagtggctcccccaagccccactcacacagctgggccctctcacccgcccgcctgtaggcttacctgcccagctcagtagcacaggacagtccccagctgcatgtggaaacactgtttccatttagccctggaggacactgcatcttcccggctttcctccgacctcacctggctgttctgtgctccctcatcatcttcatctgca

SEQ ID NO: 182200 - DNA, 601 bp, Human
ccacctcccaatcaggattctaagactgagagtgtcttaaaagtcacgttggtggccaggtgtggtgactcatgcctgtaatcccagcgctttgggaggccaggaggtcaggagttcgagaccagcctggccaacatgctgaaaccctgtctctactaaaaatacaaaaaaatttgctgggcatggtgacacatgcctatagtcctaactactcaggaggctgaggcagcagaatcacttcaacccaggaggtggaggttgcagtgagccgagatcgcaccactgcactccagcctgggcracagagtgagactccgtctcaaaaaaataaataaaataaaaaataaaagtcatgctggctactgtgagcttcatttatgagccactaatgatggtgaagagaccaagtggctcccccaagccccactcacacagctgggccctctcacccgcccgcctgtaggcttacctgcccagctcagtagcacaggacagtccccagctgcatgtggaaacactgtttccatttagccctggaggacactgcatcttcccggctttcctccgacctcacctggctgttctgtgctccctcatcatc

SEQ ID NO: 182201 - DNA, 601 bp, Human
aataatctcccaccggttccctcccacaacacatgggaattatgggagctacaagatgagatatggggaggggggggggacacagggccaaaccatatcaccaaccaaaactaattatctgattctctaaccaaggagagttattgagctttaaacattaaaacagatcagattcacatttaatattgccataggaacctttgtattaaagtagcaatttgagtacatttagtgctatcatataagaacaatactttcataggtgatgtttacttctgccctttttatgagtgaccctcayccaagtgcagtggtcttactgctgccatctgcaatgaggggaacgagttctggagggttcaatgccttgccctgtcttatctaaaagggctgacaaacagtgaaactaacacaaaaaggcaacatgcctgtggaaattgacaacaatccttgacacacaagcatgggaaatgggagggcaggtgtgctttcagcctgttcttggagaacatttaaactataaaaagggcctttgataaaaacagatcaatttcaaggcaaatcgacaaaagtactgaccataagatccgttaagttacaa

SEQ ID NO: 182202 - DNA, 601 bp, Human
agtgggaaaatctccaaatagccaaaaatctcatttagaaaaactccgatttcacattaggaaatgctgataaacaataactctcaagcactgctggtggaatatgggagtataaatttaaaatactaccctggaaagcaaattgttcatttttattcatgttgaatatgcacatttaccaaataattccacttccatgtaaccagaaaatgcacagctgtatacagtgctgttttgtaatgaggaaaaaaaatcaacagagaaatgaataaagtatttactgacaaaaaaaaaaaaaaamaaaactgaatgcctttaacagcacccaggttatctcttgaattctttgctgcttagaaatttcttccaccagttaccctaaatcatctctctcaagttcaaagttccacagacctctaaggcaggggcaaaatgccaccagtctctttactaaaacataacatgacaagagtcacctttgctccagttcccaacaagttcttcatctctgtctgagaccacctcagcctggactttattgtccatatcattatcagcattttggtcaaagccattcaccaagtctctaggaagttccaca

SEQ ID NO: 182203 - DNA, 601 bp, Human
tttctcctcagaaaacaggattttcttttcaatcgcattgtcaggctgcaaattttccaaaccacttcccttataaaactgaatgccttgcattacttcccgttttcacgatctgctgctcgtctcaggctcgtagttcgccttcaacatgccggagccagcgaagtccgctcccgcgcccaagaagggctcgaagaaagccgtgactaaggcgcagaagaaggacggcaggaagcgcaagcgcagccgcaaggagagctactccgtatacgtgtacaaggtgctgaagcaggtccacccygacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaattgatgcctgcagctcctggggaaagtggaagtcagataactcctttatgaaaaggcagcat

SEQ ID NO: 182204 - DNA, 601 bp, Human
tttctccactgtcttagggcttaacattcagctccttgttacttatgcaaatttctttagccagtctgaatttctcctcagaaaacaggattttcttttcaatcgcattgtcaggctgcaaattttccaaaccacttcccttataaaactgaatgccttgcattacttcccgttttcacgatctgctgctcgtctcaggctcgtagttcgccttcaacatgccggagccagcgaagtccgctcccgcgcccaagaagggctcgaagaaagccgtgactaaggcgcagaagaaggacggcargaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaac

SEQ ID NO: 182205 - DNA, 601 bp, Human
gtaaacttctgcctagacaaccaggcatttccatacatcctctaaactcttggcagaggttcccaaaacccaatttttgacttctgtgcactgacaggctcaataccacatggaagctcccaaggcttgaggcttgcaccttctgaagcaggacctgagcactatgttggcccctttcagccatggttggagtgacagggacacagggcaccaagtccctaggctgcacaaagcacagggaccctgggcctggcccatgaaaccactttttcctcctaggcctctaggcctatgatgggaygggctgccacaaaagtctgtgacatggctggagacattttctccactgtcttagggcttaacattcagctccttgttacttatgcaaatttctttagccagtctgaatttctcctcagaaaacaggattttcttttcaatcgcattgtcaggctgcaaattttccaaaccacttcccttataaaactgaatgccttgcattacttcccgttttcacgatctgctgctcgtctcaggctcgtagttcgccttcaacatgccggagccagcgaagtccgctcccgcgcccaagaagggctcg

SEQ ID NO: 182206 - DNA, 601 bp, Human
ctacccaccctaacccttactgacacatccactccgattcctggctctaccaggatcctcatggcctgggctcacatcctgctctgccacttgctccctgggtgaatcagcactgacctggcagggctggcaagttaatgcatggaaagtgctcacaatagggctcaacacagaggaagcactgagaactgctcacgatcaccaccatcacctcatcaagtactttgtactgtctgaatctagttcatttaagtcttgccttctcggcaaatttcaagttctgtcacacagtatgcaaggyggtaaccctcacagatccaaaccagtgctgtgtacactcccagctgacattgcacctgaacacataccactgtggtgagcagggttggctggacccattgagatgtgcctgcatcacagtgaggcctaatgcacgtgaaatgcctggagtttcccagtcaagtaggagttgctgtccataccctgcatcagggactatgttcatggggtgtgccagcccaggctgtctgtcaatgcgtgctcccacactgtctagtagactaagatctgatatcaggtaaattctaaaaataaataatgc

SEQ ID NO: 182207 - DNA, 601 bp, Human
acaggcaaatattttatagctaagaccttgaaagcacagacaacaaacaaaaatagacaaatgagactatattgaactaaaaaccttctgcacagcaaaagaaacaacagaatgaagagacaatgtgctgaatgggagaaactatttgcaaactattcctctgacaaggggatctatctaaaaggaactcaaacaactcaaataaaagaacaaataatcccattaaaaagtgagcaaaagatttgaacagatattcctcaaaataagccatacaaatggtcaataagtatacaaaaaaaamccactaatcatcagggaaatgcaaactgaaatcacaatgagatatcatcttacccagttagaatggctatcactaaaaagacaaaaaacagatgctggcgaggatgtggagaaaagggaacttttacacattgttgataggcatgtaaattagaatagccactacagaaaacagtatggagatttctcaagaaactagaaatagaactaccacgtgatctagcaattccacttctggatatttatccaaaggaaaagtaatcaatatatcaaagggatacccccatgtttattgcagcac

SEQ ID NO: 182208 - DNA, 601 bp, Human
catttggtacaggcaaatattttatagctaagaccttgaaagcacagacaacaaacaaaaatagacaaatgagactatattgaactaaaaaccttctgcacagcaaaagaaacaacagaatgaagagacaatgtgctgaatgggagaaactatttgcaaactattcctctgacaaggggatctatctaaaaggaactcaaacaactcaaataaaagaacaaataatcccattaaaaagtgagcaaaagatttgaacagatattcctcaaaataagccatacaaatggtcaataagtatacaaaaaaaaaccactaatcatcagggaaatgcaaactgaaatcacaatgagatatcatcttacccagttagaatggctatcactaaaaagacaaaaaacagatgctggcgaggatgtggagaaaagggaacttttacacattgttgataggcatgtaaattagaatagccactacagaaaacagtatggagatttctcaagaaactagaaatagaactaccacgtgatctagcaattccacttctggatatttatccaaaggaaaagtaatcaatatatcaaagggatacccccatgtttat

SEQ ID NO: 182209 - DNA, 601 bp, Human
accaaaagaatccaaatagccaatgcaattgtgagcaaaaaaaaagaaaaaagaaaagaaaaagaaaaaagcaagaggcatcatattacctgacttcaaaacagattacaaagctttagtaaccgaaacagcatggtactggtataaaaacagacacacacaccaatggaacagaatccagaatctagaaataaatccacgtatttacaacagaggtgcaagaatataccttgggggaaggacagtctctttgataaatggtgctgggaaaattggatatccatatgcagaagaatgaaaytcgatccctatctctcaccaaatatttaaaaagcaactcaagatggattgaagcttaaatgttagacccaaaactaaaaactactagaagaaaatatagggaatacacttcaggacatttggtacaggcaaatattttatagctaagaccttgaaagcacagacaacaaacaaaaatagacaaatgagactatattgaactaaaaaccttctgcacagcaaaagaaacaacagaatgaagagacaatgtgctgaatgggagaaactatttgcaaactattcctctgacaaggggatctat

SEQ ID NO: 182210 - DNA, 601 bp, Human
gtgcagtggctcacacctgtaatcccaacactttgggaggccgaggtgggtggatcatgaggtcaggaattcaagaccagcctggccaacatggtgaaaccccgtctctactaaaaatacaaaaattagccaggcatggtggcatgcatctgtaatcccagctacttggaaggctgaggcagaagaattgcttgaacctgggaggcagaggttgcagtgagccgagatcacgccactacactccagcctgggtgacagagcaagactccatctcaaacaacaacaacacaaaaaaaaaaaraaaagaaaagacaattataggctaacattcctaatgaatatagacttagaaattctcagcaaaatactagcaaactaaatccaacggcacatcagaaaaataacacatcattatcaaatggaacttaacttatcccagggattcaaggatggttcaacatatgcaaatcaataaacatgatacattacatcaacagaacaaacgacaaaaccatatgatcattcaacagatgctaaaaaagcatttggtaaaattcaacatccttttatgataaaaaccttaaaaaaactaaggatagaa

SEQ ID NO: 182211 - DNA, 601 bp, Human
tacacccagaagtgaaagaacagtaactataatcatgaaaacatatgaaaatataaaaaccactggtagagcaaacacagaaaaaaagaaaaaacttaaatgttaccactacagatcaccaccaaaccacaataataaacaacaagagagaaagaatgaaacaaaggatatacaaaacaatcagaaatcaagtaataaaatgacagaggtaaacctcacatatcaataatagccttgaatgtaaatggattaaattttccactcaaaagatacagactggctcaatgaattaaaaaaaaacaaaaaaaaaacatgacccaactacatgctgcctacacaaaattcatctcacctgtaaagacacatatagactaaaataaagggacaagaaaagatatcccatgcaaatggaaacaaaaagcaagcaggggtagctttatttatgtcagataaaacagattttaagtcaaaaactgtaaaaagagacaaaagaaggtcattatataatgataaaagtatcaattcagcaaaaggatataacaattccaaacatatatgcacccaacgccagagcacccaacaccagagcactagataaagc

SEQ ID NO: 182212 - DNA, 601 bp, Human
agatacatcttcgggaaaatgtcctctcctacgaaagtaaattcaaaaaacttagaagaaatgaccattataccacagagatactaatgcaagggtacaggaaacatgaaaaagcaagaaaatatgacatctcctaaagaaaacaattctccagcaacagattccaatcaaaaagaaatttatggaataccaggaaaataattcaaaatattgatagtaaggaagttcaatagcatacaggagaatgctgaaaaatacaaaggaatttaaaaagcaattcaggataagaatgagaaatttkatccaagagatggatattgtattggtcctttctcacgctgctaataaagacatacccaagactgggtgatttataaaggaaagaggtttaactgaaagaggtttaattgactcatagttcagcatggctgaggaggcctcaagaaacttacaatcatggcagaaggtgaagcaaacacattcttcttcacacagaggcaggaagaagtgctcagcaaagggggaaaagcccctcataaaaacatcagatcttgtgaggactcactcactatcacgagaacagcatgggggtcactgcccc

SEQ ID NO: 182213 - DNA, 601 bp, Human
tgctaggctgggatcaactgggagtcagcagtggctccctaattgggggaaagggtaagtgaaagacccttcccagcagttcacattgctgctgtggacttctacaatccacagccctgggagagtccttcaattctagaggaccccaagactactgcggagagctgcctgaagactgtacaaaggcactgctccacagagagcccacgctgggtgccacaaccccccaaatcctaagctgctgtggcatggcaccacttggagagtacaacccccaatgaactgcagcctgccccgccaycagggtggaggtgggagccacagggagtgatcccccacaccatccctgcagatgggtagccatgtattttcatgagctccaaggtcaaagtcgactacctgcaactgctaccactatgagctgctgcaggcctgaggtgaggtgcaatcaaagcccatgccccctaggtgcctgactacagctgctcccagggaaagaaaccctgccctccccagtagcagggacacaatgaaactctggccacccctacctgagcattccacgggaggcctaggaatcacctcgatgctacttaccaca

SEQ ID NO: 182214 - DNA, 601 bp, Human
tttcatgtacaaaattactaaaagtactatataaaattaccttcgggctatgtctatcacaggtatatgaaatacatatgaacatgtttagacttgggtcctatccccaaggtatctcattatggatatgcaaatattccaaaatccaaaacaatctgaaatctgaaacacttcctgtcccaagcatttcaaataagggatattcaacctgtactatagagcagtggttctcaaccagggcgaggggcattttgccatcccagagggcaatctgaacatctggaaacatttttgattgtcmcaagtgggagacactattggtatctggtgggtaaagaccaggaagactgctaaaatccctacagtgaacagggcagccccacagcagagcatcattaagcctgaaacgtcagcagtgctgagaaaccctacgaggtggcagtgaaaatgaaccacagctacatgcaacagcacgatggacctcactagcaaagtgctcaatgaaaaagccaacatcaaagtatggtttcatttatataatgttcaaaaatgggaaaatgggagtgggtagtgatgaggaagaagcacacgcatttcctgg

SEQ ID NO: 182215 - DNA, 601 bp, Human
acatcttatcctaaagctggtgcacgctgacttaggttccttagaaagaaggctccaccaggcacgggcatctgtctgataggaagcaaggtctacaaactccctccttgcccatacttctcttcaccgccccttcctattctccatgtcacactcactgtcaacatcaaggtagctcaatgtttcccaaactgggtccctcaggacactagttccccacaatggtaagagggttttcatatgtcccacgctcacacccagtgggaaggggaagggagggaaaaacaaaatggcactcagrgttaagtcacagctaactgagaacaaggagatggcactgagacaccctagctccacatgcccttgtgatagctcttgtcgcaggcattgatttcccagtgccacatttctcagacatgggcactcatgctaacacaaagaaaactcaccaaactcggcctggaggacaccctgacagctatgctggctccttggtacttgctggtgggctcctcaggcacatgctcacagggccctattgtcaaccacaccttcaaatgacaataaacaaatctatctttacttatctgctaattgtctg

SEQ ID NO: 182216 - DNA, 601 bp, Human
cctcagggccccagtgacaggtgtgctctgtcattctggggtacgttctcctgccacacatggcctcacagagtctgggatacttacaagccccaccatcccagggtcttgagtcattattacacagtgtcacatcccctgggaccggagctgccactgagccctgttggctccggttccggaactgcagccataccctggctccccaggcccaagcccccagagcaccccttcttcctcagagttccgccagtgctgtaccctgccccaccccctggggtagaatcacagttacaacctsgccccctgggcccgagctgctagagggtgcctcagagtcacagatcctggctctgagggccacctaaatccaaccctgccataagagagcaaacctgtaccccaagacccacatgccacaataggggtcgcaacccagccctgcaaccattacaagcacctacacctggaacccagcaccatggcagctgcttgtaggccatgtcagagcagacatcaaaggaattcccctcagctaagtctccccattgcaaggaaaatgagaccaggaggaccccaaaagcccttgataccaaggaca

SEQ ID NO: 182217 - DNA, 601 bp, Human
gagacacctctctccctgcagagtggagtcatggatacgctgcttcccaccctcctcagggccccagtgacaggtgtgctctgtcattctggggtacgttctcctgccacacatggcctcacagagtctgggatacttacaagccccaccatcccagggtcttgagtcattattacacagtgtcacatcccctgggaccggagctgccactgagccctgttggctccggttccggaactgcagccataccctggctccccaggcccaagcccccagagcaccccttcttcctcagagttcsgccagtgctgtaccctgccccaccccctggggtagaatcacagttacaacctggccccctgggcccgagctgctagagggtgcctcagagtcacagatcctggctctgagggccacctaaatccaaccctgccataagagagcaaacctgtaccccaagacccacatgccacaataggggtcgcaacccagccctgcaaccattacaagcacctacacctggaacccagcaccatggcagctgcttgtaggccatgtcagagcagacatcaaaggaattcccctcagctaagtctcccca

SEQ ID NO: 182218 - DNA, 601 bp, Human
agagcagtagctgagcccagacatcccaccttacaggccaaacaactcaactgcctgcttccctagagctgaactagccccccaccccagtctgagctgctgagacacctctctccctgcagagtggagtcatggatacgctgcttcccaccctcctcagggccccagtgacaggtgtgctctgtcattctggggtacgttctcctgccacacatggcctcacagagtctgggatacttacaagccccaccatcccagggtcttgagtcattattacacagtgtcacatcccctgggaccrgagctgccactgagccctgttggctccggttccggaactgcagccataccctggctccccaggcccaagcccccagagcaccccttcttcctcagagttccgccagtgctgtaccctgccccaccccctggggtagaatcacagttacaacctggccccctgggcccgagctgctagagggtgcctcagagtcacagatcctggctctgagggccacctaaatccaaccctgccataagagagcaaacctgtaccccaagacccacatgccacaataggggtcgcaacccagccctgcaa

SEQ ID NO: 182219 - DNA, 601 bp, Human
aaaagaatgtgaatggctgataacgcaccaaaactctgctcacaacataggtagaagaataacacagagctcaggtctaatcatgaaaagcctcattacttgagactgagaacatttacgatagtcatggctgaactttgggtttaaagacacatgaggcaacttaaatgaaaaagaaaattgcctgacatcagcagaaagatgacacagatgttcaaattatctgatatgatttatggtggttttaaatcggccatcaaaaaatttctttagtgagcaactgtgctagaaaccaatgagaaaaaaacaacatataaagaaaaccaaaatggaaaaattaaaacagaaaaaataaaataactgaaattaaaatcttggtgaagacagaatggaggggacagaggcaaaaaaaaaaaaaaaaaatcagtaaattggaagataggacgacagaaactacccattctgggtaacattatcaagatagccagctagaagtgcctagcattcaaccccctcacagagacagccagaacaatgaatacacaactacatgttaacaaaaacaactgagggagagtgctaaagtgcattagaggagtaa

SEQ ID NO: 182220 - DNA, 601 bp, Human
gagagtacagatgtcccctcttatctgttgctaaaactttctgtggtagtgccggcatgtgtcaaatacaatcaaacttgttcctgtcaggtgctttctgacagtggcaaagctctcagggcacacactgagcattccctcctcctatgggcttcctggccacctccaaagcacatatggattctggaccatgtcagccacatcttaggcaatgccccaggctccttgagcacctaggaacatggagtcatcgagcagcaacataagcccattcttacaagcttcaaagaacaagaaggcaaaaaaaaaaaaaaaatcttccttgaccccaaactggcctccagttctgcccagttcttgactcccttcccaggaatattacaagagtggtctgttgttgctaccgccccacctcaccttcacccttcagtcacgctaccatctgctcactgctgagacagcttctctcaaggtcaccaatgtcctccatgttgtcactgctcagctttcgtctcacttgactcctctggcttttcttggcttccatagcactccttcaccagtccctccttatacttctcctttagatgctagcccaggg

SEQ ID NO: 182221 - DNA, 601 bp, Human
tcagcatcatggctattagaaaaatggaaattaaatccatacctattagaatggctaaaattaaaaaataaaaatctgaaaataccaagtgttgacaagaatgaggaacaactggaatgttcatagattagtggtgaaaatttaaaatggtactgccaggccaggcgcagtggcttacgcctgtaatcccaacactttgggaggctgaggcaggcagatcacctgaggtcaggaacttgagaccagcctggcctccatggtgaaaccccatctctactaaaaatacaaaaattagctgggygtggtggtgcacgcctgtaatcctagctacttgggaggctgaggcaggagaatcacttgaacccacgaggtggaggttgcagtgagccgagatcgtgccactgcactccagcctgggcaatagagcgagactctgtctcaaaaataaataaaataaataaaataaaataaaataaaataaaataataaaataaaataaaataaaataaaataaaataaaataaaataaaataataaaataaaataaaataaaataaaataaaataaataaaatggtacaaccacctgagacaacaatttg

SEQ ID NO: 182222 - DNA, 601 bp, Human
agatataaggatccacagacatatagatggagagaatatgccatatttatggactagaagactcaatattgttaaaatgtcaaatctcctcaaattcatctatataatcaatgcaatgccaaccaaaatccaagttgaaattttagcagaaatcaacaagtaattctcaaatttatttggaaaaacaaaggaactagaccagacaaaacaatttagagaaagagaaatgttggggaattgcagtactagatttcaacatttatggccataaagagtgtggtactggtcaagtgacagagcracagacaaagagataagtgaaataaaattagaggatccaaaaacagaccacagctttgtgaactctcaacaaaggtatacattcaattcaatcaagaaagaataacctttacaacaaatggtgctggaaaaattgaacatccatatgcaaaaacaaagaacttcaatctataccttgcctaacatacaaaaattatacaaaaattaataacatacctaaatgtaaaaccccaaattttaaaacttctggaagaaaacaggagaaaaatctttgtgaccttgaattaggtaacaatttcct

SEQ ID NO: 182223 - DNA, 601 bp, Human
ccctattcaaaatcatactagagatcctagcctgtgcagtaaggcaagaaaaagaaataaaaggtttattgattagaaaggcagaaatgaaactgtctctatttgcagatgatatgattgtctatacagaaaatcccaaagaaactagaaaaaaagttattagaactaattgagtttagcaaagtcacagaatacaaattcaacatacaaaggtcaattgtatccacatacttataacaaaaaattaaaaatctaatgttttttaaaaattaccatatattatataatagcaccaaaacakgaaacacttaagtataaatctcatgaaactatgtgcaagatttctatgctgaaaacaacaaaacacagatataaggatccacagacatatagatggagagaatatgccatatttatggactagaagactcaatattgttaaaatgtcaaatctcctcaaattcatctatataatcaatgcaatgccaaccaaaatccaagttgaaattttagcagaaatcaacaagtaattctcaaatttatttggaaaaacaaaggaactagaccagacaaaacaatttagagaaagagaaatgttggg

SEQ ID NO: 182224 - DNA, 601 bp, Human
tgaagaggcaatggaggccaggcgcagtggctcacacctgtaatcccagcactttgggaggccaaggcgggcggatcacgaggtcaggagtttgagaacagcctggccaacatagtgaaaccccatctctactaaaaatataacaattagctgggtgtggtggcgcacgcctgtaatcccaggtactcaggaggctgaggcaggagaatcccttgaacccaggaagcagaggttgcagtgagctgagattgcgccactgcactccagcctgggcaacaaagtgagactctgtctcaaaaacaaacaaacaaacaaacaaacaaacaaacaaaagaaggcaaaggaaacaaaaggctcattgtcaagtgacaatcaacagaagcagacacacagataacctggaataataatacaggaatttcagaaaaagaatctgaaataaatatgatcaatagatgggaaaacactgttttaaggtacttacactatacctgaagcagcggattattatttaaaggtaaacagtcatgcaatgtataacatttcagagagcttcattgtcaaattctatcaaaaaattagaacagaaataatagaaatt

SEQ ID NO: 182225 - DNA, 601 bp, Human
cctcagctttcctctgtaactgaggcaggagtttcccaagtaactgagataacaggtgtgtgccaccatgcctcgctaattttttgtatttttagtagagatggagtttcatcatattggtcaggttggtctcgaactcctaacctcaagtgatccacccaccttggcctcccaaagtgctgggattacaggcgtgagccaccgcgcctggcctagaataaaatgttctactgcaatctacccctcaaggggttcctggcctttctgaataacacgtttgacagtttagaaaactacaggmtaacccagaaacacagtcactgcttgatataaaagcttagctcataaaagcagcatcaaaaaactcaatagtctaataaccatcatcttcaaatattacagtcatacaattttaaagtgttaaactagaaagatgagggctttctctgtttgctagtgaggactaaactctgattttttttatcttgcccaaattcctatctaaggggtctggggagtcatgtcctacaaatcacaaattctcatcagatgggttttatttaaccctatatatcatgactttccaacctgactctggcat

SEQ ID NO: 182226 - DNA, 601 bp, Human
ccaggatgcgttgcaggggcagggagctccggaactcagaggccgacttggagaagacttcaggttccagaaccacagactggacaagcctcagtacatgaaggcacacctctgcatctggatctagggaaaagaggtaatgcttctggttagaataaaattttcttttttctttttgttttatttttttgagacagagtctcgctctgtcacccaggctggagtgcggtggcatgatctctgctcactgcaacctccgcctcccaggctcaagagactctcctgcctcagctttcctctrtaactgaggcaggagtttcccaagtaactgagataacaggtgtgtgccaccatgcctcgctaattttttgtatttttagtagagatggagtttcatcatattggtcaggttggtctcgaactcctaacctcaagtgatccacccaccttggcctcccaaagtgctgggattacaggcgtgagccaccgcgcctggcctagaataaaatgttctactgcaatctacccctcaaggggttcctggcctttctgaataacacgtttgacagtttagaaaactacaggataacccagaaacaca

SEQ ID NO: 182227 - DNA, 601 bp, Human; identical to SEQ ID NO: 35530

SEQ ID NO: 182228 - DNA, 601 bp, Human; identical to SEQ ID NO: 35531

SEQ ID NO: 182229 - DNA, 601 bp, Human
caatgtcctttgttctcgaactcccagtgactcgaggggtgtcctctgattgctcacctcaggtggagcctcgaaaggatggcgctgctgttcctacctcgggtctccccagtgcacggcatccttacctgtgggctccacagggttccatgcaggcattttgctcccataccccgatgtccaagcccggctggacaaggagaagcaatgtgatgaccgaggggctgagatggctggagacccagcgagcctggaccagccttagtgggcacaggagggaatgggggacagagcctggaartggccttggggccagtgtttgccgcttctagctgcagttccaaggggacgtgtccccaaagtctagagctgctcttgcaagagtttgttcttgattttgatcatcacatgtggcttaggactccaaagccttgttcacatagctgaatgtgaggaaagaaaacttagaaactggcagaacatagcctctggctgggccccagagatttgcctcaaggctacttggaatgagactggagaatgcctcaggggtgtggcatgtagcagggcggctggagaggcgccttatggggactgaccc

SEQ ID NO: 182230 - DNA, 601 bp, Human
agctcctgacctcaggtgatctgcctgcctcggcctcccaaagtgctgggattacaggcgtgagccaccgtgcccggcccaaagatcctttttccaaatagagtccccttcacaggtttcagttaaacatatccttcgagggtccagcattcaatctggaaggagccttcagagaaatttgaaagtggcataaaccaaggggtgaattaaaggcccagaagttgatgacgtcaagacgtcctttttggaagtgaggggagcagcacagctgtgagtctccaaactgggctgtgcagagatygtcccaagcacgtctgaggccagtagctgccctgtggggagaggcaagcctgtcctgtcactgtgcatcccgtccagatggacaggtagtagattcccgctggctgggtgacatccgtgtccttcatctgtcagcctctggagccgccgaggctgggtgccaggcactgccgcctgggacacatgtgacctccgtgctgcaggaccacagtgcaggtgcgctttcacagggccgctcctagggaggaggttgtggacatcagacattccatgattggattccatggctttgagaatctca

SEQ ID NO: 182231 - DNA, 601 bp, Human
caggtttcagttaaacatatccttcgagggtccagcattcaatctggaaggagccttcagagaaatttgaaagtggcataaaccaaggggtgaattaaaggcccagaagttgatgacgtcaagacgtcctttttggaagtgaggggagcagcacagctgtgagtctccaaactgggctgtgcagagattgtcccaagcacgtctgaggccagtagctgccctgtggggagaggcaagcctgtcctgtcactgtgcatcccgtccagatggacaggtagtagattcccgctggctgggtgayatccgtgtccttcatctgtcagcctctggagccgccgaggctgggtgccaggcactgccgcctgggacacatgtgacctccgtgctgcaggaccacagtgcaggtgcgctttcacagggccgctcctagggaggaggttgtggacatcagacattccatgattggattccatggctttgagaatctcacttggggccttagctcgagacccatttaaataccacatcgcagagaccagaaggcaagaccatgggactccctgcagcccccaccagaagaccctgtgaggtggctggctcc

SEQ ID NO: 182232 - DNA, 601 bp, Human
tacctgctgtgacattggcaaaagtagctgtggcagaggccgagggtcccacctgcttactgggccccgcttctccggacaggagcagaagctgcagagctttgggacctcagcacttgagcagcatgtggacgcgagcagcgagtaaccccgggctcccagagacgcgtgacggggtccccagggggttgcttgagggccctcaagtcaggagctgatttctatcctcaaatatttaagcatccccaagcccaggtgcggtggctcacacctataatcccagtactttaggaggccgagrtggggggatcacttgagcctgggagtttgagaccaccgtgggcaacatagcaagactccagctctacaagaaaaaaaaaaaaaagctggctatgtgactcacatctgtagtcccacctacttgggaaggtgaagtgggaggatcacctgatcccaggaggtggaggatgcagtgacctgtgatggtgccactgcactccagcctgggtgacagagtgagaccctgtctcaaaaaaaaaaaaaagtaaaaaataaacatgtatggaagtacaatgtatttttaaccagaaagttgacagag

SEQ ID NO: 182233 - DNA, 601 bp, Human
ccccgcttctccggacaggagcagaagctgcagagctttgggacctcagcacttgagcagcatgtggacgcgagcagcgagtaaccccgggctcccagagacgcgtgacggggtccccagggggttgcttgagggccctcaagtcaggagctgatttctatcctcaaatatttaagcatccccaagcccaggtgcggtggctcacacctataatcccagtactttaggaggccgaggtggggggatcacttgagcctgggagtttgagaccaccgtgggcaacatagcaagactccagctytacaagaaaaaaaaaaaaaagctggctatgtgactcacatctgtagtcccacctacttgggaaggtgaagtgggaggatcacctgatcccaggaggtggaggatgcagtgacctgtgatggtgccactgcactccagcctgggtgacagagtgagaccctgtctcaaaaaaaaaaaaaagtaaaaaataaacatgtatggaagtacaatgtatttttaaccagaaagttgacagagaataccgatgcactaggtagaccctgttttaaaaaaaaaaaaatcccctgctctgcaaagtggc

SEQ ID NO: 182234 - DNA, 601 bp, Human
ggaaacaggtgttgtttctggtatttcttctttttctttcatctttctccaagaaggaagaaaattggctagttttttgcttttctgactcccttagtttgggactgaggtttctgttattcttgtttggctgtcatggagaaaaacaagaacttatcggtcccgttttccattttttctttttcttttttttttttttttttttgagacggagtctcactctgtcacccaggctggagtgcagtggcgtgatcttggctcactgcagcctcctcctcctcccaggttcacgccattctcmtgcctcagcctcccaggtagctgggactacaggcgcccgccaccacaccaggcaaatttttctgtatttttagtagagacagggtttcaccatgttagccaggatggtctcgatatcctgacctcgggatctgcccgcctcggccttccaaagtgctgggattacggctgagccaccgcgcccggccaatttttgtattttggtagagacggggtttcaccatgttggccaggctggtcttgaactcctgacctcaggcaatccacccacctcagcctcccaaagtgttgggattacagg

SEQ ID NO: 182235 - DNA, 601 bp, Human
ccacccacctcagcctcccaaagtgttgggattacaggcatgagccactgcacccagcctattggtcccattttctgatctatttttccctcttgcctctggctctagcccacatcggtgcatgtgtgtgtgtgtatgtgggtgtgcatgtgtgtacgtggtgtgtttgtgtacactgtgtgtgtatgtgggtgtgcatgtgtgtacatggtgtgtgtgtatgtgggtgtgcttgtgtgtacatggcatgcatgtgtgcatgtgggatgcatgtgtatggggcatgtgtgcatggcgtgtrtgcacatgtctgggcatgcatgcgtgtgtcatgggcatgcatgtgtgtgtatgcggtgtgttgctctgcaggccccagtgttggccggcccccccgtctttcctgtaagtgacttccttcctaggaggcttggtgtgactggcattccctggaaagggaggggcggatccgcagaacgggcagcttcggggacacaggggctgctgattggcattgtggcttgttggccttggtgtctgcgggtgcacacccacacagagcttttgaaatggaatcctgcgtgcccagttcacagagtga

SEQ ID NO: 182236 - DNA, 601 bp, Human
gcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgctyggcgcttgtttacggagttacaccttgcggtagaggctgagcaggagcttgtccttcagacttcccagcggagacagccaggctgtcctgtggcagcagtgggtttgtcagaggccgggggctttggccagggccggcagagagccccagtcctgaagaaccctcgttcttcgcgtgctgtcgcgggggctccgtaggcacggttgcagcagggtcttggaggccgaaagaaggacggtctgagctgagagaggggagttggccaggcacaggggtttcagagctttacaggattcagaa

SEQ ID NO: 182237 - DNA, 601 bp, Human
agagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgcttggcgcttgtttacggagttacaccttgcggtagaggctgagcaggagcttgtccttcagacttcccagcggagacagccaggctgtcctgtggcagcagtgggtttgycagaggccgggggctttggccagggccggcagagagccccagtcctgaagaaccctcgttcttcgcgtgctgtcgcgggggctccgtaggcacggttgcagcagggtcttggaggccgaaagaaggacggtctgagctgagagaggggagttggccaggcacaggggtttcagagctttacaggattcagaaggtgcccggggttctgcagcccagtgaggagttcacagagtggtgggcgacccagcagccaggggcatcagccgtgggagtgggacgctccgggagtctgagctgcat

SEQ ID NO: 182238 - DNA, 601 bp, Human
gagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccattatagggacagggtttactgtaaaacaaggtgattcacatacacagaccagtaatgctgttcctaaaggggcccaagctgatcccatcagtcagcagggctgctcacagggcacytggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcaggcagggtccagtccagaaacagaaaccagagcaacaatcgtagaggccgttgttcagccaggtattgagaaaatagagaaggcaaaaagggaacactggtgtcgtggaggagacccctgccagcattggctccacaca

SEQ ID NO: 182239 - DNA, 601 bp, Human
ccccgccccccgtgcattgtcgtcttctgagtctggctttgtctggcacatgaagttggatgggtagactctggaagcgtccagaccagcttgcgatgctgatgaataagctgattttgatggggtgtgtgaaacggagatgccagcccaggggctcagcttgctcgtgctctcatttaaaagcagaaaatagcgacttcattctcggatacgtttgccagccccaaaggattaattatctacacacccagaagcagtggagcagaatattttggcaggattttcaggatttgtgtcatcrttgcttaatatctgtttcttcacagtcggttagaattttaaaggatttgaaatactgcaagctatctgtgtatagaggctgtggattcgggctggtacatttgcaaagtgcccattttattttttatttttatttttatgttttttgagacatattctcactccgtcacccaggctagagtgcagtggtgccatcagggctcactgcagcctccacctcctgggctcagtgatcctcccacctcagcctcccgagtagctgggactacagacatgtgccaccacgcccggctaatttctg

SEQ ID NO: 182240 - DNA, 601 bp, Human
caccacgcccggctaatttctgtattttttgtagagacagggtttttgccatgttgcccaggctggtcttgaactcctggcctcaaactgtactcctacctcggcctcctaaagtgctgggattacaggcatgagccactgcacctggccgcaaaaaaagttaaagtgctaactttaactttttagattagtaagactgctaacgtgtttcattagttcagtgataataccggcttcaaagaaaagccttggcaaatacaaatcgtaagcagatagctcaactcatcatcacaaagcaaascccacccagtgaagaaacaaatgtgggaagccccggaagcccctccccatccccacccccccccccgccccccccgccctggaaacagccgctgtcctggtgttgacagcagaggtggcactgcctggctttgaacttgaaggtgggactcaggggtggttggctgttcagatgcagcagggagagagggtttggggcattgctggtgcacgggagagggtggggatggccccccaaactagcggaggccgggcttggccctgggagatacaggaaggaggcccccactccgtggattcc

SEQ ID NO: 182241 - DNA, 601 bp, Human
cagccgggactcatttactcccctcttctgagtcagcacctgctggggttcgtgggaccccagacctggctctcttacgcctacctgttccttctctgtcttgcaggttttgggatttgagattgacgcggtgaactctgtccagttttcaaaccacacaggtaaggcgttggctccagcagctggcatagagcagactgtgggtgtgagggacggggcggagtgtgggtgtgagggacggggcggagtgtgggtgtgagggacggggctttcgtgtggacggggacctggagtcctgggygtcgctcgggcagagcctgcacagcatatcagggtgtaggcctgggtggcctcgcctctgagaggggttgtgttgactcagcttggctgctttgaggctgtgtgacccagtgcaggtggcagaacctctcggtgcttcagtttccttctctgtaagacaggagggcaatcctaacacctgccgtgaggttgccagagttgattacgtcacttgcataaaatgcttggaccaatgcctggctcagagcgcagccgtgtgactcctgctgtccacctgcctcctggagctgaggagggtccc

SEQ ID NO: 182242 - DNA, 601 bp, Human
aagcactggactgtggacagacacacgggctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaacatctgcttctcagatctaagtgactgtactcaataaatagcgtggagaccagagctcagtgccttttgcagcctccattttgccactggccccctggctcctacctttatgaactcttttctttttctttttttttttttttggagacggagtctcactctgttgcccaggctggagtgcagtggcgcgatctccactcactgcaagctccaccccctgggttcatgccattctcctgccttagcctcccaagtagctgggactacaggcacccgcaaccacgcccggctaatttttttgtatttttagtagggacggggtttcacagtgttcaccaggttggtctcgatctcctgacctcacacaccacgcccagctaatttttgtattttttagtagagatgaggttttgccacgttggccaggct

SEQ ID NO: 182243 - DNA, 601 bp, Human
tggcagaagcctcctcaggacacaccctccaccggaggggcaggctgctgtgtgaggcactgacctcgcccgcagtggataccacctgcccctcctgaccccagtgactgttaacccagagtccatcaggggcttggtctctggcagacccacccctcagtgcgtacactctggtgtcccgggcagagtacagggcaggcgcccccaggtgcaccccccagatgccgcactgtgcctggagcgtggctcctgatggcagtctcaggacctttgcgccacacgtcctcccgtgcgacggctsctggggaaagccaaaggcgtcccttccagcgggagccagcgactggtacgcaggagggccctcaggggcaggagccatggagccctcctctggtgtgggaattcaggggatcttagccacagggcatggcgcgtgggcgcagagccggccgtgacccacaagtgcgtgatacttgtactttgctattctaggaacccatacatcagttttccttatttgctgaaaaaggcatgcattagaggggtgattcatgtgggaggaggccgggagcccctcgatgtgaggcgtttctcatgggcg

SEQ ID NO: 182244 - DNA, 601 bp, Human
gactacgcaccccactccagccagggtgggctcagggaggtccagagcacccccgccctgggcctgtctcgggtccctgccccttcaaggagggccttggcgtgcccaagccaccatcacacccccggtagcctggggggtcctggccacactatgcctgccgggacaatgactgcccaggctgtgccaagtcacccccactcctgtgaccacactggggttccagtgcccaggggagggtgcaggcagggtgttgggaacgctgaccggggcaggacaggtgggtgggacactcaattasgtgacgggctgctacctggtacactgccatcctttgtcaactttctggttaaaaaaaaattgtatttgtatacatgtttattattattattatttttgagacagggtctcactctgtggcccaggctgtagtgcaatggcacaatcatagctcactgcagcctcaacctcccaggctcaggtgatcctcctgcctcaacatcccaagtagctgggagtaaaggcgtgcaccaccatgcccagctaactttttgtgggtgtgtgtggagacagggttttgccatgttgcccaggctggtct

SEQ ID NO: 182245 - DNA, 601 bp, Human
gctgtccccgtggtgggaacaacttatcgctacagtcggggggcctggcccctgagcctggacttcagggggcttttgggggagcactccgtggtgggcttccctccgcgccccctggcgtgcttccctcacggtgactcagcctctcctcctgtctcctttgttggccagtacgtcccggaggacctccttcccgtctacaaagaaaaagtggtgccgcttgcagacattatcacgcccaaccagtttgaggccgagtaagtcattttattttattttactttatttatttatttttcargatgggtctcgctcttgtcacccaggctggagtgcagtggcacgatcacagctcactgcaacctctgtctccggggttcaagcaattctcctgcctcagcctcccgagtagctgggatgacaggcgtgagccaccacgcccggctaatttttgtatttttagtagtgacggggtttcaccatgttggccaggctggtcttgaactcctgacctcaggtgatccacccatctcagtcttccaaagtgctgggattacaggcatgagtcatcgtgcccagcagagtaagttattttaaatgg

SEQ ID NO: 182246 - DNA, 601 bp, Human
ccccttgatactggagcaggatgtggtgggggcgcctgggttggagaagcccctgcccacctgggtcccaggctcacgtcttctctttggtggtggcagccatgggtgatggggatggttttgctgcccctgtgccttcctgagcggcagggcccctgggagaggaagaggaggggcgacctggggagctgtgggcttgtcggggccaccacagcagagggagggtgggggcagcacaggcggccaggtcacctgccgccctgtgaggggaagaggagtgtgttgggcttggctgtctgayaccgagtttgaaaaggtctttctttgggtgcatggctccccccagctgaagaatcacacaccaggggaagccaccagcgccccagtgccatgaagagtggagctgcccgcggagggggctggtgcctgtcacagcttagctctacctggccctgagccaggtctcgagcccccccattcacgcaggggtgggggcgcctggactcttggaggcctgggatccctgacctgggcctgtccaaacttgggggtggcatctcactcgaggcccctgagccatgggtggcccatgcgtgcatta

SEQ ID NO: 182247 - DNA, 601 bp, Human
ggcatctcactcgaggcccctgagccatgggtggcccatgcgtgcattaatcgctagcggctctttgactttgtatggatgtcagtcacccatgctgagaccctgcgctgtggcatgggccttaagtgggggccgtggctgctgtccatcaccacggttacgtataaacagcagccatgattgggccttacgtgactcctgtaatgtgagggtcccctttagaaccaaaccccacatgttgcaggggccccggcccagggtggccagtggacgaagagttagctgcctgtggggatggggrtttccagagccgctgcggtttggggaatgtcaacacacaacccggagaggagaggctcacctgtccccacccgcctgtccccgcctgtcttccaggttactgagtggccggaagatccacagccaggaggaagccttgcgggtaaggaggccctctggggcctgtgcggggcacatgtgccgctcacggtggggacgggagacaggctgcctgagtggcaccactgtgtcatttctccccagcagtgactgaacagtctgtaccagtcggggcctccagagatcagcaggatatatgtgt

SEQ ID NO: 182248 - DNA, 601 bp, Human
gaagatccacagccaggaggaagccttgcgggtaaggaggccctctggggcctgtgcggggcacatgtgccgctcacggtggggacgggagacaggctgcctgagtggcaccactgtgtcatttctccccagcagtgactgaacagtctgtaccagtcggggcctccagagatcagcaggatatatgtgtgtgtgtacatgtgtggacatgtttgtgcatgtgtgtgtgtgtgtgtgcatgtgtgcgtgtgtgcgcgcgtattgtgtgtgggtgtgtgtgtgtggatgtgtgcgtgtgtgygcgcacccatgtgtgcatgtgtgcacgtgtgtgtgtgcacatgtgcatgtgcgtctgtgtgcatgtgtgtccatgggcgtgtgggcatgggtgtgcacgcatgtgtgtgcgtgtgtgtgcacgtgtttgcacatgtgtgtgcatatgtgtgtgtgtgtgtgtgcacatgtgtgtgaagagctattgtaaggcggtggcttgagctgtgtgggggctcctgggcatgtttgggatttgcagggccagctgttgggaagggcaggctggaggctggacacaggagcagatgcagcagcccaa

SEQ ID NO: 182249 - DNA, 601 bp, Human
aggccctctggggcctgtgcggggcacatgtgccgctcacggtggggacgggagacaggctgcctgagtggcaccactgtgtcatttctccccagcagtgactgaacagtctgtaccagtcggggcctccagagatcagcaggatatatgtgtgtgtgtacatgtgtggacatgtttgtgcatgtgtgtgtgtgtgtgtgcatgtgtgcgtgtgtgcgcgcgtattgtgtgtgggtgtgtgtgtgtggatgtgtgcgtgtgtgtgcgcacccatgtgtgcatgtgtgcacgtgtgtgtgtccacatgtgcatgtgcgtctgtgtgcatgtgtgtccatgggcgtgtgggcatgggtgtgcacgcatgtgtgtgcgtgtgtgtgcacgtgtttgcacatgtgtgtgcatatgtgtgtgtgtgtgtgtgcacatgtgtgtgaagagctattgtaaggcggtggcttgagctgtgtgggggctcctgggcatgtttgggatttgcagggccagctgttgggaagggcaggctggaggctggacacaggagcagatgcagcagcccaaggtgcagtttcttcaaagtcctttttctccgggactt

SEQ ID NO: 182250 - DNA, 601 bp, Human
tctgtaccagtcggggcctccagagatcagcaggatatatgtgtgtgtgtacatgtgtggacatgtttgtgcatgtgtgtgtgtgtgtgtgcatgtgtgcgtgtgtgcgcgcgtattgtgtgtgggtgtgtgtgtgtggatgtgtgcgtgtgtgtgcgcacccatgtgtgcatgtgtgcacgtgtgtgtgtgcacatgtgcatgtgcgtctgtgtgcatgtgtgtccatgggcgtgtgggcatgggtgtgcacgcatgtgtgtgcgtgtgtgtgcacgtgtttgcacatgtgtgtgcatatgtgtgtgtgtgtgtgtgcacatgtgtgtgaagagctattgtaaggcggtggcttgagctgtgtgggggctcctgggcatgtttgggatttgcagggccagctgttgggaagggcaggctggaggctggacacaggagcagatgcagcagcccaaggtgcagtttcttcaaagtcctttttctccgggacttggagaccgtgcgtgtcttgctagcattgaaccttggttgagtcatcttagtctgttggggctgctgtgacaaaatgcctgagactggatgatttataaaaaacagaact

SEQ ID NO: 182251 - DNA, 601 bp, Human
gggagtggggtgtgaccagccgtggctgacatgtgaccggccgtggctgacgctccctgtgccactgctaggtgatggacatgctgcactctatgggccccgacaccgtggtcatcaccagctccgacctgccctccccgcagggcagcaactacctgattgtgctggggagtcagaggaggagtaagtgcccccatcgtgcaccgtggccgcctctgctcttcccagaggaaggtgttctttggggctgcaagaatgttttgggttcaatagcatgaaatttaagccttatccagcaccrggatgacacccccattttacagactctcagggatcaggtgggattcccaagacctcacaggtcacgatgaatggcctggctggaactggcttccacggacccagcatcataggcctccctcagagccaggcggggtccctgagttcactgggaggacgcgtccacccggctgtgctgattgtttacacagacaccacctggttgattttctctgaacagtgtgaaaatgacgcagaaggctggggccatgcactaagctagtggccgcgggttcatacccatgggcccaaaagaacagct

SEQ ID NO: 182252 - DNA, 601 bp, Human
ctgagtgatgattggctgactctgaggcatcactgagtgatgattggctgactctgaggcatcactgagtgatgattggctgactctgaggcatcactgagtgatgattggctgactctgaggcatcactgagtgatgattggctgggctttcggcaggagcacttccccttgtagactcgttataaggagttaattctgggaactcctaccaagctcctgctgcctgccaagttctatgcaggtcacgaggctgtcccttctgtgagccatctcttgtccagagcaggtagctgggaccrggcatctgctcagccctccgggctctccgtggtgggcagtccgcagcctgtcctccagggttcagcacgtgcattggcggagccggctccccggtggctcggagagcaggacggcccttgtgttccctggaaatcccctcctggcagcagtgggcacgtcgggtgttgtgagtgggccaggggcacagcaagtctgtcctccctgcaggtggcctgtgagaagaccgtgtctaccttgcaccacgttctgcagaggaccatccagtgtgcaaaaggtacggcggccgggctgcatgggct

SEQ ID NO: 182253 - DNA, 601 bp, Human
ttccagctgggtacggtggctcaaggatgtaatcccagaactttgggaggctgaggtgggcggatcacttgaggtcaggagtttgagaccagcctagccaaatggcaaaaccccgtttctactaaaaatacaaaaattagctgggcgtggtggcgagcacctgcaatcccagctactcgggaggctaaggcaggagaatcccttgaacctgggaagcggaggttgcagtgggccgagattgtgccactgcactccaccctgggcaagagtgagactgagtctcaaaaacaaaaaaaaaaamcacaggcctcagcatcgcctggacctgttcttgcttggggcatcccgtcggtcaccaaccatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaaggttgccatctgcaacccagcccggtttttatcttgtttttctgtgttttaactttttatttagacttacagtttgaaacagtgctagaatc

SEQ ID NO: 182254 - DNA, 601 bp, Human
aaaaacagttccagctgggtacggtggctcaaggatgtaatcccagaactttgggaggctgaggtgggcggatcacttgaggtcaggagtttgagaccagcctagccaaatggcaaaaccccgtttctactaaaaatacaaaaattagctgggcgtggtggcgagcacctgcaatcccagctactcgggaggctaaggcaggagaatcccttgaacctgggaagcggaggttgcagtgggccgagattgtgccactgcactccaccctgggcaagagtgagactgagtctcaaaaacaaamaaaaaaaacacaggcctcagcatcgcctggacctgttcttgcttggggcatcccgtcggtcaccaaccatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaaggttgccatctgcaacccagcccggtttttatcttgtttttctgtgttttaactttttatttagacttacagtttgaaacagtg

SEQ ID NO: 182255 - DNA, 601 bp, Human
aataataaagtagaaaaaaacagttccagctgggtacggtggctcaaggatgtaatcccagaactttgggaggctgaggtgggcggatcacttgaggtcaggagtttgagaccagcctagccaaatggcaaaaccccgtttctactaaaaatacaaaaattagctgggcgtggtggcgagcacctgcaatcccagctactcgggaggctaaggcaggagaatcccttgaacctgggaagcggaggttgcagtgggccgagattgtgccactgcactccaccctgggcaagagtgagactgmgtctcaaaaacaaaaaaaaaaaacacaggcctcagcatcgcctggacctgttcttgcttggggcatcccgtcggtcaccaaccatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaaggttgccatctgcaacccagcccggtttttatcttgtttttctgtgttttaactttttatttagactta

SEQ ID NO: 182256 - DNA, 601 bp, Human
tgccggcctccagtgtctctggcctgacatgtccagtgtggcacctgtggcacaggacgccacctaccctacccctcaggaggagagaggagaggatttaggagaccagaagtgaggtgctgggttgggaaggggcccagccagcaccccaaggctgtgcagcggggtctggtctgtcttttagagttcagaaaatggttgagaaaatgcggacacacacccccacccagcttcaggcacctgaccctccttttccctatctggaagccaggaagaggcgagaaggaagccggccttgagygggaccaagccagggaggcaggagtggctcgtgggtgtcactgtctgaaccccggcctgcagagggggctccttcagacctggctgagccaggcctgtggtggctgcccacccgcccttttcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagaggggagggcgttgttcaaggatgtctttttgcacaataa

SEQ ID NO: 182257 - DNA, 601 bp, Human
tgggttgggaaggggcccagccagcaccccaaggctgtgcagcggggtctggtctgtcttttagagttcagaaaatggttgagaaaatgcggacacacacccccacccagcttcaggcacctgaccctccttttccctatctggaagccaggaagaggcgagaaggaagccggccttgagtgggaccaagccagggaggcaggagtggctcgtgggtgtcactgtctgaaccccggcctgcagagggggctccttcagacctggctgagccaggcctgtggtggctgcccacccgcccttytcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagaggggagggcgttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggc

SEQ ID NO: 182258 - DNA, 601 bp, Human
ggggtctggtctgtcttttagagttcagaaaatggttgagaaaatgcggacacacacccccacccagcttcaggcacctgaccctccttttccctatctggaagccaggaagaggcgagaaggaagccggccttgagtgggaccaagccagggaggcaggagtggctcgtgggtgtcactgtctgaaccccggcctgcagagggggctccttcagacctggctgagccaggcctgtggtggctgcccacccgcccttttcacagctgtggcaagagcgggagctgctgcttgttgccggcyactggcagtgtcctggagccagtgtggctccacaagtcctgtcctgtgtggctctgggtcacgcctttcctgtgggccaggggtccgtgttgtcgagaggggagggcgttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagac

SEQ ID NO: 182259 - DNA, 601 bp, Human
tggaagccaggaagaggcgagaaggaagccggccttgagtgggaccaagccagggaggcaggagtggctcgtgggtgtcactgtctgaaccccggcctgcagagggggctccttcagacctggctgagccaggcctgtggtggctgcccacccgcccttttcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagcggggagggcgttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagcccca

SEQ ID NO: 182260 - DNA, 601 bp, Human
ggaagaggcgagaaggaagccggccttgagtgggaccaagccagggaggcaggagtggctcgtgggtgtcactgtctgaaccccggcctgcagagggggctccttcagacctggctgagccaggcctgtggtggctgcccacccgcccttttcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagaggggagggygttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagccccaaagcccacc

SEQ ID NO: 182261 - DNA, 601 bp, Human
gccggccttgagtgggaccaagccagggaggcaggagtggctcgtgggtgtcactgtctgaaccccggcctgcagagggggctccttcagacctggctgagccaggcctgtggtggctgcccacccgcccttttcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagaggggagggcgttgttcaaggatgtctwtttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagccccaaagcccacctgtggttccctgaaacac

SEQ ID NO: 182262 - DNA, 601 bp, Human
tgtggtggctgcccacccgcccttttcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagaggggagggcgttgttcaaggatgtctttttgcacaataacctgtgcaaaggtagctagaagacttgaagcaggccgggtgcggtggctcacacctgtaattccagcactttgggtggcctggtgggttgtgggcmcaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagccccaaagcccacctgtggttccctgaaacacagagggtccccaaccagcttccttgtttgcaaagtgggagcatcagcagtggagggttgggaaagttgagagcctggggtggcacgtgccccccccaccccctgccac

SEQ ID NO: 182263 - DNA, 601 bp, Human
acgcctttcctgtgggccaggggtccgtgttgtcgagaggggagggcgttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccacyagggaggcgctttcttggtgaggctggtgaagccccaaagcccacctgtggttccctgaaacacagagggtccccaaccagcttccttgtttgcaaagtgggagcatcagcagtggagggttgggaaagttgagagcctggggtggcacgtgccccccccaccccctgccaccccatgcacagactaaacagagaaggggggctcgctggaggttgctgaagggccagcctggcaggtggttcttgggccagcggggaggggcacccagggtgacaggcggttctggatgctggtggagg

SEQ ID NO: 182264 - DNA, 601 bp, Human
gttgtcgagaggggagggcgttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggygaagccccaaagcccacctgtggttccctgaaacacagagggtccccaaccagcttccttgtttgcaaagtgggagcatcagcagtggagggttgggaaagttgagagcctggggtggcacgtgccccccccaccccctgccaccccatgcacagactaaacagagaaggggggctcgctggaggttgctgaagggccagcctggcaggtggttcttgggccagcggggaggggcacccagggtgacaggcggttctggatgctggtggaggatctggagatgggatgcccctcctggcc

SEQ ID NO: 182265 - DNA, 601 bp, Human
tcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagccccaaagcccacctgtggytccctgaaacacagagggtccccaaccagcttccttgtttgcaaagtgggagcatcagcagtggagggttgggaaagttgagagcctggggtggcacgtgccccccccaccccctgccaccccatgcacagactaaacagagaaggggggctcgctggaggttgctgaagggccagcctggcaggtggttcttgggccagcggggaggggcacccagggtgacaggcggttctggatgctggtggaggatctggagatgggatgcccctcctggccctgtggacaggccggctgggtggg

SEQ ID NO: 182266 - DNA, 601 bp, Human
ggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagccccaaagcccacctgtggttccctgaaacacagagggtccccaaccagcttccttgtttgcaaagtgggagcatcagcagyggagggttgggaaagttgagagcctggggtggcacgtgccccccccaccccctgccaccccatgcacagactaaacagagaaggggggctcgctggaggttgctgaagggccagcctggcaggtggttcttgggccagcggggaggggcacccagggtgacaggcggttctggatgctggtggaggatctggagatgggatgcccctcctggccctgtggacaggccggctgggtgggcctcccatctctgtctgagctgggggttccaactgctcagcctggccccagtgcctgatatg

SEQ ID NO: 182267 - DNA, 601 bp, Human
tgaactcgggaagctccatcccatgagattagacaagaaaggccccgagtctggagggcagacaggttgctgtggggccagcccgcctgcccaccagggaggcgctttcttggtgaggctggtgaagccccaaagcccacctgtggttccctgaaacacagagggtccccaaccagcttccttgtttgcaaagtgggagcatcagcagtggagggttgggaaagttgagagcctggggtggcacgtgccccccccaccccctgccaccccatgcacagactaaacagagaaggggggctcrctggaggttgctgaagggccagcctggcaggtggttcttgggccagcggggaggggcacccagggtgacaggcggttctggatgctggtggaggatctggagatgggatgcccctcctggccctgtggacaggccggctgggtgggcctcccatctctgtctgagctgggggttccaactgctcagcctggccccagtgcctgatatggagtgggcagcgcttcctggctgcagctgggagggtgcccacagtgcacctgctggccgatcatggcatcccagttgggcctgtgccttcct

SEQ ID NO: 182268 - DNA, 601 bp, Human
ggaagcctgtggcatagtgtgcccttctctttgccctctatgtcagccgggcagcaggagagtggggactgggaggcactttctgccccaatgctgaagtctgcgtttgttggatgtatggaacagccagcctcaccatcctgccagtgttgcccagtcctgggacttctcgggccttgatttccccttctgtgaaagggggttggggacaagacaggccaccttgcaagttccttccagccagcccacaagtcctgtcctgtgtggctctgggtcacgcctttcctgttggccaggggtyggtgctgttgagcaggggagggcgttgttcaaggatatctatttgcacaataacctgtgcaaaggtagctagaagacttgaaacaggccgggcgcggtggctcacgcctgtaattccagcactttgggaggctgaggctggtggatcacctgaggttaggagttcaagaccatcctggctaacatggtgaaacctcgtctctactaaaaatacaaaaaattagctgggcatggtggtgcgcatctgtaatcccagctactcaggaggctgaggcaggagaatcgcttgaaccaggaggtg

SEQ ID NO: 182269 - DNA, 601 bp, Human
atctatgtggggatgtgagggaggcactgttcctttagagacggcgttgcttgctcaagtggagaagctgccagtgtgggcagctccagctccctgcacgctctgtgctctgcccattctaacgtctgtgccccttcttctggatggctgccgggcttggctctggcccccctgttggatcccctggctgctgggtggggagagggccacctactgaacctgagggtgggtctgggtgagtcctggctctgctgccacctgctgggctctggaaggtccctcaccctccctctgggatctyattggattcctgtagtgtggggatggtggcagatactctggctgctacgtgagaacagtgtgccgatccctggggtttctcaaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggtcagcacctccagcctctgcaagtacaggggggtgggagggcaggggcttttga

SEQ ID NO: 182270 - DNA, 601 bp, Human
tctatgtggggatgtgagggaggcactgttcctttagagacggcgttgcttgctcaagtggagaagctgccagtgtgggcagctccagctccctgcacgctctgtgctctgcccattctaacgtctgtgccccttcttctggatggctgccgggcttggctctggcccccctgttggatcccctggctgctgggtggggagagggccacctactgaacctgagggtgggtctgggtgagtcctggctctgctgccacctgctgggctctggaaggtccctcaccctccctctgggatctcrttggattcctgtagtgtggggatggtggcagatactctggctgctacgtgagaacagtgtgccgatccctggggtttctcaaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggtcagcacctccagcctctgcaagtacaggggggtgggagggcaggggcttttgag

SEQ ID NO: 182271 - DNA, 601 bp, Human
gggatgtgagggaggcactgttcctttagagacggcgttgcttgctcaagtggagaagctgccagtgtgggcagctccagctccctgcacgctctgtgctctgcccattctaacgtctgtgccccttcttctggatggctgccgggcttggctctggcccccctgttggatcccctggctgctgggtggggagagggccacctactgaacctgagggtgggtctgggtgagtcctggctctgctgccacctgctgggctctggaaggtccctcaccctccctctgggatctcattggattyctgtagtgtggggatggtggcagatactctggctgctacgtgagaacagtgtgccgatccctggggtttctcaaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggtcagcacctccagcctctgcaagtacaggggggtgggagggcaggggcttttgaggggcacga

SEQ ID NO: 182272 - DNA, 601 bp, Human
gtagaggtcgagagtcctctcgtgggggtctccatgttcaagggagctgccgaggcttgagcaggagcccccagcaggtcagcacctccagcctctgcaagtacaggggggtgggagggcaggggcttttgaggggcacgaggcttggggacagaggacccgcatggcttagggatggatggcatggtatgggtgctgggagggaggcaggaagagcagggctggtcccaggggcaagcacaaactcaggcctgttacacggccccagacctcactcagaaggggaccctggccgctggcrtgggtttcctcctctctgaagattaggtggtcttggctgccccttttgtatgaagtcatggatatcttttgagatgggggctctcgggaagaaggtgtggggtacattagcaccagcgtttcctgagtgccgcctcccccgttaatgtccctctccaggaaactggctttgccaaggcccccgctgggacagactgtttctttcactgcagtcctgggagccgagggcaaggggacaggaaagaggaagtgacctcagagcctggtggcaccagcatcatgtccaggctggggggtgagg

SEQ ID NO: 182273 - DNA, 601 bp, Human
ggtgctgggagggaggcaggaagagcagggctggtcccaggggcaagcacaaactcaggcctgttacacggccccagacctcactcagaaggggaccctggccgctggcgtgggtttcctcctctctgaagattaggtggtcttggctgccccttttgtatgaagtcatggatatcttttgagatgggggctctcgggaagaaggtgtggggtacattagcaccagcgtttcctgagtgccgcctcccccgttaatgtccctctccaggaaactggctttgccaaggcccccgctgggacrgactgtttctttcactgcagtcctgggagccgagggcaaggggacaggaaagaggaagtgacctcagagcctggtggcaccagcatcatgtccaggctggggggtgagggtccctgaggccctggggcagggcagtgctgttccctgggtggctgaggccggaggggctctgttctcagtcccccatctcattgcggaggaaggagcccaagccccttccagcaggtgctttcctcagtgcccagaggtgctccccggcttctccatccccacgccgcagcctgaatgtctggggtgggg

SEQ ID NO: 182274 - DNA, 601 bp, Human
ctcctctctgaagattaggtggtcttggctgccccttttgtatgaagtcatggatatcttttgagatgggggctctcgggaagaaggtgtggggtacattagcaccagcgtttcctgagtgccgcctcccccgttaatgtccctctccaggaaactggctttgccaaggcccccgctgggacagactgtttctttcactgcagtcctgggagccgagggcaaggggacaggaaagaggaagtgacctcagagcctggtggcaccagcatcatgtccaggctggggggtgagggtccctgaggccctggggcagggcagtgctgttccctgggtggctgaggccggaggggctctgttctcagtcccccatctcattgcggaggaaggagcccaagccccttccagcaggtgctttcctcagtgcccagaggtgctccccggcttctccatccccacgccgcagcctgaatgtctggggtggggccggtgtgggaggtgccggcctcttttccacctgccccactttttatcctgctctgtggtcaaggcctggccccgtggcctgtgagtgtgggggctccgtggcagaggttggggcggc

SEQ ID NO: 182275 - DNA, 601 bp, Human
cttggctgccccttttgtatgaagtcatggatatcttttgagatgggggctctcgggaagaaggtgtggggtacattagcaccagcgtttcctgagtgccgcctcccccgttaatgtccctctccaggaaactggctttgccaaggcccccgctgggacagactgtttctttcactgcagtcctgggagccgagggcaaggggacaggaaagaggaagtgacctcagagcctggtggcaccagcatcatgtccaggctggggggtgagggtccctgaggccctggggcagggcagtgctgttccctgggtggctgaggccggaggggctctgttctcagtcccccatctcattgcggaggaaggagcccaagccccttccagcaggtgctttcctcagtgcccagaggtgctccccggcttctccatccccacgccgcagcctgaatgtctggggtggggccggtgtgggaggtgccggcctcttttccacctgccccactttttatcctgctctgtggtcaaggcctggccccgtggcctgtgagtgtgggggctccgtggcagaggttggggcggcggggtgtggagttcgggacaccc

SEQ ID NO: 182276 - DNA, 601 bp, Human
ggctgccccttttgtatgaagtcatggatatcttttgagatgggggctctcgggaagaaggtgtggggtacattagcaccagcgtttcctgagtgccgcctcccccgttaatgtccctctccaggaaactggctttgccaaggcccccgctgggacagactgtttctttcactgcagtcctgggagccgagggcaaggggacaggaaagaggaagtgacctcagagcctggtggcaccagcatcatgtccaggctggggggtgagggtccctgaggccctggggcagggcagtgctgttcactgggtggctgaggccggaggggctctgttctcagtcccccatctcattgcggaggaaggagcccaagccccttccagcaggtgctttcctcagtgcccagaggtgctccccggcttctccatccccacgccgcagcctgaatgtctggggtggggccggtgtgggaggtgccggcctcttttccacctgccccactttttatcctgctctgtggtcaaggcctggccccgtggcctgtgagtgtgggggctccgtggcagaggttggggcggcggggtgtggagttcgggacacccaca

SEQ ID NO: 182277 - DNA, 601 bp, Human
gggaagaaggtgtggggtacattagcaccagcgtttcctgagtgccgcctcccccgttaatgtccctctccaggaaactggctttgccaaggcccccgctgggacagactgtttctttcactgcagtcctgggagccgagggcaaggggacaggaaagaggaagtgacctcagagcctggtggcaccagcatcatgtccaggctggggggtgagggtccctgaggccctggggcagggcagtgctgttccctgggtggctgaggccggaggggctctgttctcagtcccccatctcattgyggaggaaggagcccaagccccttccagcaggtgctttcctcagtgcccagaggtgctccccggcttctccatccccacgccgcagcctgaatgtctggggtggggccggtgtgggaggtgccggcctcttttccacctgccccactttttatcctgctctgtggtcaaggcctggccccgtggcctgtgagtgtgggggctccgtggcagaggttggggcggcggggtgtggagttcgggacacccacacatgcctgattgccatgctctgcatgggatgttcccagtttatctctgggc

SEQ ID NO: 182278 - DNA, 601 bp, Human
ctggctttgccaaggcccccgctgggacagactgtttctttcactgcagtcctgggagccgagggcaaggggacaggaaagaggaagtgacctcagagcctggtggcaccagcatcatgtccaggctggggggtgagggtccctgaggccctggggcagggcagtgctgttccctgggtggctgaggccggaggggctctgttctcagtcccccatctcattgcggaggaaggagcccaagccccttccagcaggtgctttcctcagtgcccagaggtgctccccggcttctccatccccrcgccgcagcctgaatgtctggggtggggccggtgtgggaggtgccggcctcttttccacctgccccactttttatcctgctctgtggtcaaggcctggccccgtggcctgtgagtgtgggggctccgtggcagaggttggggcggcggggtgtggagttcgggacacccacacatgcctgattgccatgctctgcatgggatgttcccagtttatctctgggcaccatactccaggtgctcggaagctgaagcctagagcctgctgggttcacccgagcctccacccgggggcccagggc

SEQ ID NO: 182279 - DNA, 601 bp, Human
tgcatgggatgttcccagtttatctctgggcaccatactccaggtgctcggaagctgaagcctagagcctgctgggttcacccgagcctccacccgggggcccagggctggtcctcaagtttcctggcctggtgcctcctgagatggggagggtgaccaggccttccctaccccctgccctctgagatggggagggcgtccgggccttccctgacccttgccctcttgagatgaggagggtgaccagggccttcccccaccacccgccctctgagatggacagggtgtccaggcctcccckaccccctgtcctctgagatggggagggtgtccagggccttgcttctcagcgtgggactgacaggtttgccctgacctccacaggcatgaacgctgctgtccgggctgtgacgcgcatgggcatttatgtgggtgccaaagtcttcctcatctacgaggtaaggccaaggtgggctgtgtgtgtgcagggagtggggacctcctgaggcgcatgccgaggtgtgttctgtgtgggtcacactgggagacggggtggtcctggcctggaggagctgatgggtatgtggtcttggggagtgtg

SEQ ID NO: 182280 - DNA, 601 bp, Human
tatctctgggcaccatactccaggtgctcggaagctgaagcctagagcctgctgggttcacccgagcctccacccgggggcccagggctggtcctcaagtttcctggcctggtgcctcctgagatggggagggtgaccaggccttccctaccccctgccctctgagatggggagggcgtccgggccttccctgacccttgccctcttgagatgaggagggtgaccagggccttcccccaccacccgccctctgagatggacagggtgtccaggcctcccctaccccctgtcctctgagatggggagggtgtccagggccttgcttctcagcgtgggactgacaggtttgccctgacctccacaggcatgaacgctgctgtccgggctgtgacgcgcatgggcatttatgtgggtgccaaagtcttcctcatctacgaggtaaggccaaggtgggctgtgtgtgtgcagggagtggggacctcctgaggcgcatgccgaggtgtgttctgtgtgggtcacactgggagacggggtggtcctggcctggaggagctgatgggtatgtggtcttggggagtgtgagggggagcttggggccagg

SEQ ID NO: 182281 - DNA, 601 bp, Human
tctgggcaccatactccaggtgctcggaagctgaagcctagagcctgctgggttcacccgagcctccacccgggggcccagggctggtcctcaagtttcctggcctggtgcctcctgagatggggagggtgaccaggccttccctaccccctgccctctgagatggggagggcgtccgggccttccctgacccttgccctcttgagatgaggagggtgaccagggccttcccccaccacccgccctctgagatggacagggtgtccaggcctcccctaccccctgtcctctgagatggggrgggtgtccagggccttgcttctcagcgtgggactgacaggtttgccctgacctccacaggcatgaacgctgctgtccgggctgtgacgcgcatgggcatttatgtgggtgccaaagtcttcctcatctacgaggtaaggccaaggtgggctgtgtgtgtgcagggagtggggacctcctgaggcgcatgccgaggtgtgttctgtgtgggtcacactgggagacggggtggtcctggcctggaggagctgatgggtatgtggtcttggggagtgtgagggggagcttggggccaggccaa

SEQ ID NO: 182282 - DNA, 601 bp, Human
cctctgagatggggagggtgtccagggccttgcttctcagcgtgggactgacaggtttgccctgacctccacaggcatgaacgctgctgtccgggctgtgacgcgcatgggcatttatgtgggtgccaaagtcttcctcatctacgaggtaaggccaaggtgggctgtgtgtgtgcagggagtggggacctcctgaggcgcatgccgaggtgtgttctgtgtgggtcacactgggagacggggtggtcctggcctggaggagctgatgggtatgtggtcttggggagtgtgagggggagcytggggccaggccaaaggcatctgcagaaagaagacctactgccttgggactcagcccggctggaggctcagaggctgcagagcacgggcctgggggcagggaaggagctgggtggacaaggagtcgaggccctgcctacagtgatcgctgacgggccaggccccacccaccacacccctgcctggtgtcccccagcctggcccttgtcccgccccgaggcctctgtgagtgggggccagggacctcaccgcctctgcccttgtcctccccagcctcctgcctcaccacccagacccgggg

SEQ ID NO: 182283 - DNA, 601 bp, Human
cgggccaggccccacccaccacacccctgcctggtgtcccccagcctggcccttgtcccgccccgaggcctctgtgagtgggggccagggacctcaccgcctctgcccttgtcctccccagcctcctgcctcaccacccagacccggggggcagccgctggcagcagctctgctgtgtctatgttcattgtgtccccgcaggagcagcggatgccctactgcctcagccccagtccccgtgggagatttggggctcgccctccgtcctgggtatttacacacccacacttgcgctcacacrtgtgcacacacaggcgcattcacacacttgggccacaccacgcactcacaggctgcattcttgccttgtcaggtggttttccacattccacaagacaaggtcttttgttattttgttgccactttttatgtaatatgtagctgtttatataaaatgtagcaaccccagctctgcagccccaggcactcagccccacccccctcactgctcactgctcgctgctgaccactcaccgccctgggtctcagttcccccatcttggccccagggaacagcagcctgtccagccctccctctgca

SEQ ID NO: 182284 - DNA, 601 bp, Human
gctctgcagccccaggcactcagccccacccccctcactgctcactgctcgctgctgaccactcaccgccctgggtctcagttcccccatcttggccccagggaacagcagcctgtccagccctccctctgcaggactgtgtgaatgaatgagtgagtgggcagtctgtgctggcccgtcctctccctgtggccaggctggggtggggctggggccctgccagtattggattaggaagcaggtctcagagccctggggagctgggtgtgggggcctctctaggcaggctgggctgtgtccrtacaaacccctcctgccacctgctcgaccttcagtttcttcttctaagtggcaaaggggagaaattagggttttccggaacccccacacatttgtggttgggaaagactcctgtggcaaaagacagaaaacaggttcatcggtgcagggcgtgtcctggaaaaggggagaagaggcactttgccgtgcctagagtcctggcttctgcagagcccagcagagaccagtgcacatggagaagccgaggggtacagggacgcagcgtgaggccctcggaggtgggggaatgcaggagggtgag

SEQ ID NO: 182285 - DNA, 601 bp, Human
atagcggcccagggaagacttcccctccgtcccatgaaggttcttggaagaatccacttgcgaaaagcggattaatagggcagaggtgctggcattcattgtgaataggcatggagaggtagggcgaagatgctgacctgccctcctcccagggaaaggggcatgggcagcctggatgattctaggggggtaggaattttttttttttttttttttgagacagagtctcattctgttgcccaggctggagcgcagtggcacaatcttggctcgctgcaacctctgcctcccaggttcaagyaattttcctgcctcagcctcctgagtagctgggattacaggcacccaccaccacgcccagctgttttttgtatttttagtagagacggggtttcaccatgttggccagcctggtctcgaactcctggcctctggtgatccacccgcctctgcttcccaaagtgctgggattacaggcgcgagccactgtgcacggccatgaatggtttttaggggattcaatgggcttggacagcatctgttagccctggtgaccacctgcccaagtgtgttggcagacacaggtctttcttcctacgat

SEQ ID NO: 182286 - DNA, 601 bp, Human
ggtctctggggactgctgggctggccatacctgcctgcccctccgcccagtggggcaggggcctggctggcgcctgggctctgtattggatcctgagttttgcagacagacctgtgtttggtggcctcctgctcaggtggggctgtgggtttgggatcattttcctgttttccttgttcctagctcagggctggtacaaccagagggggccaggctggcctggcctgagccggaggaagtagctctgtggtccctcagatcagcccctgagatggggcaggggcacctgtcccccagcccmgctggtggggaagggaggctgtcaggctagaagcccgccatggccagagtggggatgttcatgcgccccgcagcgcgcactatcccttgaccccctgcctgcttgaggcacttgccctcctggcccccagggccctgacacctggttggggagaaggcggagggaggagcagaagcccacagctgagctggcatccgccctggccgaggaatggctgctccactgcctcacctcacggcctggagaaggctgctgatgccatggagggaccggggctgcacggaggaggccgcccttctc

SEQ ID NO: 182287 - DNA, 601 bp, Human
ctggctggcgcctgggctctgtattggatcctgagttttgcagacagacctgtgtttggtggcctcctgctcaggtggggctgtgggtttgggatcattttcctgttttccttgttcctagctcagggctggtacaaccagagggggccaggctggcctggcctgagccggaggaagtagctctgtggtccctcagatcagcccctgagatggggcaggggcacctgtcccccagcccagctggtggggaagggaggctgtcaggctagaagcccgccatggccagagtggggatgttcaygcgccccgcagcgcgcactatcccttgaccccctgcctgcttgaggcacttgccctcctggcccccagggccctgacacctggttggggagaaggcggagggaggagcagaagcccacagctgagctggcatccgccctggccgaggaatggctgctccactgcctcacctcacggcctggagaaggctgctgatgccatggagggaccggggctgcacggaggaggccgcccttctcctctccacacccttagtgaaatgcagtcatgagtgtccctcccctcaaacaacaagaaaggg

SEQ ID NO: 182288 - DNA, 601 bp, Human
ggctggcgcctgggctctgtattggatcctgagttttgcagacagacctgtgtttggtggcctcctgctcaggtggggctgtgggtttgggatcattttcctgttttccttgttcctagctcagggctggtacaaccagagggggccaggctggcctggcctgagccggaggaagtagctctgtggtccctcagatcagcccctgagatggggcaggggcacctgtcccccagcccagctggtggggaagggaggctgtcaggctagaagcccgccatggccagagtggggatgttcatgygccccgcagcgcgcactatcccttgaccccctgcctgcttgaggcacttgccctcctggcccccagggccctgacacctggttggggagaaggcggagggaggagcagaagcccacagctgagctggcatccgccctggccgaggaatggctgctccactgcctcacctcacggcctggagaaggctgctgatgccatggagggaccggggctgcacggaggaggccgcccttctcctctccacacccttagtgaaatgcagtcatgagtgtccctcccctcaaacaacaagaaagggct

SEQ ID NO: 182289 - DNA, 601 bp, Human
gtacacagatacagaaacatacagacatatgtactcagagtcacacacacacgtgccccatcgcacagggactcaggttcaggccgaccctgtcatctgctgccatggaattgttgggtcgcagggtcatggggttgccaggggccaggaggacctggagacgtggccgtgctgggtcctgggggagccctggctgaggctggctatgaggggccacgtgagcgcacctggagctgctgaggcttgagccctggaggccctggccggttccctgagttggtacagggcctgtgtgtgcacrtgtgcacgcacatgtgtgtggcaacctatgcgtgtgtgtactgtgctttccagtctccaaagccttccactctattaccttggggcttcccaagcccaggaccggacggacatcatcctcctctttgtctctccaaggagagaggcccagggaggtagggccacctcaggtttccagagaccccggggcttctgcctctcactctgcagggtctgccagccccttgctgcccagtcctggggtccctctggtgatccccaggggctgtctgccgcctgccatctctcctgaagtttctgg

SEQ ID NO: 182290 - DNA, 601 bp, Human
gcaaggagtggggggctacggggctgacctcagtgaggcacctgtggtcctgcccccagtgggcaggaggcggagagggtcactcaggctgccgccgccccaggctcagccccgtggtcagtgtggggagcttggtgaggctgcttactggggtgggactgctgagcctggggcggtgggaggtggttggttgtgagggagtggccccagcaaggtccagacggcagggctgtgggggtggcgaggccaggagctgggccagtggggagcagggccttcccctgagggcggtcggggcccrggggtgggttctaggctggaaagatgtgtcggaacgtggctgtagccacagggtggacaggaggtcccggaagcaggagagggtggggaggctgctgggaggccgagaccgcctctgggagggatgggggggtgcctggtggggaggggtgtgtctggagtgggggtgcctggaatgccgccctctggttcccttggggtggagttgggggctctggcctagaacaggctgacactgccctgtggaccctgagacccctcaactgggacaggtcggccccttggtggggtggggctcaat

SEQ ID NO: 182291 - DNA, 601 bp, Human
cctctggttcccttggggtggagttgggggctctggcctagaacaggctgacactgccctgtggaccctgagacccctcaactgggacaggtcggccccttggtggggtggggctcaatggtggaccagaggcacgggccattcaggctgtccttcgcccacacccgaccatgcagggcaaggccaggggcccccgtggctctagctctgtcctctgtgcgctgaggctgaggcaggaccactggaaccagccctgggggcagagggtgggtttgggactgacacggtatccctgtccccrtgtgaaggtggcagcgtcactcccatctgtgtggacactggttccacctccgcgtggctgtacagtgctgccgagggcagtgggagaggccgtgggtaatgacctggcttctagaaccttccccagtggagcctaggggccgggcggagatggagcccaacaggcgaggctggcccaaggtgcgggtcctatgaggggcttgctctcctagggcagggacttcccgggggttccggctccagtggtgaccttggccttagcttatgtctgtgactcacattgggccctcctggaagtggc

SEQ ID NO: 182292 - DNA, 601 bp, Human
tccggggagccctggctggtgccagcgatgcggggcccctggttataaggatgagcagatggaagctcacaggggccccaggtacctggcccaggctagcccgggcaggcccctctgccctgtgccccgtggagctgcagccctgtgcgtcttcccgcctggaaggcttcaccagacacaagggcccagccccagctgtgtgtgtgctgggcccagccccgagggcccccttcctcccctgctgcccttcccaggctttcgggcagagccctcttgttcaccgcctccaggagggcggggsgtcctagtgggcccagcctcatctctgccctcgcgctccaggcctgctttcctcctgccgggtggggattgtgccctggcccatgtgggttgggaatggtggccccagggagggctcctggcacccgggggctgtgtccggggcaggtttccctgcctggcagctgagccctgtcgtgtctttgacccagactcggagccgtgggtcccgactgaacatcatcatcatcgctgagggtgccattgaccgcaacgggaagcccatctcgtccagctacgtgaaggacgtgcgtgtgggcct

SEQ ID NO: 182293 - DNA, 601 bp, Human
tggaagctcacaggggccccaggtacctggcccaggctagcccgggcaggcccctctgccctgtgccccgtggagctgcagccctgtgcgtcttcccgcctggaaggcttcaccagacacaagggcccagccccagctgtgtgtgtgctgggcccagccccgagggcccccttcctcccctgctgcccttcccaggctttcgggcagagccctcttgttcaccgcctccaggagggcggggcgtcctagtgggcccagcctcatctctgccctcgcgctccaggcctgctttcctcctgcygggtggggattgtgccctggcccatgtgggttgggaatggtggccccagggagggctcctggcacccgggggctgtgtccggggcaggtttccctgcctggcagctgagccctgtcgtgtctttgacccagactcggagccgtgggtcccgactgaacatcatcatcatcgctgagggtgccattgaccgcaacgggaagcccatctcgtccagctacgtgaaggacgtgcgtgtgggcctgggggtggccactgggcacctgctcctctaggccgtgtgggctggggctcagggctggt

SEQ ID NO: 182294 - DNA, 601 bp, Human
cacagtctgggaggctggtgctgggagggagcattcggggtctggcctggcctcgccgtccttggtcctgatcaccgctgggtctcactttgtcctctgcaaaatgggaatgaagttggagccaaatggagtgggtctggggccaggaaggcaccatggtaggcaaaatgcctgtgtatgagggtggtcaccctctcaggcagggccagagactgtcagacaggtgggacttgtgctgagggagaccaggtgactgcgcccagccctgtgactgcacctggccctgtgactcgtgtgctgwgccgagcattcccagggaacccacacagctggacgagggccactctatagaggggaggcttcctcagagaggggccccgccgacctagccaggcagctgctgtcccctctgtgaggcctcaggctcactctgaagagcctcttgaggggccggggacatcagggcaagccagccgctgctgagcctggggtgatggaaatgccgctgctgtgaccgggccagccatgcactcccagcctgcaggctgctgggttttccagccagtgtcttggatgcctgatgccgggtgtgaaacaaagg

SEQ ID NO: 182295 - DNA, 601 bp, Human
tgctttgctgcacgggctggcgtggcctcgtgttgtgttgggggtctcgcaccttctgtggaaggtgccctgcctggcatgcgcggtgtctgctgcctcatggctgagcttccatcgggccgtgtgcctgtgaccagcctcctgggctctgtcacggctgcgctgtggctgtacgccgtggcgctgcagggctgtgcatggtgtgacccgaatcccttccaggagcttcgagaacaactggaacatttacaagctcctcgcccaccagaagccccccaaggagaaggtgaggcagggagcsgcgcccacagagggaggaacgggctcagttattctgcagcctcttcacgctggccccgtggctgggcctgcctgcccccaccttccctcctgctggggtccgagctgtgagctgggagggtgggcctgacctctgcctgggctcaggcaccactgtggctggcaggtcccgggtgctgggaccctggctgcagggctggctgttgcttctcagtggtggatggaaatgaagtcaggccacaggcttaactcaggagaggagaagccattgtgtagaaaatgtcccccggggccaggctca

SEQ ID NO: 182296 - DNA, 601 bp, Human
aatagcttgaacttgggaggtggagggtgcagtgagccgagatcgtgccattgcactccagcccgggcggcaagagtgaaactctgaaaataaaatgttcccaaacagctgaaaacctcaggaaatgggatctctccaaaataaggatgaaatggcttgtttctaaagtcctgggggacgagggtcctgtagagagagtcacggccagtgaggtcctggctcccaagccccttgagccacagccggagctgcaggccggggcagacagcgtggcccagcctgagtctggtcctcccttccrtggacatctttgggtgtccctgctgctccagcctcctgcttatccccagagctagtcagcgggctctaccctccgtggtggggcaacctggtctccacgaacccagaacctggcaggggcgtgactggctttgtgggcagcagggctggctcgtaccaggacccagtggggccatgtggctatggagcccttgggtgtggctgctgccaagtgggatgtgctgcacgtgacaggtgcacgccaggttcagagcctcagcacggtgggtggaggggaggtggtggcggccgtcactggatt

SEQ ID NO: 182297 - DNA, 601 bp, Human
gcacgccaggttcagagcctcagcacggtgggtggaggggaggtggtggcggccgtcactggattcacatggatgtggtggggttttgggtccatcaggttaaattaactgtagtcctgatgggactgtctccatgtcttttcccttcccttaacgtggctactagaaaacaggatagccagggccccttccttactcgtggctgtgcaccccccaccctcccgcccgctgccagccccttgtgtgggcactgacctgtgttcccgcccgcaagcctggcttcacaacagtgctcgccccytctgcctcctctgttgcctgcgtgccagggggccaggcttgcaccgtgtctcttttggtcttcaccagaatcttctggaattagaacagataccgtattcccagggcagttgggcggtgtgctgggcagcgtccaggctgctggcagggcctggcccctttttccagaacctgccggcctgctgacctcctgtgcaggttgggggtcccctccccggctgtgcctcacgctcatctccccttctctctgaagtctaacttctccctggccatcctgaatgtgggggccccggcggctggc

SEQ ID NO: 182298 - DNA, 601 bp, Human
caggttgggggtcccctccccggctgtgcctcacgctcatctccccttctctctgaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgggtccggccggggcaaacaagtgaggacttgggccttctgtgtgcacacttggggcatttcctgtggaaggccggctgctggaggtggaggcygagacctgggtccgcgtgtcggtgcccacccgggcctgggtactcagctctgcctgcagcgtgatgcccaacactggctggcccccgggcacaggcccacccctggggggaattggccagaggctcaggctggcccctgaagctgcatctcctcctggcaggtgcaagaagtaggctggcacgacgtggccggctggttggggcgtggtggctccatgctggggaccaagaggtgagctgcctgctgcgggtacctgggggcaggagggccagggcgcagtatccaggccctgcaggtgg

SEQ ID NO: 182299 - DNA, 601 bp, Human
ggcatttcctgtggaaggccggctgctggaggtggaggctgagacctgggtccgcgtgtcggtgcccacccgggcctgggtactcagctctgcctgcagcgtgatgcccaacactggctggcccccgggcacaggcccacccctggggggaattggccagaggctcaggctggcccctgaagctgcatctcctcctggcaggtgcaagaagtaggctggcacgacgtggccggctggttggggcgtggtggctccatgctggggaccaagaggtgagctgcctgctgcgggtacctggggrcaggagggccagggcgcagtatccaggccctgcaggtgggggcggcaaggggaacccagcccggggccctgggctcggcccctcttcctgctggtggtctgcccagagcaggcttcacgcctcctgcctggggcttcctggcctgagctccgctgtgtagggcaggctgctctggcggccccatgcccatggtgggctctccgtggcaaggaagctggcgagcgtctgtccctgcctggccaggccaggcagcctgcactgtcagcactctggctgaggctatgggcctgtctgatggct

SEQ ID NO: 182300 - DNA, 601 bp, Human
gctgctctggcggccccatgcccatggtgggctctccgtggcaaggaagctggcgagcgtctgtccctgcctggccaggccaggcagcctgcactgtcagcactctggctgaggctatgggcctgtctgatggcttttgtcccagggcctgagacccttctgtgggcatggggtgggcacagtccccctgtgtgactacaggggaagttgctgagtcctgagccactgagtggctgcaagggccagaggaagcatccgctcctgccgctgagtgttgggcgagaaagcctcgggcaggaasgggttcccacggggagcccagcggggtggggggttcactcggttgcctggccggtgcctggtgatgctgagtggtgcccaggcggctcacgctgggcctgtgtgtccctctccgtgtggagccacagcgccacatcccgggcattgcagcgactgctgactggctcggggaacggccaaggcaatgcctttctgtgatcagatgcaatctggacacgcgtccccgggtgctgcgtgttcatgcggatgtgtctttgactgcaggaccctgcccaagggccagctggagtccattgtggag

SEQ ID NO: 182301 - DNA, 601 bp, Human
gccagaggaagcatccgctcctgccgctgagtgttgggcgagaaagcctcgggcaggaaggggttcccacggggagcccagcggggtggggggttcactcggttgcctggccggtgcctggtgatgctgagtggtgcccaggcggctcacgctgggcctgtgtgtccctctccgtgtggagccacagcgccacatcccgggcattgcagcgactgctgactggctcggggaacggccaaggcaatgcctttctgtgatcagatgcaatctggacacgcgtccccgggtgctgcgtgttcaygcggatgtgtctttgactgcaggaccctgcccaagggccagctggagtccattgtggagaacatccgcatctatggtattcacgccctgctggtggtcggtgggtttgaggtgagagctgcccacggacgaaaaagccccagggcacaggagacccaaggtgtcctcccgccgagggggcccatcctgaaaacccgtgtgctggctgggccgatgcaggggccgagagggtcggggttttaagtgctgtgtgtgggctcgggagggcacccgtgtgccagctgggctgatgcaggggccg

SEQ ID NO: 182302 - DNA, 601 bp, Human
tgctggacggcatcgctgaacgtggtgtcctggcactgggcaagctgtcactaaataatgaataaatgacagcccttcccccttgccctccatggagtggatctggggtcagagtgggttggaggagactcctgaccctccttagagtccagtttccctggtaggcatcctgagatgacaccaggctgactgcctggcccagccccaggggattgagcaggtgggtcctggcgtccagcacggggcacatgacaggtcagcagggagcagggctgggcggccgccggcagagcctgtcccyggcccaccctggcctcggtgctgcccttgacctgccccgtccctactgctgcaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggaggtacggggctcctggacaccggcctgccatgcccaggcccttgtggggtggggctgagcctacggaggctgctggaggggatagtgtgtggtg

SEQ ID NO: 182303 - DNA, 601 bp, Human
agcctggaattccctccccacagtcctccggctcatccgtgtccgcccctcccgcaggtcaacgtggagcacatgacggagaagatgaagacagacattcagaggggcctggtgctgcggtgaggctgccgtgggtccctggccacagctgcgcgtccaactctcggggctggggtggggctgctgaggagcggctgggcaggagaaggcaggaggggtccttggagagggtgggccagggcggctttcctgggagctgccactccctctcccaggcctggcccagcggggactcaggatsggggggagacctgaactcgttcccgccgactcaggccctgctgcccctctcaggaacgagaagtgccatgactactacaccacggagttcctgtacaacctgtactcatcagagggcaagggcgtcttcgactgcaggaccaatgtcctgggccacctgcagcaggtgtggggcaggggtgaggctctgagaggcctgcccctctttcctgccaccatctgtccccggccccaggggtcccagccctcacgggcacccacgggcactcccggcaggccctcgggcacgtgtgcccttccc

SEQ ID NO: 182304 - DNA, 601 bp, Human
cggagaagctgcgcgaggtttaccgcaagggtaggtggtgggtgcgacccgaggcctcactttgccctcccctggctccctggggcagggcctcaccatggagggctgccacgtgcctctgtttgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcmggtgtgccaggcccagccccactggcaccctgaccccgcaaggcctcctgggcccccatgcccaggtccccgccaggccgtggagagcagggaccatgcccaagtcttctgagcacaacactgggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggg

SEQ ID NO: 182305 - DNA, 601 bp, Human
cgcgaggtttaccgcaagggtaggtggtgggtgcgacccgaggcctcactttgccctcccctggctccctggggcagggcctcaccatggagggctgccacgtgcctctgtttgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcaggtgtgccagrcccagccccactggcaccctgaccccgcaaggcctcctgggcccccatgcccaggtccccgccaggccgtggagagcagggaccatgcccaagtcttctgagcacaacactgggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggggggggtggggg

SEQ ID NO: 182306 - DNA, 601 bp, Human
ctggggcagggcctcaccatggagggctgccacgtgcctctgtttgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcaggtgtgccaggcccagccccactggcaccctgaccccgcaaggcctcctgggcccccatgcccaggtccccgccaggcygtggagagcagggaccatgcccaagtcttctgagcacaacactgggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggggggggtgggggggctggggacgtggctgaagagctgccctgacccctgactccccatcatcctcccatccccgtcctgc

SEQ ID NO: 182307 - DNA, 601 bp, Human
tgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcaggtgtgccaggcccagccccactggcaccctgaccccgcaaggcctcctgggcccccatgcccaggtccccgccaggccgtggagagcagggaccatgcccaagtcttctgagcacaacactrggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggggggggtgggggggctggggacgtggctgaagagctgccctgacccctgactccccatcatcctcccatccccgtcctgcacaggcaccgcatgccacgggagcagtggtggctgagcctgcgg

SEQ ID NO: 182308 - DNA, 601 bp, Human; identical to SEQ ID NO: 102819

SEQ ID NO: 182309 - DNA, 601 bp, Human; identical to SEQ ID NO: 102820

SEQ ID NO: 182310 - DNA, 601 bp, Human; identical to SEQ ID NO: 102821

SEQ ID NO: 182311 - DNA, 601 bp, Human; identical to SEQ ID NO: 102822

SEQ ID NO: 182312 - DNA, 601 bp, Human; identical to SEQ ID NO: 102823

SEQ ID NO: 182313 - DNA, 601 bp, Human; identical to SEQ ID NO: 102824

SEQ ID NO: 182314 - DNA, 601 bp, Human; identical to SEQ ID NO: 102825

SEQ ID NO: 182315 - DNA, 601 bp, Human; identical to SEQ ID NO: 102826

SEQ ID NO: 182316 - DNA, 601 bp, Human; identical to SEQ ID NO: 102827

SEQ ID NO: 182317 - DNA, 601 bp, Human; identical to SEQ ID NO: 102828

SEQ ID NO: 182318 - DNA, 601 bp, Human; identical to SEQ ID NO: 102829

SEQ ID NO: 182319 - DNA, 601 bp, Human; identical to SEQ ID NO: 102830

SEQ ID NO: 182320 - DNA, 601 bp, Human; identical to SEQ ID NO: 102831

SEQ ID NO: 182321 - DNA, 601 bp, Human; identical to SEQ ID NO: 102819

SEQ ID NO: 182322 - DNA, 601 bp, Human; identical to SEQ ID NO: 102820

SEQ ID NO: 182323 - DNA, 601 bp, Human; identical to SEQ ID NO: 102821

SEQ ID NO: 182324 - DNA, 601 bp, Human; identical to SEQ ID NO: 102822

SEQ ID NO: 182325 - DNA, 601 bp, Human; identical to SEQ ID NO: 102823

SEQ ID NO: 182326 - DNA, 601 bp, Human; identical to SEQ ID NO: 102824

SEQ ID NO: 182327 - DNA, 601 bp, Human; identical to SEQ ID NO: 102825

SEQ ID NO: 182328 - DNA, 601 bp, Human; identical to SEQ ID NO: 102826

SEQ ID NO: 182329 - DNA, 601 bp, Human; identical to SEQ ID NO: 102827

SEQ ID NO: 182330 - DNA, 601 bp, Human; identical to SEQ ID NO: 102828

SEQ ID NO: 182331 - DNA, 601 bp, Human; identical to SEQ ID NO: 102829

SEQ ID NO: 182332 - DNA, 601 bp, Human; identical to SEQ ID NO: 102830

SEQ ID NO: 182333 - DNA, 601 bp, Human; identical to SEQ ID NO: 102831

SEQ ID NO: 182334 - DNA, 601 bp, Human
gagggcgacgcaatagggaggggtgggcgcacaccagggacgcgatgatggggacgggtgggcgcacaccaggtggcatgatggggaggagtgggtacacaccatggggggcgtgatggggaggcgtgggcgtacaccggggggcgcgatggggaggggtgggcgcacaccgggggacgcgatggaggcggtgggtgcacacggggcgcgatgggtgggagtaggtgcacactgagggcacgattggggagacacgaaggagaggggtgggcgcacactgggggacgcgatggccgggacrcgatgcggagaagtgggtgaataccggggtcgcgatgggcgccctggaaggacggcagtgctgctcacaggggccaggcccctcagagcgcgccccttgggggtaaccccagacgcttgttcccgagccgactccgtgcactcgacacaggatcccgcacccagggcgatgccgggggagagggcgaccccaaccagcaatgactcaggagaggagcacgcaaagacgcttcggggacactgctggggcgggatccgagggcgccgcgctctgcaggagcagcagcgcggggcccgacac

SEQ ID NO: 182335 - DNA, 601 bp, Human
ggtaatggctgcagccccggggggaatggctgcagccccgggagaggctggggcagggcagggccggccacagtgcctctgctccaaacagatggacaccaggaatgacgatctgtcccagacccctggtgaattcctaataagcaagtgaactcgtgagttaaaaagtgaagccctaaaaacatgggcctcagtttgctacagtcaatcctccacctcagctatccagggaagtcagaaccattctcctgcctgacctaaaagctcttctttccagcaccaccgggccccagagtccacytcttccccttcgtcagagccccagagggcagagctgctcccacatgggctcagaggggacccaccagaagcggggcctgtgaggtggcagccactcagtcattctggaattaaacaagtgttttcaacggaactggagcctgagattgaccacatggcagagctaagtgtaaatactgctgagaaaattaatatcatatgtattttattacatttactcttcattaagaggaagccacctacaaaaacataaaggacatttatatttgacctagttttaacaagtatttaaatattcaaa

SEQ ID NO: 182336 - DNA, 601 bp, Human
catgctgagctgctgccctcaggaagcactgtacatcacacgcctgttctctccacttctcctttccttccctggctgggagagggacaactgtcccagcgatgcctaaatacagggagtgggatgtagaaggctcgcctgagggtgaacccagggactgcacccatgcttgcttccctggggtatgcaccctggggagaccctggggaggcatggtgctctgtcaagggagctagagtggcctgcaaggggccttggcagtgaggggctccagctgcgagcctgaaggtgcgtgtcctgrggcggcactcaccccccgactccagtcttgggccagacacccctgcccactcccgggatgccagtggcttggcggcagcctgagtggtgagctggcacacccccatctccccatcccgaatgtggcctccagcacagagacaactggcctaggaaggaagagcatgcaaacagctccaggcaggatggaagtggggacccctgcatgagcccccttcacttccccaagcatgaggatgcactggcttctttagggaaggaaggtatgagtgtgttcaaaggcacagatgcagggcccaga

SEQ ID NO: 182337 - DNA, 601 bp, Human
agtctgagccgaaaagtggggcacccctctgccggcctgcactgctgggataaagtcgtttgtgagtgaagcaatgaggcagggccctccggctcactctgaaagtcaagtctggggcgtcctggtaccctttcaccccatgctgagctgctgccctcaggaagcactgtacatcacacgcctgttctctccacttctcctttccttccctggctgggagagggacaactgtcccagcgatgcctaaatacagggagtgggatgtagaaggctcgcctgagggtgaacccagggactgcayccatgcttgcttccctggggtatgcaccctggggagaccctggggaggcatggtgctctgtcaagggagctagagtggcctgcaaggggccttggcagtgaggggctccagctgcgagcctgaaggtgcgtgtcctggggcggcactcaccccccgactccagtcttgggccagacacccctgcccactcccgggatgccagtggcttggcggcagcctgagtggtgagctggcacacccccatctccccatcccgaatgtggcctccagcacagagacaactggcctaggaaggaagag

SEQ ID NO: 182338 - DNA, 601 bp, Human
aaatgtgagggaagccacctccgagtactttctggtttcaaactgtcctatctgagcggcagtaggtggtactattttattttttaattcatgccatacttgaagctactcaacaatggcacaatcggggtgtcttgttgcctgaaaatgcattttgagttgaggcaaaaagctgatgtcaagagactgggagccaacttcggggcagctcagtctgagccgaaaagtggggcacccctctgccggcctgcactgctgggataaagtcgtttgtgagtgaagcaatgaggcagggccctcyggctcactctgaaagtcaagtctggggcgtcctggtaccctttcaccccatgctgagctgctgccctcaggaagcactgtacatcacacgcctgttctctccacttctcctttccttccctggctgggagagggacaactgtcccagcgatgcctaaatacagggagtgggatgtagaaggctcgcctgagggtgaacccagggactgcacccatgcttgcttccctggggtatgcaccctggggagaccctggggaggcatggtgctctgtcaagggagctagagtggcctgcaagggg

SEQ ID NO: 182339 - DNA, 601 bp, Human
ggtgatttcgggaatccaactgaggacggccactccccacagcaggcggccaggctccttctcgctgccctgacatcagcaaatgtgagggaagccacctccgagtactttctggtttcaaactgtcctatctgagcggcagtaggtggtactattttattttttaattcatgccatacttgaagctactcaacaatggcacaatcggggtgtcttgttgcctgaaaatgcattttgagttgaggcaaaaagctgatgtcaagagactgggagccaacttcggggcagctcagtctgagcygaaaagtggggcacccctctgccggcctgcactgctgggataaagtcgtttgtgagtgaagcaatgaggcagggccctccggctcactctgaaagtcaagtctggggcgtcctggtaccctttcaccccatgctgagctgctgccctcaggaagcactgtacatcacacgcctgttctctccacttctcctttccttccctggctgggagagggacaactgtcccagcgatgcctaaatacagggagtgggatgtagaaggctcgcctgagggtgaacccagggactgcacccatgcttg

SEQ ID NO: 182340 - DNA, 601 bp, Human
ttcaaagaaaaaaacaaagtctagggaaaaataagagaaaatccatctttattttaaagttattcttgtgggctgggcacagtggctcacacctgttatcccagtactttgggagttgacgtgggaggatggcgtaagcccaggagtttgagaccagtctgggcaacagagcaagaccccatctcttttttaaaaaattcttatgaaaccagtaaaaacacatatccaaaagtcatgcagctatacagcactagtaaaagaaaccaaaaacagaagaaaacatttgtgactcagaggaacyctatgggacattcaagtggtgatttcgggaatccaactgaggacggccactccccacagcaggcggccaggctccttctcgctgccctgacatcagcaaatgtgagggaagccacctccgagtactttctggtttcaaactgtcctatctgagcggcagtaggtggtactattttattttttaattcatgccatacttgaagctactcaacaatggcacaatcggggtgtcttgttgcctgaaaatgcattttgagttgaggcaaaaagctgatgtcaagagactgggagccaacttcgg

SEQ ID NO: 182341 - DNA, 601 bp, Human
gcccccaagagccttcagcatcacagacttcacagatgttagtaccccatggagaacacagcaccccgggcagccgccctgtcaggaagaaaaacccaccacacttctccgagcctctaggtccctccaccttataaaaggccatgggggacaagcccagcctggactaattttacagcacaagcccccgcctgcccatccacgaagagggcacctcgggcagctgcatctgggtccagccccgagacgctcgtgctctggggatgcctggaacgcacaggaccagtgcgcacacggggasgctctgcgggggagcaaggtgccgcacctgcctctcgcagtaggccttcatcagcttgctcagcggcgtgtgcctcttgatcttgaactgcaccacggagccgtcctgcccggccaccttcaggttgatgtggtcattctctgtcttcacaccctcctgcagaagacaccagagactggcctcaaaactgtgtctcaaaataaccgcgacttgaatgggcaagtctttaggtaattgttggctttttaaagtcatcaaaaccaacctaattcttaaaattctccagcaattcagagtcac

SEQ ID NO: 182342 - DNA, 601 bp, Human
gccccagaatggccagacctgagcagggcccccaagagccttcagcatcacagacttcacagatgttagtaccccatggagaacacagcaccccgggcagccgccctgtcaggaagaaaaacccaccacacttctccgagcctctaggtccctccaccttataaaaggccatgggggacaagcccagcctggactaattttacagcacaagcccccgcctgcccatccacgaagagggcacctcgggcagctgcatctgggtccagccccgagacgctcgtgctctggggatgcctggaamgcacaggaccagtgcgcacacggggaggctctgcgggggagcaaggtgccgcacctgcctctcgcagtaggccttcatcagcttgctcagcggcgtgtgcctcttgatcttgaactgcaccacggagccgtcctgcccggccaccttcaggttgatgtggtcattctctgtcttcacaccctcctgcagaagacaccagagactggcctcaaaactgtgtctcaaaataaccgcgacttgaatgggcaagtctttaggtaattgttggctttttaaagtcatcaaaaccaacctaattct

SEQ ID NO: 182343 - DNA, 601 bp, Human
ctgcccctatgagcagggtatccaaagtgggagggaaagaggaggaaatctaactgaaaatccacaggcaaaagagtaaaataaaagggcaacgagttgctgtattttcaaagcggctgaagaaaagcagcctctaggtcccactcaggcaagcagggctccctggggaagggcgcctggctgcagggccgggcccccaacacaccaggcagcagctggtgggcaaagcccataaaagtggcctagagagggaccccctggcccagggtgagtccgccacagcgttaccaagaacaacagccacacacacaccacgtcacaaacagcagccagaaggcatccacccagctgggcactgccagtggggcagctcattatcctgaaactggggaagaaggggaaagaatcacgcgctttcttgcctttcctaacaaaatggaaaaccacaccgcacatgagggcagtgtctctccagggtcaggccagctcatacgcgaggacagggtgacagcggcgtggggcacacgccacctgcagccccagaatggccagacctgagcagggcccccaagagccttcagcatcacagacttcacagatg

SEQ ID NO: 182344 - DNA, 601 bp, Human
tagcatctgggcgcctccagaacctgcaatccagacagatcaccccatgtggatgcacagccctggcagcacagccatccatgtacacagcttttcagcagcttctcggtgctccatgcttgcacagaagtcagcctgcgtgagagcagtcagggaaaggctcactgtgcagcagcccagagaggaggggaggagcgcagaggagaacggacaggaaggaggcaggagaacactcccaacacaggcacacacatgcccacacccacacatgcccacacccacacacatgcacacacccacacatgcacacccatgcacacacccatgcacacacccacacatgcacacacccacatacacacacatgcacacacccacatatacacacaggcacacacccacacatacacacacaggcacacacccacacatacacacacatgcacaaagacacggacatacacaccacacacacctacactcacgattcaaattctatgggaagtaaaaaatactactaccttcagaaaacaatcaattgctactgaggatgggtgcggtggctcacacctgtaatcccagcactttgggagaccgaggc

SEQ ID NO: 182345 - DNA, 601 bp, Human
atctgattagcagcactgagtcctaggacccacaggagccttgcgctttataccaagtgcgggggaccatgccatgaaagccaaagcccccagctcacagaagggcccgtcaagtgagggtccattgccagcttctccccgcccctccccatttaaagcccaggcaaggtagtgaaacacccccgctcacttctctcctcctgacacagtgggcgcaaaacacccaccctgatcttcttccatcctctaagcaagaggaagcttctgccagttcctacacagactcagcaaggctggaagyagtcatgctcccagatggaaaggagtcccatcagggctgtcggccaccctcaccctgccaccgacactatgggctggagggagagcccccaggcagggctccctctgcctctcggtccacctgtccacagccagccccctgacccccagtcaagccccagagactccacgaggccctccctgctcagctgctctcagcagcttctccctggtgaacactcccagagctgccactgcctcagcggtgtgtaggtttcctcaagtaggtacaaatggatacttgttgcaaagatgttttcaa

SEQ ID NO: 182346 - DNA, 601 bp, Human; identical to SEQ ID NO: 27148

SEQ ID NO: 182347 - DNA, 601 bp, Human; identical to SEQ ID NO: 27149

SEQ ID NO: 182348 - DNA, 601 bp, Human; identical to SEQ ID NO: 27150

SEQ ID NO: 182349 - DNA, 601 bp, Human; identical to SEQ ID NO: 27151

SEQ ID NO: 182350 - DNA, 601 bp, Human; identical to SEQ ID NO: 27152

SEQ ID NO: 182351 - DNA, 601 bp, Human; identical to SEQ ID NO: 27153

SEQ ID NO: 182352 - DNA, 601 bp, Human; identical to SEQ ID NO: 27154

SEQ ID NO: 182353 - DNA, 601 bp, Human; identical to SEQ ID NO: 27155

SEQ ID NO: 182354 - DNA, 601 bp, Human; identical to SEQ ID NO: 27156

SEQ ID NO: 182355 - DNA, 601 bp, Human; identical to SEQ ID NO: 27157

SEQ ID NO: 182356 - DNA, 601 bp, Human; identical to SEQ ID NO: 27158

SEQ ID NO: 182357 - DNA, 601 bp, Human; identical to SEQ ID NO: 27159

SEQ ID NO: 182358 - DNA, 601 bp, Human; identical to SEQ ID NO: 27160

SEQ ID NO: 182359 - DNA, 601 bp, Human; identical to SEQ ID NO: 27161

SEQ ID NO: 182360 - DNA, 601 bp, Human; identical to SEQ ID NO: 27162

SEQ ID NO: 182361 - DNA, 601 bp, Human; identical to SEQ ID NO: 27163

SEQ ID NO: 182362 - DNA, 601 bp, Human; identical to SEQ ID NO: 27164

SEQ ID NO: 182363 - DNA, 601 bp, Human; identical to SEQ ID NO: 27165

SEQ ID NO: 182364 - DNA, 601 bp, Human; identical to SEQ ID NO: 27166

SEQ ID NO: 182365 - DNA, 601 bp, Human; identical to SEQ ID NO: 27167

SEQ ID NO: 182366 - DNA, 601 bp, Human; identical to SEQ ID NO: 27168

SEQ ID NO: 182367 - DNA, 601 bp, Human; identical to SEQ ID NO: 27169

SEQ ID NO: 182368 - DNA, 601 bp, Human; identical to SEQ ID NO: 27170

SEQ ID NO: 182369 - DNA, 601 bp, Human; identical to SEQ ID NO: 27171

SEQ ID NO: 182370 - DNA, 601 bp, Human; identical to SEQ ID NO: 27172

SEQ ID NO: 182371 - DNA, 601 bp, Human; identical to SEQ ID NO: 27173

SEQ ID NO: 182372 - DNA, 601 bp, Human; identical to SEQ ID NO: 27174

SEQ ID NO: 182373 - DNA, 601 bp, Human; identical to SEQ ID NO: 27175

SEQ ID NO: 182374 - DNA, 601 bp, Human; identical to SEQ ID NO: 27176

SEQ ID NO: 182375 - DNA, 601 bp, Human
gagagtgtagcccacacaatctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccrtcagggggtcctgcggttcccacctggccggtgtcctccctgggggcattcattccccggctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccat

SEQ ID NO: 182376 - DNA, 601 bp, Human
tcatatagaaggttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaargtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgtgacctccacctcctggg

SEQ ID NO: 182377 - DNA, 601 bp, Human
ctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttcctttttttwaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgtgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcct

SEQ ID NO: 182378 - DNA, 601 bp, Human
tgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttwaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgtgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctg

SEQ ID NO: 182379 - DNA, 601 bp, Human
tgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgygacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttattt

SEQ ID NO: 182380 - DNA, 601 bp, Human
tcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagcc

SEQ ID NO: 182381 - DNA, 601 bp, Human
gatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatctttgcccatttttcaattgagttgtcttttatattattgagttgtcttttatattattgagtygtaagagttctttacgtaaggatgccagtctcttaccaaaggtatgatttgaattttttttgtcaatctgtgcactgacttgttattttctttatggtgtcatttgatgcacgaacttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagc

SEQ ID NO: 182382 - DNA, 601 bp, Human
ttagtagatacagagtttcaccatgttggccaggctggtctcgatctcctgacctcgtgatccacccgccttggcctcccaaagtgctggcattacaggcataagccactgcccccagccatctttgcccatttttcaattgagttgtcttttatattattgagttgtcttttatattattgagttgtaagagttctttacgtaaggatgccagtctcttaccaaaggtatgatttgaattttttttgtcaatctgtgcactgacttgttattttctttatggtgtcatttgatgcacgarcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactg

SEQ ID NO: 182383 - DNA, 601 bp, Human
agaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactktatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtgg

SEQ ID NO: 182384 - DNA, 601 bp, Human
gtgtttttattgtgaaggagtggtagactttgtcagctgcttctcctgcacttattcaaatgttcagatggtctttgatccttttactattaatatggtgcattccatcaattgaccttcgaatgttaaaccaactgtatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcamcaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttc

SEQ ID NO: 182385 - DNA, 601 bp, Human
ttttcaagaactgagtttggtttgttgacattcattgtttttgttttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttwttaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatttttccttagagatttgtttaaggtagaagctgtttccatattcaatagcccttactttctatgcacgcaggatgctatttttcttcacaatcacccgtttcacttgt

SEQ ID NO: 182386 - DNA, 601 bp, Human
tttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagyataaggaaagaatgttattcataatttcacctcccggagttaactactgttaacaacttactatttttccttagagatttgtttaaggtagaagctgtttccatattcaatagcccttactttctatgcacgcaggatgctatttttcttcacaatcacccgtttcacttgtcgatacgttgcctctgcaacatcttcccttttccacatctccacgtctcccttctctttgggatagttgttatttttttccttttcaattctttttttttttttttttttttaatttttgagacagac

SEQ ID NO: 182387 - DNA, 601 bp, Human
ctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatktttccttagagatttgtttaaggtagaagctgtttccatattcaatagcccttactttctatgcacgcaggatgctatttttcttcacaatcacccgtttcacttgtcgatacgttgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctc

SEQ ID NO: 182388 - DNA, 601 bp, Human
tgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatttttccttagagatttgtttaaggtagaagctgtttccatattcaatagcccttactttctatgcacgcaggaygctatttttcttcacaatcacccgtttcacttgtcgatacgttgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcc

SEQ ID NO: 182389 - DNA, 601 bp, Human
taggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatttttccttagagatttgtttaaggtagaagctgtttccatattcaatagcccttactttctatgcacgcaggatgctatttttcttcacaatcacccgtttcacttgtcgatacrttgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcacca

SEQ ID NO: 182390 - DNA, 601 bp, Human; identical to SEQ ID NO: 27177

SEQ ID NO: 182391 - DNA, 601 bp, Human; identical to SEQ ID NO: 27178

SEQ ID NO: 182392 - DNA, 601 bp, Human; identical to SEQ ID NO: 27179

SEQ ID NO: 182393 - DNA, 601 bp, Human; identical to SEQ ID NO: 27180

SEQ ID NO: 182394 - DNA, 601 bp, Human; identical to SEQ ID NO: 27181

SEQ ID NO: 182395 - DNA, 601 bp, Human
tagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagyccctcgctggcctgcagtggccggacttctgctcccagggagacccttcccccaccaggtgaccccaagttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcg

SEQ ID NO: 182396 - DNA, 601 bp, Human
ctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccragttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagtt

SEQ ID NO: 182397 - DNA, 601 bp, Human
ggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccaagttaacccagagccttggtctcactccttgggggtcccaaagggatcctactccctaggccagagcaggtctctaaagaagcctgcatgctgtcccgctgtgcgccggctcctgacrcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgc

SEQ ID NO: 182398 - DNA, 601 bp, Human
ggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccaagttaacccagagccttggtctcactccttgggggtcccaaagggatcctactccctaggccagagcaggtctctaaagaagcctgcatgctgtcccgctgtgcgccggctcctgacgcccrctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgcctac

SEQ ID NO: 182399 - DNA, 601 bp, Human; identical to SEQ ID NO: 27182

SEQ ID NO: 182400 - DNA, 601 bp, Human; identical to SEQ ID NO: 27183

SEQ ID NO: 182401 - DNA, 601 bp, Human; identical to SEQ ID NO: 27184

SEQ ID NO: 182402 - DNA, 601 bp, Human; identical to SEQ ID NO: 27185

SEQ ID NO: 182403 - DNA, 601 bp, Human; identical to SEQ ID NO: 27186

SEQ ID NO: 182404 - DNA, 601 bp, Human; identical to SEQ ID NO: 27187

SEQ ID NO: 182405 - DNA, 601 bp, Human; identical to SEQ ID NO: 27188

SEQ ID NO: 182406 - DNA, 601 bp, Human; identical to SEQ ID NO: 27189

SEQ ID NO: 182407 - DNA, 601 bp, Human
taaagagataaataattgcgctggacatggtggctcatacctgtaattccaatactttgcgaggctgaggcaggtggatcacctgaactcagggggtttgagaccagcctggccgacacagtgaaactccatctctactaaaaagtacaaaaattagccaggcatggtggtgggtgcctgtagtcccagctactcaaaggctgaggcaggaaaattgcttgaacccgggaggcagaggttgcagtgagccaagatcgtgccactgtactccagcctgggcaacagagagagactccgtgtaaaaaaaaaaaaaaaagaaagaaacaattggtatgcgatccctgtgtaagttggggacattttggactgagaaagacaatgagggagagaagaaaaaaatctttcacagacgcacacactcaagttctcccagcagggcttattctctgcctgcctttggggcagcggcaagggggtacaaggctagatgtgaccaagaagagggggtgtagaccttcaacttccccgtaacaaagtaaaacaagccctcctgggattcctttccaggtgagagcaagttccaaactattgctcccctcct

SEQ ID NO: 182408 - DNA, 601 bp, Human
ccacgtatccaggcttttttttgtctttaagaaaaggtacagttcaaattaaaaaaacaaaggaaaataaagagataaataattgcgctggacatggtggctcatacctgtaattccaatactttgcgaggctgaggcaggtggatcacctgaactcagggggtttgagaccagcctggccgacacagtgaaactccatctctactaaaaagtacaaaaattagccaggcatggtggtgggtgcctgtagtcccagctactcaaaggctgaggcaggaaaattgcttgaacccgggaggcrgaggttgcagtgagccaagatcgtgccactgtactccagcctgggcaacagagagagactccgtgtaaaaaaaaaaaaaaaagaaagaaacaattggtatgcgatccctgtgtaagttggggacattttggactgagaaagacaatgagggagagaagaaaaaaatctttcacagacgcacacactcaagttctcccagcagggcttattctctgcctgcctttggggcagcggcaagggggtacaaggctagatgtgaccaagaagagggggtgtagaccttcaacttccccgtaacaa

SEQ ID NO: 182409 - DNA, 601 bp, Human
gaatgcccacgagtatgccaggttctcctctgacaccaccttgcagcccagacgccccgcagactgaaggagaaatgtgaggctcctccttgcacgcactctgtctttattaaattttacgacagcatcgttgctgtcagatgctgccagcagtggagacagagcattcattactttagatgccctcaaaggacatcaggtaaggggaccccaatgtcccctacgcagggatagaaagcaaggaaaggatggaaatcccttcttgataacaggtctaggccaaaaggaagacaggcttgaractggatctcagatcacattggtactgtcaattcaggggtgaggtgcccggggtggtccacaaagcctcacaacctgcaaagctcccacatatgtgagagcccaccatacgccaggcatggcaccagcagctcacagcctggtcagatgcgtcccatgtataagtgactcgtgtctatggacatggtacgtttgtatattcactgctaaacatgcagtatttcagttacagcacaaaacagattacacccagatgccacgtatccaggcttttttttgtctttaagaaaaggtacagttc

SEQ ID NO: 182410 - DNA, 601 bp, Human
gcatggcacagcagggcatcgcggccgcactgccatcagccacagagaactgtcgaagccacggccaacccacttccggggcctgaggggcacggccttactcagccagtgtgcccagggtgaatgcccagggcctgaggggagcggccctgctcagccagtgtgcccagggtgaatgcccagggcctgaggggagcggccctgctcagccagtgtgcccagggtgaatgcccagggcctgaggggagcggccctgctcagccagtgtgcccagggtgaatgcccagggcctgaggggagyggccctgctcagccagtgtgcccaggatgaatgcccacgagtatgccaggttctcctctgacaccaccttgcagcccagacgccccgcagactgaaggagaaatgtgaggctcctccttgcacgcactctgtctttattaaattttacgacagcatcgttgctgtcagatgctgccagcagtggagacagagcattcattactttagatgccctcaaaggacatcaggtaaggggaccccaatgtcccctacgcagggatagaaagcaaggaaaggatggaaatcccttcttgataacag

SEQ ID NO: 182411 - DNA, 601 bp, Human
gctgctcaggaatctcaacaccagccttggccagaagcaaatactcctcaaaacctcaactacgacacaatagaaaaaggaacagaccatattgaatttattccatttctctcatatatcaatttccctgaagtttatattattaatatcaataaaattgtctgggagaaaatagtggtgtccgtatacctgacaaggatgagacactagtgtgctgagaatgccaaggatgaacaaacagcatgaaaccacagcctggaaaactgtgtcggtgctggcgctggctagaggaggcacgagygcctccaataggtggagcgcagcagcaggcactgcggtgctgggacggcccctccccacggcaggggcgcgatggcaccgccaccctaggttcacagtggcccgtggagcctgcccagtccctgtggaccagtgcgatgctgcttgccagatactgacgcccccgctcgccatggcgcatggcgatggtcagagcagggctgctactcacagaagcaaaagaaggaacccttttgctttgctaccaggtcctgcggtcgttgggggatacccaaactgtcagtcccaggagggaccctac

SEQ ID NO: 182412 - DNA, 601 bp, Human
tgcttgtgaaatgcatgcacgtgtatccacctccagggacaactcccagagtagcagccggttcctcactgtcccatccccagcctggcacaggctgacacacaacagatggtggagggctgctcaggaatctcaacaccagccttggccagaagcaaatactcctcaaaacctcaactacgacacaatagaaaaaggaacagaccatattgaatttattccatttctctcatatatcaatttccctgaagtttatattattaatatcaataaaattgtctgggagaaaatagtggtgtcygtatacctgacaaggatgagacactagtgtgctgagaatgccaaggatgaacaaacagcatgaaaccacagcctggaaaactgtgtcggtgctggcgctggctagaggaggcacgagcgcctccaataggtggagcgcagcagcaggcactgcggtgctgggacggcccctccccacggcaggggcgcgatggcaccgccaccctaggttcacagtggcccgtggagcctgcccagtccctgtggaccagtgcgatgctgcttgccagatactgacgcccccgctcgccatggcgcatgg

SEQ ID NO: 182413 - DNA, 601 bp, Human
gcagctccccctggggcacagctcttcaaggccctgtgaggctccatgctccctccccacggggccctgtgaggctccatgctccctccccacggtttctgtgcagtgggtgcagtgggcagaggcagccgcggcccctagcggcccgccactcaccctgcccctgtggctgctcgaggcatccctggctgagagggaaggaaactggccccgggaaggcggcttcaggccacgttcatcctgggcgccgctgctgagagggagacaaaggcgtgtgagggtcagggggctcgtggcaccgggggggcctctgcaaaccctgtctgcgggtcgcatccaagcaaaggaggggctcatacaaatcccacctggcacacgggggcaagagaagggaggcaactcctgggaggtcaggggctacagatggcagctcctggagagcccggcacttacttcacctgtggggcgccctcccggcaccctggggctccccagctgtaacaccttccacccagggcttcaggggcagggtggggggcacccgaacacacaaatgccgggggagagctcctgaccatggggtcaggccctgtgccggatg

SEQ ID NO: 182414 - DNA, 601 bp, Human
gccgatgtggcaaaccggggaggcttttgtgtggggccggggctgcggccatggcagccaccctccagctcccgggggctggggaagacgctggggtccccgtggaggctggagcggcgttcaggtcctgcggtcactcggcgtgctcctgcacctcttccccacgcagggcctgcagccggctgcccacagtctgctgcacggcctccagcccctctgcatccagctcccgcagcagcagcaggatggcagtcaggacgttctgagggcagaggggtgcggactaagcccacccggcacrgcgaggctgcttccctccacaagggctggggcctggccagcggtgccccaccacggagcgactggtcccgggggtgtgggccgtccaagtgactgaccggcacactcggagaatctgagcagaggagccccgcctgtggacgcgtgtgtggcacctcttccacgtgactcctgttgccctcagcccagcagggcccgggcccacattccacagaccaggacagcaggagaggctgaggggccaggacggctccgtgcggggcacgtgttacacgtgtgtgcgcattcacagacccgcaca

SEQ ID NO: 182415 - DNA, 601 bp, Human; identical to SEQ ID NO: 29761

SEQ ID NO: 182416 - DNA, 601 bp, Human; identical to SEQ ID NO: 29762

SEQ ID NO: 182417 - DNA, 601 bp, Human; identical to SEQ ID NO: 29763

SEQ ID NO: 182418 - DNA, 601 bp, Human; identical to SEQ ID NO: 29764

SEQ ID NO: 182419 - DNA, 601 bp, Human; identical to SEQ ID NO: 29765

SEQ ID NO: 182420 - DNA, 601 bp, Human; identical to SEQ ID NO: 29766

SEQ ID NO: 182421 - DNA, 601 bp, Human; identical to SEQ ID NO: 29767

SEQ ID NO: 182422 - DNA, 601 bp, Human; identical to SEQ ID NO: 29768

SEQ ID NO: 182423 - DNA, 601 bp, Human; identical to SEQ ID NO: 29769

SEQ ID NO: 182424 - DNA, 601 bp, Human; identical to SEQ ID NO: 29770

SEQ ID NO: 182425 - DNA, 601 bp, Human; identical to SEQ ID NO: 29771

SEQ ID NO: 182426 - DNA, 601 bp, Human; identical to SEQ ID NO: 29772

SEQ ID NO: 182427 - DNA, 601 bp, Human; identical to SEQ ID NO: 29773

SEQ ID NO: 182428 - DNA, 601 bp, Human; identical to SEQ ID NO: 29774

SEQ ID NO: 182429 - DNA, 601 bp, Human; identical to SEQ ID NO: 29775

SEQ ID NO: 182430 - DNA, 601 bp, Human; identical to SEQ ID NO: 29776

SEQ ID NO: 182431 - DNA, 601 bp, Human; identical to SEQ ID NO: 29777

SEQ ID NO: 182432 - DNA, 601 bp, Human; identical to SEQ ID NO: 29778

SEQ ID NO: 182433 - DNA, 601 bp, Human; identical to SEQ ID NO: 29779

SEQ ID NO: 182434 - DNA, 601 bp, Human; identical to SEQ ID NO: 29780

SEQ ID NO: 182435 - DNA, 601 bp, Human
gaaggggccctcttcccgggtccctgggcctgcaggggggctctgctgccctcctggcccgctccagagctgggggctgtgtcaccatcccgtaactcctgaaccccttgtggcctggtccacccccagcagacagctccgaggtgagaactcactgaggcccaggcagggtgacaagggccagctcaccctctcctagggcagggagttgctctgcacagggccctgaggatggtggatgcaggcggggcccccaacagccactgctgctccccctcccttgccctcccaggctcctgcmggtgactctccgccagcagcccccacagcgggttcctggtacatcctcccaaccccaagcctccccaagccctcggcctgctgcagggaccctgtgcagccccaggtccagccctcaacacctgctggcacctcaaacccaatgtgccaaaaagagcccgatcgatctgccctgtcctccctcccactcattgtggcctgactccggggacccctgcccctgtaccccctgggtttgaggctgtccctccagcctgcacacaaccaggcccattcccagacccctcctcaccctgctgac

SEQ ID NO: 182436 - DNA, 601 bp, Human
ctgttaggagcagcttcagctggaggaaggggccctcttcccgggtccctgggcctgcaggggggctctgctgccctcctggcccgctccagagctgggggctgtgtcaccatcccgtaactcctgaaccccttgtggcctggtccacccccagcagacagctccgaggtgagaactcactgaggcccaggcagggtgacaagggccagctcaccctctcctagggcagggagttgctctgcacagggccctgaggatggtggatgcaggcggggcccccaacagccactgctgctccccytcccttgccctcccaggctcctgccggtgactctccgccagcagcccccacagcgggttcctggtacatcctcccaaccccaagcctccccaagccctcggcctgctgcagggaccctgtgcagccccaggtccagccctcaacacctgctggcacctcaaacccaatgtgccaaaaagagcccgatcgatctgccctgtcctccctcccactcattgtggcctgactccggggacccctgcccctgtaccccctgggtttgaggctgtccctccagcctgcacacaaccaggcccattc

SEQ ID NO: 182437 - DNA, 601 bp, Human
actccctgagcatgaggctacaaaacccagttcaatggatgcccatcccacacacgatggggcccagagggcccagaagaaagggctggaaaccctgagctgaacaccgctggggatggggacacggggtatggcggggccctcttcgtggaagtcatcagggctcggtttacacgagatgggaaccaggcaggagcacagacgggcaggccccttgctccgctccctgctccgacctcttactcccaccaccaatgacaggcaggtcctgctcctgccctcagcgctgggaacaagacayagcctgggccaggagcccgagagatggggaacctgccgaccccatcccaagctcacagccatactgcccccttccccttctctgcctgtcccctcccccagccctggatgaggctgcagagagagaacacggccagagcaggatgtgggaagggaacgacagcttgaggctgacacggggcggagggggcagaagagggcggaagagggcagacggggcaatttcctgttcaggctgagcagggtccagacaggagggctctgaggagcccccagtacagactggactccagcccagcag

SEQ ID NO: 182438 - DNA, 601 bp, Human
cagggcaggaggccgccggctgacacgctgcccacccccaaaacaaaagcccccaacccccagtcacccctcttatgtggaaccctccactcaggtctgccccgagaagaggaaactaactgagtccgacgtccccttcccaaggtcacctgaccatgggtcacccaagctggagcagcggctgcaggtgggggccctgggggagaacccttttcccagaaggaagggccccctatgttcctcctcgagggcagccggcacctgctggggacgcccacagagctgctcgcagcgtggtgcyggggacccatacgcacccaaggtcacctccccggggatccccggtcccctgggcaccatgaccctctccaccatcagcaaccccgggaccaggaccacatgtgcccatcaccaggtctggggaccgacgggccgactgaaccaagaggaactgccacgacccctgacctgggtccattctcataggagggaggcccagctgccaaggtcccaggacccacagcctggcccgagcccctcccactgggagaccccggccaaacagctttctctgtgctgccgcttactcctctgcagaagg

SEQ ID NO: 182439 - DNA, 601 bp, Human
ctccccacatgcaacccccacctgcagaaccggggtcctccagggtctccgcacaccgcccccgcccacagaacccaggggagccgactgcagccactactcactggtccaggtggacctgccagtaggccttgcgggtgacattcaggtaggacagagaacccttgtaatacttggagtctgtgccacccagcatcagctcacccccaggctgcgcatctgggtccctaggaggaaaagggaggagtcagctgccacgccaccccccaagcacaagagtgccaggtcaggagtaagaggrtgaatgtggcaatcagggagagcttcctgaaggaggggcctttctgaaactgcagggatggaaaggcccagaaggcaggaggagggacagactcccttcttcccggggtagggctgctctgcgtgggcccagcctggcccagaagaggttttcctcaaccctcaggttctcctggtctgctcaggagccaaggttcagccagacatcagggtcaaggctagcggcagacaaggaagtgagtgccaggagctccactggggaggaccctgtctgtctgtctggaagaaaaaaccaaagaag

SEQ ID NO: 182440 - DNA, 601 bp, Human
ttgacagtgacacagaacaagcctgagtaggtctgcacccaaaacaaaagggaggaacagaattatttgatggggaccttaatcatctactacttttcaaaaactattaactactctcatgagtagaagaccgtgagaaagaactcacgtagatcatccaggctgcgtagcgctctttgaggttgtacagcacagcaggctcgtgtagatgagtcatcatggccatgtcctcgatcttgtcatatttgggagggttcatggggaagacttggtcatctttcactgttacagtctgtccagkcaaacaagagaggccagatcaaaaagtaagtgctaacttaacccaaaatgaggcagagtctaatcagctccaggtgtttttactcacagctccagcttcggtcttagctgtcaccttccccccttccctgctctgcactgttgctttcacaaaggactccttagggtccaccacaaagactgatgtcttggcatcaaaaggcttgttctgggcttcaattcgctccctttcagactttcggaggaaaggagcagcctccccaaaaatggccatctcagagtcggaactcatggctgcagg

SEQ ID NO: 182441 - DNA, 601 bp, Human
cagagatggagaagatgtggggtggggcctcctggcgctttttgcctcggtaggctgtcaccacctctgcattatacactggcaaccacttgtaggggttgacagtgacacagaacaagcctgagtaggtctgcacccaaaacaaaagggaggaacagaattatttgatggggaccttaatcatctactacttttcaaaaactattaactactctcatgagtagaagaccgtgagaaagaactcacgtagatcatccaggctgcgtagcgctctttgaggttgtacagcacagcaggctcrtgtagatgagtcatcatggccatgtcctcgatcttgtcatatttgggagggttcatggggaagacttggtcatctttcactgttacagtctgtccagtcaaacaagagaggccagatcaaaaagtaagtgctaacttaacccaaaatgaggcagagtctaatcagctccaggtgtttttactcacagctccagcttcggtcttagctgtcaccttccccccttccctgctctgcactgttgctttcacaaaggactccttagggtccaccacaaagactgatgtcttggcatcaaaaggc

SEQ ID NO: 182442 - DNA, 601 bp, Human
ctcgtattatttcttttgctttgcactggcaagaagtagaaaaaatcagtcattgttcatttaacacgtatttcttgagtgtttataatgtgtcagctttttttctgggtgctgaggcctgggcttgaggggtctgaaaagcagctactcagcacctctgtagtgaatggaacaattagtaggaaactctatgaaacgtgcatgtgtttttccatttcctcggactagagacatggctcaagtttggtctttgaaggaacagacattctctaagtgggccttaaaaatgaaccactagtartatttccaaactgttgtaccttttgaaggctgtatgctgctcattgcactatactgggttccagcccagctcattttacactttctacacaccaaaaagttctgtggaactttcaagaccagcaaatgaggtgatttagaacattattattttacattctaatgcaatgtaaaccttataataaagctaaaccaatatctagttccaggttgatcattcagtgctttagtagagaacattaactaatttctttttttggtttgtcatttttccagtaagaacaaactgccaataaatctc

SEQ ID NO: 182443 - DNA, 601 bp, Human
gcatatgcgaagtgccagaagccagtcacaaagaccacatattatccgattccattataagacatgtccagaacagccaaaaccagagacagaaagtagattaggggtttctgtggcctagggggaggacaaaatagaatttcctgttgggatgatgaaaatgttctgaaattgttatgatgatagcatgtacctgtgaatatactaaaaaccattgaattttatactttaaataggtgaattgtatgatatgttaattatatctcgataaagctgttacttcaaaaaaaaaaaaagaagmagctcaaaatgattgcaagtaccctgtcattagttctcttattttaaaaagtgtggattgctttttctgttcctgcttgatgacagattattcctttctttccacgttggcttggaaatgtctggaagtgcttccgtttctaaaatttcatccagtttcaatcagtccgtacacagataaaagtttagaattgggacctctaaatgagacacatccgagatactgctgtcaagtggaggactgcagtagccctatttcctaagctgtgtagcaggtattcttccttaggcagacaaattt

SEQ ID NO: 182444 - DNA, 601 bp, Human
caacattttgatgccagagccagtgtttgtaactactcctagaacttgagtagacctgccctgctttattattcgggacacctacatagaaacacaattgaggatgcccttgtttaagggcattatcaccatacacaaaagtcaaaggaattctatgagggggatgaatctggcaagcatatgcgaagtgccagaagccagtcacaaagaccacatattatccgattccattataagacatgtccagaacagccaaaaccagagacagaaagtagattaggggtttctgtggcctagggggaggacaaaatagaatttcctgttgggatgatgaaaatgttctgaaattgttatgatgatagcatgtacctgtgaatatactaaaaaccattgaattttatactttaaataggtgaattgtatgatatgttaattatatctcgataaagctgttacttcaaaaaaaaaaaaagaagcagctcaaaatgattgcaagtaccctgtcattagttctcttattttaaaaagtgtggattgctttttctgttcctgcttgatgacagattattcctttctttccacgttggcttggaaatgtctg

SEQ ID NO: 182445 - DNA, 601 bp, Human
ttgttttttttttgttttttttgacgaagtttcactcttggttgcccaggctggagtgcagtggcatgatctcggctcactgcaacctccacctcctgggttcaagcgattctcctgcctcagcctcccgagtagctgggattataggcacctgccaccatgcccggctaatttttgcatttttagtagagacggggttttgctatgttgaccgggctggtcttgaactcctgacctcaggcaatctacccaccttggcctcccaaaatgctgggattacaggcaccgtgtctggcctctrgttatgttttatacattaggtaaaagattaattatattgataattacctgcttccgctcccgttgccccaacaaagaggagagccagagtcttcattgcagacttctggtacagccccaccacagtctcattcagggggtccttgttcttgtcaagccagccggcaatgttgtagtccacggtgccagcatagtgaatcaaagagaagtgggcctcaggcttgcctttggcaggcttgggcttctggaagttattggattttccaagatgttgttcatacagcttgttcttgaaggaggt

SEQ ID NO: 182446 - DNA, 601 bp, Human
agtcacatcagttctagaatccttgcaaggttagttttttcccccacaccatagagtacatttaatatcctaaatctaattagacagagaaaatgaagtttgtaccctgaagagagcagacacagtctggaaagaagaacccttcttcttaccacctttctttccaccgccagcctctgaggggaaaaagaaagcaatcataggacagcctttctctggttatggttttttttttttgttttttttttgttttttttgacgaagtttcactcttggttgcccaggctggagtgcagtggcrtgatctcggctcactgcaacctccacctcctgggttcaagcgattctcctgcctcagcctcccgagtagctgggattataggcacctgccaccatgcccggctaatttttgcatttttagtagagacggggttttgctatgttgaccgggctggtcttgaactcctgacctcaggcaatctacccaccttggcctcccaaaatgctgggattacaggcaccgtgtctggcctctagttatgttttatacattaggtaaaagattaattatattgataattacctgcttccgctcccgttg

SEQ ID NO: 182447 - DNA, 601 bp, Human
accactaccagctgaactatctcgttgagtcacatcagttctagaatccttgcaaggttagttttttcccccacaccatagagtacatttaatatcctaaatctaattagacagagaaaatgaagtttgtaccctgaagagagcagacacagtctggaaagaagaacccttcttcttaccacctttctttccaccgccagcctctgaggggaaaaagaaagcaatcataggacagcctttctctggttatggttttttttttttgttttttttttgttttttttgacgaagtttcactctyggttgcccaggctggagtgcagtggcatgatctcggctcactgcaacctccacctcctgggttcaagcgattctcctgcctcagcctcccgagtagctgggattataggcacctgccaccatgcccggctaatttttgcatttttagtagagacggggttttgctatgttgaccgggctggtcttgaactcctgacctcaggcaatctacccaccttggcctcccaaaatgctgggattacaggcaccgtgtctggcctctagttatgttttatacattaggtaaaagattaattatatt

SEQ ID NO: 182448 - DNA, 601 bp, Human
cctcaagctccctaaaactcagtcttaccactaccagctgaactatctcgttgagtcacatcagttctagaatccttgcaaggttagttttttcccccacaccatagagtacatttaatatcctaaatctaattagacagagaaaatgaagtttgtaccctgaagagagcagacacagtctggaaagaagaacccttcttcttaccacctttctttccaccgccagcctctgaggggaaaaagaaagcaatcataggacagcctttctctggttatggttttttttttttgttttttttttgttttttttgacgaagtttcactcttggttgcccaggctggagtgcagtggcatgatctcggctcactgcaacctccacctcctgggttcaagcgattctcctgcctcagcctcccgagtagctgggattataggcacctgccaccatgcccggctaatttttgcatttttagtagagacggggttttgctatgttgaccgggctggtcttgaactcctgacctcaggcaatctacccaccttggcctcccaaaatgctgggattacaggcaccgtgtctggcctctagttatgttttat

SEQ ID NO: 182449 - DNA, 601 bp, Human
ttttccttgagatggagtcttgctctgtcacccaggctggagtacagtgacatgatctcagctcatggcaacctccgcctcctgggttcaagcgattctcatgcccagcctcctgagtagctgggattacaggtgtgcaccaccatgcctggctaatttttatatttttggtagagatggggtttcatcatgttggccaggctagtctcgaactcctggcctcaagtgatctgcctgccttggcttctcaaattgctgggattacaggcgtgagcaactgtgcttggccgtaatttttttwaaagtgctatttattatcacatctggtttcttatttccttcttttgactcaggctccaattcccaccactgttctatcttatagctttcaaaatctactcatttcggttctataccaatgtatctttaagcacctaaatcacttggaggctcccaaagcctcaagcaagtctcagctttacttaatcctatcccactggagtcttttaagggttaaatgacctcattctcaggccccagaatcgaattttgccgtctaatactgacttctgcaattcgctttcatctctcctgactcctg

SEQ ID NO: 182450 - DNA, 601 bp, Human
tatcaaatgtgtattccttgccatagatatagagctgtgtcctcctacttattccacagaaagtggcctttattaatgcctattctgggaattggtagaaaactgacagccatgttaccaagcgtgtaaagttttccatcttttgaaaatcctggtttttccgaatatctacagcatcagttattagagatggaatcagaaatgggattgccaaaagaaaaatagacttttctttttttccttgagatggagtcttgctctgtcacccaggctggagtacagtgacatgatctcagctcayggcaacctccgcctcctgggttcaagcgattctcatgcccagcctcctgagtagctgggattacaggtgtgcaccaccatgcctggctaatttttatatttttggtagagatggggtttcatcatgttggccaggctagtctcgaactcctggcctcaagtgatctgcctgccttggcttctcaaattgctgggattacaggcgtgagcaactgtgcttggccgtaatttttttaaaagtgctatttattatcacatctggtttcttatttccttcttttgactcaggctccaattccca

SEQ ID NO: 182451 - DNA, 601 bp, Human
tctttgctgctgctatgctgccttcttagaacaccctccctcttctttctttttgcacatagccccttgtctttcaagcccagcgaaagacctgttttgcttgtatagcttttctttgtgaacacattaaccttcctttccatcaattctttttacccgtattgtctattattcacagttaactttctttattgattttaaaaactttattgtgtgtacatcttagaccttgtaatagggatgatgttccatattcctcattcataggaggcacttgataagtactcactatatcataacracacaaacttatgcttacttagtttgttacaaaatttaaaaaatcatttttatataatgttaggcttacatcatccacttgttgttcaagtttgattttagctttggtcagggtgttgactttgtcctcctctgcctgcaggtcatccagggtctgctggtgggcctcctggagagccttcttctccttggtcagcttagcaatggtttcatccagacccgccatctcttctgtgaggtttttcacctacaaaggtgaagaaagcagcttagttgctctaaagcacctttgttgggtggc

SEQ ID NO: 182452 - DNA, 601 bp, Human
gagggggaataaatgcagagactttccaatttctctaatcaaaaatctacaaatcttacttgaatgcttctcagctgggttgtggtcttgaatatttccctacttaaccgtgttagttaccagtaattggcaagacttcaggaaaaagactggagtaaacattcttggacaagttgcttcatcactaccataatccactgtctttaaaatggggatagtattacacagactaatgaggaaaataaagtaacacatagcttgcgaaagcattttgaaaagtgaaaagaggtactgtaaggaygcactttgtttttgataactttttgattaaagccaagtctcccttaaagtcttcaaaaatagaagggcctgattctatttatctctctctctctctttatatatatatatatatgtatgtatggatatatatacaaatatatatatggatatatatgtttcatatatatacacatatatttctctcgtatatatatgaaagaaagcaacctcatgccagtggtcaataatgtgttcatattagtggggatctcccagggaggtagtatatgacctcaagtaaataaatgcagagtttttc

SEQ ID NO: 182453 - DNA, 601 bp, Human
atgaggtcctcaacttcattctggagcctctgcttcgtcttctcaagggaagcacatttggcattcacagcttctacatgttcctcagcatcctgcagacgctgagccagcttcttcctatgaaatatgggcaataaaagtgaatggctgtcaactgaattgggtgtttcaaagtgggtacaagagagtgaattccacaatcagacttctttaatactttgcttctcaagcttgttttgtaggtccagttctatattaactcattcccattatcctaccaccaaataccaaaaacaaccccagttttggtattgccatacttcatagagtggctttaaggccatccatgacaagcatgagctaacactttacccttccaggtagctggtttattcctcttctgtagaatattaatatctaccttgaattactggtttgtttttctgtgtctccacataattttaatccccagagggagagtctgtactgtactaatctttgtattcttgtaggctgtccaacatattaagggctcaaatgttggataaattgaattcaaatgaaatatacttgattttgtctgtctaattgtatcccttat

SEQ ID NO: 182454 - DNA, 601 bp, Human
ctcagcagccatgcggttggcatggttcagctggatttccatttcattgaggtctccctccatcttcttcttgagcctaatggcatcattcctgctcctgatctcagcatccagtgtgctctgcatggactccacgattctaatgtggtttctcttcatctggtcaatttcctcatctttttcagcaattttcctatcaacctcagacttgacttggttcaactcaagctggatgcgcaggatctttccctcttcatgttcaagagatgccttaatgacagcaagaggtgacattagtagrgtaatggaagtgtgtagtattctagagataagaatgatttatcattcatgaaaccttatttataaatagatttctaagtagtagtaagatttaaacaagagtgtcattttcatgcctttgcattttcttgctattctctaacacacacactgtctgcctttgtgctgccatcatacatttttattttgttgttttagacatttctacaaattattgaatgttattgttgattttatatgcttttatctccctaggtagattgtgcccttgaaagcagggcctttaactgattcatctttg

SEQ ID NO: 182455 - DNA, 601 bp, Human
taccttagatgtcaggggtaaaataaaaaccatcaatgaacagaggaactcatttgtgatatgtaactatgaatatttatatgtaggaagttgaaactatttgattattaatccagatgaatcatgggatacggaaatgagataaagtggagtgttaagaatctactgatttgaacataaccaagaccttctgagtttcagaatcttatatttaactatttacttgacatgttcacttgtgtatatatggtattatgtatctaaaacagaattcctgtttctttcttgccctgcaattctkttcttccctttgttccccacttaagtgttacatcatccacttggttactcaaaccataaacttgataaattactcttaattgcctttctttcatctcccaagtgcaacctattagcaatcttgtagtttctacctccaaaatatgtcctgaatttctccacttctctctgctccactctcttatccaagccacagaaccgacctgaaaagcttcctaacatgtctctctgcacccacttgtgttacccagtaaccgattctttacatagtatcccaaatgctctttttaaaaaatataga

SEQ ID NO: 182456 - DNA, 601 bp, Human
ttggattgttcctcctgtgaatggaaatccatttatgagggaagaaagttcagaatttttccattcttaggtcagtggatcttgaatttcctttttacttaaaaatgattcactctagcagatattttaagaaacctagagaaatgctcttgaatttttatttttttttatttttgcattagcttcttgaactcatagataacaaggaaggacaggtgacctttgtatctgaacttttagaacagcagaacatcctagagctactactaaatatgccaggtgtccagctttgttttttttktttgtttgtttgtttgtttttttcagaatcctgagaatggaaccaaaccttttaagagtgcaagtatgcaatctataccaaaccaaaccattaagcttgaatataagttattgccatgtgagtataaattattgccacttaagtttagaaattaagcaagaagtttgtttcctaaaatagtctgagctgtctctgattatacttaaatatatagcagagaatttgagcaggtcagttctagtttagtctctggtaatcattcttatttaaaagtctcagtaagaacctccaaaatgtggc

SEQ ID NO: 182457 - DNA, 601 bp, Human
tcacttatgatttttgtgtgaacctccctgctcttcaccctcagcttgttgacctgggactcagcaatgtcagcccgttcctcggcctcctccagctcgtgctggatcctgcggaatttggagaggttgacgttggattgttcctcctgtgaatggaaatccatttatgagggaagaaagttcagaatttttccattcttaggtcagtggatcttgaatttcctttttacttaaaaatgattcactctagcagatattttaagaaacctagagaaatgctcttgaatttttatttttttttatttttgcattagcttcttgaactcatagataacaaggaaggacaggtgacctttgtatctgaacttttagaacagcagaacatcctagagctactactaaatatgccaggtgtccagctttgttttttttttttgtttgtttgtttgtttttttcagaatcctgagaatggaaccaaaccttttaagagtgcaagtatgcaatctataccaaaccaaaccattaagcttgaatataagttattgccatgtgagtataaattattgccacttaagtttagaaattaagcaagaagtttgt

SEQ ID NO: 182458 - DNA, 601 bp, Human
aacttctggggatcctggggtcatttgaaggcctgggaggtccctaattattggggtcattgaggtgtggtcctattcaactcagatgcacatggaacctgtactatttgatgggataaataacccataagcacccccggcatttcccaaaaaacatctggagaaatgccagccagtgagatacttaaggaaaaagatgacgttgtagtgaaattagggaaacctcgcatttgcaacccctgtattgaagcttcaagatcattaaaaccttcaaaattccaagacatcatgcagtgacttygcctcgttcattttattcaagccagctgttgaccatagaaccttttgagacacccttcagaaaacccagccccagacgaacaggttgggtttaacacagatacccagggtggacgtcagggtccaaggaagactcaaaccataaagggcagccttccttccaagatactcccagaactacagacccagacttgcacccctaccacccagcacagtgggaggagtaagactttactgtagcccctgagcatagacttaagaagaaaaaacccccaaacagagaggcgaagaagggagaaaa

SEQ ID NO: 182459 - DNA, 601 bp, Human
gggacagaacacctattatccccaggcaccctctggaaaagaagagattagggattaagggagaaagactagaagcgtctggaagaaaggtagacagacaaagaggaagagaagaatggcctgcttagaaccgggactgcactttctgggcactgggctagcatgtggatgaaatgccacctggagagcgacagagcaaagatgcttaagcaaggggccaggcagaaaggcagatagatgcagctggcccagcagtgaggaggcacaagctcaggtgcctccaggagtcaggaggtaagawaaacatgagtggctattctcatagatgccttcctgcagaaaggcaggcagattaaaatatatttaaaacatccctacagccaaacaaaacaagtctaagaaacgattccagaggagaatcagaaagatagctgctttccttctcccttagactgccgagcaaaattattaatatgatgttcatgggctgcatgatccctacaaacacagctgactctttgccatcagtaagacactccccatcccctagcccttccttacccttcccatcctgcagcttccttctccaggaagcctcccc

SEQ ID NO: 182460 - DNA, 601 bp, Human
cacggtggctcatgcctgtattcccagcactttgagagggtgaggctggtggatcacctgaggtcaggagtttgagaccagtctggccaacatggtgaaatcccatctctactaaaaatacaaaattagccaggcgtggtggtgggcacctgtaatcccagctactcgggaggctgaggcaggagaaatcccttagaacccgggaggcagaggttgcagtgagctgagatcgcaccactgcactccagcctgggagacacagcaagattctgtctcaaaaaaaaaaaaaaaaaaaaaaaargaacagtttctaaaggatgccaagaaagtcataaacgcccaccatgcccacacaagcctgtttttaatgacacttttattgcaatataattcacatatcattatattctccctctaaaagcatataatataatggtttttggtgtagttgcagagttgtataacctgcaccactacctaattttaaaacatttttattgtctcaaaaagaaaccctgtacccatcagcagtcactcgccattaattccagctcccccccgcaaccaccagggtggttttctgtggatttctctattctag

SEQ ID NO: 182461 - DNA, 601 bp, Human
acaacaggcccgggtgtgtgatgttcccctccctgtgtccaagtgttctcattgttcaattcccacctatgagtgagaacatgcagtgtttggttttctgtccttgcgatagtttgctgagaatgatggtttccagcttcatccatgtccctacaaaggacatgacctcatccttttttatggctgcatagtattccatggtgtatatgtgccacattttcttaatccagtctatcattgttagacatttggcttggttccaagtctttgctattgtgaatagcgccacaataaacatacrtgtgcatgtgtctttatagcagcatgattcataattctttgggtatatacccagcaataggatggctgggtcaaatggtatttctagttctagatccttgaggaattgccacactggaagaccacatcttaacttgatcatttgcaaagatcttatttccaaataagatcacattcccaggcactggcgaattagaacttggacatcttttgtgggacacaactcaacccgtaacatgaagcagaaggctggggctggctgggggtgataggaggcttggatagaggtccacctaacacc

SEQ ID NO: 182462 - DNA, 601 bp, Human
aactctctcttttagagatgggggaattgcaatttcaggattctggaaatgcaaggaagagcttaacataaccaggaaacagcacagctgcaggcaagaccttcagccaagtcctctctggtatggttcagagcagccaagagaaggatcaaaagtatttggaaattaattgttttttaagtccctcttttctgcagcttgtaccaaaaaacaaaaacacataattttaaaaaaatccatctctcttggaactgccaccaagacagctcttctaagcaagagcctgcaccccacattcacygatggcctggcaaggcaatgggaaaacaagccacccttcctgctgctcatgccacctgaacctcatgccgggtattgaaatgtaggggacagattgcaacctgtttacagcatcctagcggacacgataccactgcttagctatcagtgctcaaagataaccactagtgtggggcgggggaagtgtgtcagtttccagggggctgctataacaaaatgccacattactgggtggcttaaagaacagaaacgtattgttacagttctggaagccagaaatctgaaatcaagatactggcag

SEQ ID NO: 182463 - DNA, 601 bp, Human
gctcccctgcagcggccatcagggttgtctctcaggggaaatacagagcctgaaaggttttaaaaactagcccaactctctcttttagagatgggggaattgcaatttcaggattctggaaatgcaaggaagagcttaacataaccaggaaacagcacagctgcaggcaagaccttcagccaagtcctctctggtatggttcagagcagccaagagaaggatcaaaagtatttggaaattaattgttttttaagtccctcttttctgcagcttgtaccaaaaaacaaaaacacataatttwaaaaaaatccatctctcttggaactgccaccaagacagctcttctaagcaagagcctgcaccccacattcaccgatggcctggcaaggcaatgggaaaacaagccacccttcctgctgctcatgccacctgaacctcatgccgggtattgaaatgtaggggacagattgcaacctgtttacagcatcctagcggacacgataccactgcttagctatcagtgctcaaagataaccactagtgtggggcgggggaagtgtgtcagtttccagggggctgctataacaaaatgccacattac

SEQ ID NO: 182464 - DNA, 601 bp, Human
gtcgtctcactgccgggagacacccagccagcaggaatcggggaaaaaagggaagtggaggcaggagctgagcgctcccctgcagcggccatcagggttgtctctcaggggaaatacagagcctgaaaggttttaaaaactagcccaactctctcttttagagatgggggaattgcaatttcaggattctggaaatgcaaggaagagcttaacataaccaggaaacagcacagctgcaggcaagaccttcagccaagtcctctctggtatggttcagagcagccaagagaaggatcaaaartatttggaaattaattgttttttaagtccctcttttctgcagcttgtaccaaaaaacaaaaacacataattttaaaaaaatccatctctcttggaactgccaccaagacagctcttctaagcaagagcctgcaccccacattcaccgatggcctggcaaggcaatgggaaaacaagccacccttcctgctgctcatgccacctgaacctcatgccgggtattgaaatgtaggggacagattgcaacctgtttacagcatcctagcggacacgataccactgcttagctatcagtgctcaa

SEQ ID NO: 182465 - DNA, 601 bp, Human
acactggaaaacagaaaagtaaaaagaggaaataaaaccctccctaatcccatgccttggaaagaagcactgtgaacaagcaccttctccccaacttgatgaggtgtcgtctcactgccgggagacacccagccagcaggaatcggggaaaaaagggaagtggaggcaggagctgagcgctcccctgcagcggccatcagggttgtctctcaggggaaatacagagcctgaaaggttttaaaaactagcccaactctctcttttagagatgggggaattgcaatttcaggattctggaaaygcaaggaagagcttaacataaccaggaaacagcacagctgcaggcaagaccttcagccaagtcctctctggtatggttcagagcagccaagagaaggatcaaaagtatttggaaattaattgttttttaagtccctcttttctgcagcttgtaccaaaaaacaaaaacacataattttaaaaaaatccatctctcttggaactgccaccaagacagctcttctaagcaagagcctgcaccccacattcaccgatggcctggcaaggcaatgggaaaacaagccacccttcctgctgctca

SEQ ID NO: 182466 - DNA, 601 bp, Human
gcaaaaaaagctattctcaaacgtcaaaaatggcattcaggatagagaagatcacacaaaatgaagcagaactaggcagcatcttatagttgaaggaaataaggaaataagattccttgggaaattgcaggaggtttaaaaacctccctgcaaagaggactgaaaacttcatccatgcagaggaatggtaagatgctaggaacaggggcagccttaaaggagcgcttctcaaacgtcagagcgcatcagaatcacttgaaggactggttaaaacagattgcagctgttaggcactgactargacttggtctgtttcatagacttggtctgtttcatactgagatggtcagtttcaagccagtcctatgatgctgtgtgatataagcatcacagtcctctggaggcagcattaaaatgcaaatttctgggtctcacccctagagtttctgatttagtaggtctggggtagggcctgagaaattgcacatctaacaagttcccaggtaacgctgatgctgctggtctggggaccacacttcgagaaacactggtctagaaggcaacaaagggcagggttttctctgcaccaggtgctaccttt

SEQ ID NO: 182467 - DNA, 601 bp, Human
aagccacttgtaaacttgctggattcccaaggaagaggatggccatttagccccacggctccttcaggcacacagaaaaagtccttatcatgaaccagcactgtaaaacatgtatagaaattctgggcaaaaaaagctattctcaaacgtcaaaaatggcattcaggatagagaagatcacacaaaatgaagcagaactaggcagcatcttatagttgaaggaaataaggaaataagattccttgggaaattgcaggaggtttaaaaacctccctgcaaagaggactgaaaacttcatccrtgcagaggaatggtaagatgctaggaacaggggcagccttaaaggagcgcttctcaaacgtcagagcgcatcagaatcacttgaaggactggttaaaacagattgcagctgttaggcactgactaagacttggtctgtttcatagacttggtctgtttcatactgagatggtcagtttcaagccagtcctatgatgctgtgtgatataagcatcacagtcctctggaggcagcattaaaatgcaaatttctgggtctcacccctagagtttctgatttagtaggtctggggtagggcctg

SEQ ID NO: 182468 - DNA, 601 bp, Human
ccctaagtgacagggtaagactttgcctcaaaaaaaaaaaaattatgctcaaaatcactgagtattgcttttcacaggacttgggggaaatagaaagaggtgaggctattctggaaaatagaaatcagcaataatctctcaggtgtggccacaaagccacttgtaaacttgctggattcccaaggaagaggatggccatttagccccacggctccttcaggcacacagaaaaagtccttatcatgaaccagcactgtaaaacatgtatagaaattctgggcaaaaaaagctattctcaaamgtcaaaaatggcattcaggatagagaagatcacacaaaatgaagcagaactaggcagcatcttatagttgaaggaaataaggaaataagattccttgggaaattgcaggaggtttaaaaacctccctgcaaagaggactgaaaacttcatccatgcagaggaatggtaagatgctaggaacaggggcagccttaaaggagcgcttctcaaacgtcagagcgcatcagaatcacttgaaggactggttaaaacagattgcagctgttaggcactgactaagacttggtctgtttcatagac

SEQ ID NO: 182469 - DNA, 601 bp, Human
tttcctctccccagaggtttgtggggtaggcgctgaagttccaaccttctaagcatgccttggtctttcctgtgaccagctgccatcctgaagctgcctaggggatcccagacacccatcatctcattagcaaacaagagactaacattctggagattccaaggtttatgccagggagctggatggaagaccaaatatatatttcacaatatccaactacacatgttcaagactcttctctaagaactgcccaaatcccagtttggatacacatgctatgggcgtgactacttggctactrctactggacctgccaagagttgtatagaacaggacttggggtggtcctcttccacgatgagtggccacttctgccaaatggctgctgaagaagaaaaggcaagactgcggagagaaagatgcatgaagagaacccagagaaagatcgcgcccgtgatcctagaactttgggaggccaaggtaggtgtcttgagcccaggagctcgagaccagcctgggcaatatagtgagacccctgtctctattttaaaaagtggaaaagacagaaagaaaaaaaggcagaaagacagaaagaaggaca

SEQ ID NO: 182470 - DNA, 601 bp, Human
cagcaaactattgcaaggacagaaaaccaaacaccacatgttctcactcataggtgggaattgaacaatgagaacacagggacacaggaaggggaacatcacacacccgggcctgttgtggggtggggggagggggcagggataccattaggagatatgcctaatgttaaatgacgatttaatgggtgcagcacaccaacatggcacatgtatacatatgtaactaacctgtgcacatgtaccctaaaacttaaagtataatttaaaaaaaaaaaaaagactatatatatatgtgtgtgtgtgtgtgtatatatacacacatatatatatattttttattattttttattttttgagacagaggctcgctctgtcgcccaggctgaagtacagtggcgtgatcttggctcactgcaacctccgcctcccaggttcaagcgattctcctgcctcagcctcctgagtagctgggattacagacatgcgccaccacacccaggttcatttttatatttttattagagacagagtttctccatgttggccaggctggtctcgaactcctgatctcaggtgatctgcccacctcggcctcccaaag

SEQ ID NO: 182471 - DNA, 601 bp, Human
tgtagggacatggatgaagctggaaaccatcattctcagcaaactattgcaaggacagaaaaccaaacaccacatgttctcactcataggtgggaattgaacaatgagaacacagggacacaggaaggggaacatcacacacccgggcctgttgtggggtggggggagggggcagggataccattaggagatatgcctaatgttaaatgacgatttaatgggtgcagcacaccaacatggcacatgtatacatatgtaactaacctgtgcacatgtaccctaaaacttaaagtataatttaaaaaaaaaaaaaagactatatatatatgtgtgtgtgtgtgtgtatatatacacacatatatatatattttttattattttttattttttgagacagaggctcgctctgtcgcccaggctgaagtacagtggcgtgatcttggctcactgcaacctccgcctcccaggttcaagcgattctcctgcctcagcctcctgagtagctgggattacagacatgcgccaccacacccaggttcatttttatatttttattagagacagagtttctccatgttggccaggctggtctcgaactcct

SEQ ID NO: 182472 - DNA, 601 bp, Human
atacaagttaagactgtaagatactatgttttcacccatggggaaaataacctcctttgtgactgataacccctatctaaccaggatctgcaaaaacaggtgagaatgcctgtctgtgaaaggtaatttggagatatccatcaaaagcccaaatgcacgtgtcttttgacctaacaatagctttaggtgtgcaataatgtaagtatgaaggtattttgtggagcacttttcattagagggaaaagactcttgggaagtgacctaaatgttcaccaacaggggacaatgatgtatcgacagrgtggcatcctgtggagctgctgaagtgcatgagtgctggagtgaaaggctccaaaacacactacgtgtacaaaaggttctcactttaacaaaagggcataaataaaatgtctgtgcttgtatatgcaaggcaaatgtgccgaaagaatacacatgaagcatttgatgctggttctttcttaaaaatgaaaccaaagtaagaagactataaccatgctgctataaagacacatgcacacgtacgtttattgtggcactattcacaatagcaaagacttggaaccaagtcaaatgtccaatg

SEQ ID NO: 182473 - DNA, 601 bp, Human
cagtaacatggctgatggctgatttttaaagatacatgtgtatatgcatgtagataaaaagaaagataaagagacgagggaaagaccaagaagggggccagggagacagataaagcctctattccctttgtgtggtatgaactacctatcagtgagcagcccagtttaaaaagagcaaagaacatatacaggtgatttacagaaaaaacaattgcaaatgatcaataacaaaaaaaaaaaaaaagatactcattctcattcaaaattggagaaatacaagttaagactgtaagatactatrttttcacccatggggaaaataacctcctttgtgactgataacccctatctaaccaggatctgcaaaaacaggtgagaatgcctgtctgtgaaaggtaatttggagatatccatcaaaagcccaaatgcacgtgtcttttgacctaacaatagctttaggtgtgcaataatgtaagtatgaaggtattttgtggagcacttttcattagagggaaaagactcttgggaagtgacctaaatgttcaccaacaggggacaatgatgtatcgacagggtggcatcctgtggagctgctgaagtg

SEQ ID NO: 182474 - DNA, 601 bp, Human
aattcattcagactttctgagcactggggagcagcaggggggctcacagtatcgtctctgccctagggagctaacaggctggctggaagaagaatctctttctgcctcagctacatcccctgctttcatacctatccctcccaccagatgtattctgagggttgtgactgtattgaataaatgtggacctgtctcctgggcaccaaggacactcagtaattgataaatgaaggaagactcagctcaaatcaactattagaattatgttcagtaacatggctgatggctgatttttaaagayacatgtgtatatgcatgtagataaaaagaaagataaagagacgagggaaagaccaagaagggggccagggagacagataaagcctctattccctttgtgtggtatgaactacctatcagtgagcagcccagtttaaaaagagcaaagaacatatacaggtgatttacagaaaaaacaattgcaaatgatcaataacaaaaaaaaaaaaaaagatactcattctcattcaaaattggagaaatacaagttaagactgtaagatactatgttttcacccatggggaaaataacctcctttgt

SEQ ID NO: 182475 - DNA, 601 bp, Human
aacgaagctgtaatttaagaatggccagggaaggcctcaccaagaaaggaacacagaatgaagatctgagagaaatgtattatgtatctattgttacatcgcaaattacccccaatttaacagttggaaacatcaaacattcattatttcatattgttttagcacatcaggaatcagagagtggcttagctgggcaattgtgcctcaggttcccccatgagcttggggtcaggaagtcagtgggtgctgcctcatttgaaggcttgactggggctggaggagctacttgtaagaaagctcrccctggccgggcatggtggctcacgcctgtaatcccagcactttgggaggcagaggtggacggatcatgaggtcaggagatcaagaccatcctggctaacacggtgaaaccccatctctactaaaaatacaaaaaattagccgggcgtggtggcaggcacctgtagtcccagctcctggggaggctgaggcaggagaatggcatgaacccgggaggcagagcttgcagtgagccgagatcgcaccgctgcacttcagcctgggcgacagagcgagactccatctcaaaaaaaaaagaaaa

SEQ ID NO: 182476 - DNA, 601 bp, Human
ttaaactcctcctccttcagcttaaattctagtggtcattatgccattccatctttagttaattttagacacatgcacatgtgtataaaatgtgtatgtgtataaaattttccataagtgaaaacttaaaaattttctaatgggattgggggagggagttgtgccaggagacaaaaaataagcaaaacatatcaggttagctcttggtacacactaaggagaataaagcaaggaagggggatagaaagtgttatgagaacgaagctgtaatttaagaatggccagggaaggcctcaccaaraaaggaacacagaatgaagatctgagagaaatgtattatgtatctattgttacatcgcaaattacccccaatttaacagttggaaacatcaaacattcattatttcatattgttttagcacatcaggaatcagagagtggcttagctgggcaattgtgcctcaggttcccccatgagcttggggtcaggaagtcagtgggtgctgcctcatttgaaggcttgactggggctggaggagctacttgtaagaaagctcaccctggccgggcatggtggctcacgcctgtaatcccagcactt

SEQ ID NO: 182477 - DNA, 601 bp, Human
tgtgctggacacggggttatattgcaggaaatataagtggttaaactcctcctccttcagcttaaattctagtggtcattatgccattccatctttagttaattttagacacatgcacatgtgtataaaatgtgtatgtgtataaaattttccataagtgaaaacttaaaaattttctaatgggattgggggagggagttgtgccaggagacaaaaaataagcaaaacatatcaggttagctcttggtacacactaaggagaataaagcaaggaagggggatagaaagtgttatgagaacraagctgtaatttaagaatggccagggaaggcctcaccaagaaaggaacacagaatgaagatctgagagaaatgtattatgtatctattgttacatcgcaaattacccccaatttaacagttggaaacatcaaacattcattatttcatattgttttagcacatcaggaatcagagagtggcttagctgggcaattgtgcctcaggttcccccatgagcttggggtcaggaagtcagtgggtgctgcctcatttgaaggcttgactggggctggaggagctacttgtaagaaagctcaccc

SEQ ID NO: 182478 - DNA, 601 bp, Human
tctgagctctaggctgggactctgggagctgcagcaaaacagtgtattttaatctataaacaaccctttatttgagaatcatcctcaatatgaatattattattattcattcaacacatatttgagggcctattctgtgtcaggcactgtgctggacacggggttatattgcaggaaatataagtggttaaactcctcctccttcagcttaaattctagtggtcattatgccattccatctttagttaattttagacacatgcacatgtgtataaaatgtgtatgtgtataaaattttccrtaagtgaaaacttaaaaattttctaatgggattgggggagggagttgtgccaggagacaaaaaataagcaaaacatatcaggttagctcttggtacacactaaggagaataaagcaaggaagggggatagaaagtgttatgagaacgaagctgtaatttaagaatggccagggaaggcctcaccaagaaaggaacacagaatgaagatctgagagaaatgtattatgtatctattgttacatcgcaaattacccccaatttaacagttggaaacatcaaacattcattatttcatattgt

SEQ ID NO: 182479 - DNA, 601 bp, Human
ggcctgcagtctgaatgctgctgtccatgtggggacccgatgggaggcccctttccctgccctcactggcctggtcaactcccagaccccccacaagctagagtctccgtaagtaccatatccctcccctctaacctccaaatgggccccatcagggacgatgcagctgcctgaaggattcagcccagtccatctccttgtcttggcgagatctgaccaacccataacacaaagacactgtgagcctggggcagggatggtgctgagccaggccaggccaggccaggcagacatctggagwgagccactggggctctggctgggtgacctcaccagcagcaggacaagtcaccccagaggaccatactacccacagggaggaagccgtgtccaggtcttttccaatacaagattccctaatctgcttacaacacatctggctccttgaccaagtcacagtaagactgaagcggcagctccaggcctcaagagatgctggattgagacccttctgcattctctggacgtccatccctgtggtcttaggtcatcccggatgactgcccacactctactaacagagccatggccacacaggccc

SEQ ID NO: 182480 - DNA, 601 bp, Human
gtgtggtagcacgtgcctgtggtcccagctactcaggaggctgagctgggaggattactggagcctgggaagtcgaggctgcagtgagccatgatggcgccactacactccagcctgggtgacagagcaagaccctgtctcaaaaaatgaaaataggccgggcgcggtggctcatgtctgtaatcccagcaatttgggaggccgaggcgggtggatcacttgaggtcaggggttcgagaccaccctgaccaacatggtgaaacccgatctccactaaaaataacaaaaattagctgggcgygatggtgtgtgcctgtaatccagctactcaggaggctgaagcacgagaatcgcttggtcctgggaggtggaggttgcagtgagctgagaccatgccactgcactccagcctgggtgacagagtgagactccatctcaaaaataaataaacaaataaaataaaaataaattttaaaaactttccaaaatcactgaagggggcggtatagcaaagtagttaggctctgtttagtgtggtgattctagacccagactgcctgggttggaatccagctctgcctctcaccaccactatccttgg

SEQ ID NO: 182481 - DNA, 601 bp, Human
cctgggcaagatggtgaaaccccatctccaccaaaaatacaaaaattagccaggtgtggtagcacgtgcctgtggtcccagctactcaggaggctgagctgggaggattactggagcctgggaagtcgaggctgcagtgagccatgatggcgccactacactccagcctgggtgacagagcaagaccctgtctcaaaaaatgaaaataggccgggcgcggtggctcatgtctgtaatcccagcaatttgggaggccgaggcgggtggatcacttgaggtcaggggttcgagaccaccctgmccaacatggtgaaacccgatctccactaaaaataacaaaaattagctgggcgcgatggtgtgtgcctgtaatccagctactcaggaggctgaagcacgagaatcgcttggtcctgggaggtggaggttgcagtgagctgagaccatgccactgcactccagcctgggtgacagagtgagactccatctcaaaaataaataaacaaataaaataaaaataaattttaaaaactttccaaaatcactgaagggggcggtatagcaaagtagttaggctctgtttagtgtggtgattctagac

SEQ ID NO: 182482 - DNA, 601 bp, Human
aagaaaggaaagaaaggaaagaaagaaagaaagaaagaaagaaagaaagaaagaaagaaagcaaagaaagcaaagaaagagagaaaactaatactgcaagctatagtattgtcccccaaacactactttacccatttcactgccatgagcagagacttcttatgaagttatctagtgataaaaataatactttctcactacatacaatttgataatgcaggaaaacacacaaaaataaatatcacccatcatcccaccattcagaggtcatcaccatcaacattttggtatccatatgttgatttgttttctaagcatatgttcctctttaaaatgagacaaaatcaaactatagattctttttatgtataaatttttgtgaatacctttccaaaatctgtccaggcacagtggttcatgcgtcttatctcaatacttttgggaggctgaggtgggtgaattgcttaaactcaggagtttgagaccagcctgggcaagatggtgaaaccccatctccaccaaaaatacaaaaattagccaggtgtggtagcacgtgcctgtggtcccagctactcaggaggctgagctgggaggattactg

SEQ ID NO: 182483 - DNA, 601 bp, Human
gaaagaaaggaaagaaaggaaagaaagaaagaaagaaagaaagaaagaaagaaagaaagaaagcaaagaaagcaaagaaagagagaaaactaatactgcaagctatagtattgtcccccaaacactactttacccatttcactgccatgagcagagacttcttatgaagttatctagtgataaaaataatactttctcactacatacaatttgataatgcaggaaaacacacaaaaataaatatcacccatcatcccaccattcagaggtcatcaccatcaacattttggtatccatatgttgatttgttttctaagcatatgttcctctttaaaatgagacaaaatcaaactatagattctttttatgtataaatttttgtgaatacctttccaaaatctgtccaggcacagtggttcatgcgtcttatctcaatacttttgggaggctgaggtgggtgaattgcttaaactcaggagtttgagaccagcctgggcaagatggtgaaaccccatctccaccaaaaatacaaaaattagccaggtgtggtagcacgtgcctgtggtcccagctactcaggaggctgagctgggaggattac

SEQ ID NO: 182484 - DNA, 601 bp, Human
aaggaaagaaaggaaagaaaggaaagaaaggaaagaaagaaagaaagaaagaaagaaagaaagaaagaaagaaagcaaagaaagcaaagaaagagagaaaactaatactgcaagctatagtattgtcccccaaacactactttacccatttcactgccatgagcagagacttcttatgaagttatctagtgataaaaataatactttctcactacatacaatttgataatgcaggaaaacacacaaaaataaatatcacccatcatcccaccattcagaggtcatcaccatcaacattttggtatccatatgttgatttgttttctaagcatatgttcctctttaaaatgagacaaaatcaaactatagattctttttatgtataaatttttgtgaatacctttccaaaatctgtccaggcacagtggttcatgcgtcttatctcaatacttttgggaggctgaggtgggtgaattgcttaaactcaggagtttgagaccagcctgggcaagatggtgaaaccccatctccaccaaaaatacaaaaattagccaggtgtggtagcacgtgcctgtggtcccagctactcaggaggctgagc

SEQ ID NO: 182485 - DNA, 601 bp, Human
tccaggccctcaagtttatgaatggggaaaatgaggcctggcaaggagaaacatgcccaaggccccagtttaacatttgtaatttcacaaatctaggatgccagtgattgaggccagcagtggctcatgtctgtaatttgggtaattttgggaggatcacttgagaccaggagttcaaaaccagtctgagcaatatggcaaaacactgtttctacagaaaaaaataataataagaagaagaaaataaaataagaaaattagcggggtgtggtggcacacgcctgtagttccagctacttgrgaggctgaggcaggaggactgcttgagccctggaggaggaggctgcagtgagctatgatcatgacactgtattccagcctgagtaacagagcaagaccatgtctctaataaactagtatatactattgattgtaagatgcatctgacttccaagatattaatatgtcaggggaaaatgtatgtctcagaatcaatgacacaggactcttcatgctgacgtagggagctgctgcttcttgcttcaatgggccatggtctgggaacccttgagcagcgctgaactgaggctctgggtcactc

SEQ ID NO: 182486 - DNA, 601 bp, Human
cctctcttcttccctccctcccttcccttcgggcttctttttccttcctcccttccttctacccatcctccttccctccttctttctcacccccccctttttccttccttccacccgttctccttcctcatctatcacatattaaacatagtacagcctaatgtttccccaggtgtgttaaacaggatagcaattctgccagatgtgtattgtaagtgttatgcagtgatagtaaagggtcagtgttacggtccaaagaatttaggacaaacaccccattattcagattgagtttatttayagtaggccttttagaatatgctgacatgcgcttgaaatctcaaacaaggcaacagcatgcagcatccttccgcgcacacagacgcagaacccgttgagggaaatacagcagggctaccgtgaaatccactttgggacacacagtcatggccacagaatgcaaggtttgaagtggggcagttccgtgctcatccggtctgatgacatagggcacaattacagcctccttcctcccaccacatcctggaaggcctcgcaggttccttggtcaccatgctcaccttctcaggaggatccactg

SEQ ID NO: 182487 - DNA, 601 bp, Human
tcttttcctcttcccctctcttcttccctccctcccttcccttcgggcttctttttccttcctcccttccttctacccatcctccttccctccttctttctcacccccccctttttccttccttccacccgttctccttcctcatctatcacatattaaacatagtacagcctaatgtttccccaggtgtgttaaacaggatagcaattctgccagatgtgtattgtaagtgttatgcagtgatagtaaagggtcagtgttacggtccaaagaatttaggacaaacaccccattattcagrttgagtttatttacagtaggccttttagaatatgctgacatgcgcttgaaatctcaaacaaggcaacagcatgcagcatccttccgcgcacacagacgcagaacccgttgagggaaatacagcagggctaccgtgaaatccactttgggacacacagtcatggccacagaatgcaaggtttgaagtggggcagttccgtgctcatccggtctgatgacatagggcacaattacagcctccttcctcccaccacatcctggaaggcctcgcaggttccttggtcaccatgctcaccttctc

SEQ ID NO: 182488 - DNA, 601 bp, Human
ctcttattatacctcctgtaggtctggcctaatttctcctctctctggaataaacatagtaatttcactcctcaaagttaggaaacctggtgactgggagcggtggctcacgcctgaaatcccagcactttgggaggctgaggagggcggatcacttgaggtcaggagctcgtgaccagcctgcctaacatggtgaaaccccatctctactaaaatacaaaaaattagccagggatggtggcgcacgcctgtaatcccagctgcttgggaggctgtggcaggagaattgcttgaacccggraggtggaggctgcagtgagccaagatcctggcattgcactccagcctgggcaacaagtgcgaaactgtctccaaaacaaaccaaaaaaaacaaagttgaggaaccccggagtgctgaagccctggttcttgaaatcctcgcttccctcttttcctcttcccctctcttcttccctccctcccttcccttcgggcttctttttccttcctcccttccttctacccatcctccttccctccttctttctcacccccccctttttccttccttccacccgttctccttcctcatctatcacat

SEQ ID NO: 182489 - DNA, 601 bp, Human
atcgagaaaggccaagcaacaaagaagcgccagcagctccgccacccagggctcacccccacccgcagctcggcttccatatctcagtaccgatccctgagggaaaaagtcgcatcctcagagccctactctccaggttcctgttccctgaggaacccaaaagaacataagaaaatcagccatgaacactctcttattatacctcctgtaggtctggcctaatttctcctctctctggaataaacatagtaatttcactcctcaaagttaggaaacctggtgactgggagcggtggctcaygcctgaaatcccagcactttgggaggctgaggagggcggatcacttgaggtcaggagctcgtgaccagcctgcctaacatggtgaaaccccatctctactaaaatacaaaaaattagccagggatggtggcgcacgcctgtaatcccagctgcttgggaggctgtggcaggagaattgcttgaacccgggaggtggaggctgcagtgagccaagatcctggcattgcactccagcctgggcaacaagtgcgaaactgtctccaaaacaaaccaaaaaaaacaaagttgaggaaccccgga

SEQ ID NO: 182490 - DNA, 601 bp, Human
tttttaaaaagggaactaaaagctctatctagttagtaaccttagcagcttcaaatataaataatacacacaggcacccacacacttcatttcccttataggcagttaagcaacttgagagggcttaggaggtgtctaatgagaggaggggacagatatttgggtagaaaagaggagggaggtctgggtagggagaagtcaacagaaacagaaaagaaaggcgaatatgaaaagttatcgagaaaggccaagcaacaaagaagcgccagcagctccgccacccagggctcacccccacccrcagctcggcttccatatctcagtaccgatccctgagggaaaaagtcgcatcctcagagccctactctccaggttcctgttccctgaggaacccaaaagaacataagaaaatcagccatgaacactctcttattatacctcctgtaggtctggcctaatttctcctctctctggaataaacatagtaatttcactcctcaaagttaggaaacctggtgactgggagcggtggctcacgcctgaaatcccagcactttgggaggctgaggagggcggatcacttgaggtcaggagctcgtga

SEQ ID NO: 182491 - DNA, 601 bp, Human
aaaccatggctggttctgtgtgtgtgcatcacaacaataaaaacagcagataagccagggtaatttgagagggaaagagaacacaaatgctcagaattagggattagaaagaaaacaatggcacaacaaatatagtagaaacttttttttttttttttgagacggagtcttgcttcatcacccaggctggagtgcagtgggcgatctcggctcactgcgacctccgcctcccgggttcaagtgattctcctgcctcagcctcccgagtagctgggattacaggcgcccgccaccatgcccrgctaatttgtgtatttttagtggagacggggtttcactatgttgaccaggctggtctcaaactcctgacctcaagtgatccgccagcctcagcctcccaaagtgctgggattaccggcatgagccaccgtgctgtacttatagtagaaactttttaaatgcaagaacatatgacttataattctgtatcttcaacaccagaccttccatgagattcaaattatcaaaagggtttcaagagatgccaaaaagaagtcaaacctttgaaaaatgacctccccgcaaaaggcactgcacccag

SEQ ID NO: 182492 - DNA, 601 bp, Human
cttttgttcctgaattgagtccccaggaaccacaagcctgcgtgatctcaggagaccaggacgatgcgccatcccgtgacccaggcttcaagtaattgccaataaatatatacaatgcaggtcagactggaggaagatctacacactgatgtccaactcatgattcttctagagaaaactctatagcgtggcaggaagcacaggagaatatggctgaaagttaccaccaacacctactcatttggagcgacgaggactggaggcaagcgttgggcaatgggatgatgaagcccgttccackgagaacccgtctcctgctcaggtggtgccccgttctccaccacttgcagtgaacactccagggccaagcagggccacatgcagctgagtgcctgtgcgcagctgggcttctcccccagctacagggtttaccccccgttccagaataaggtggttgcacacatcccaaggaaatagcaagctgatccacagcaggcccctagtacagtagaagcttgagggaagcaacaagaaacaacaaatccaccctgcagggccagctacaagcctgggccacacccacatccctcaggcagctggc

SEQ ID NO: 182493 - DNA, 601 bp, Human
catccagaaggggaaggtctttgcttttgttcctgaattgagtccccaggaaccacaagcctgcgtgatctcaggagaccaggacgatgcgccatcccgtgacccaggcttcaagtaattgccaataaatatatacaatgcaggtcagactggaggaagatctacacactgatgtccaactcatgattcttctagagaaaactctatagcgtggcaggaagcacaggagaatatggctgaaagttaccaccaacacctactcatttggagcgacgaggactggaggcaagcgttgggcaaygggatgatgaagcccgttccacggagaacccgtctcctgctcaggtggtgccccgttctccaccacttgcagtgaacactccagggccaagcagggccacatgcagctgagtgcctgtgcgcagctgggcttctcccccagctacagggtttaccccccgttccagaataaggtggttgcacacatcccaaggaaatagcaagctgatccacagcaggcccctagtacagtagaagcttgagggaagcaacaagaaacaacaaatccaccctgcagggccagctacaagcctgggccaca

SEQ ID NO: 182494 - DNA, 601 bp, Human
actttgggaggcagagggaggactgcttgagcctaggagtttaagatcagcccggacaacaccgtgagacctcatctctacaaaatatatatatttttaaattagctgggtgtggtggctcatgtctgtagttctagtaactcgggaggctgaggtgggaggatagcttgagcctggcaggtggaggctgcagtgaactgtgattgtaccactacactccagcccacacttcagagtgtgacaccctgtatcaaaaaagtgggggagcagaggcatccagaaggggaaggtctttgctttygttcctgaattgagtccccaggaaccacaagcctgcgtgatctcaggagaccaggacgatgcgccatcccgtgacccaggcttcaagtaattgccaataaatatatacaatgcaggtcagactggaggaagatctacacactgatgtccaactcatgattcttctagagaaaactctatagcgtggcaggaagcacaggagaatatggctgaaagttaccaccaacacctactcatttggagcgacgaggactggaggcaagcgttgggcaatgggatgatgaagcccgttccacggaga

SEQ ID NO: 182495 - DNA, 601 bp, Human
tacttcgtgaggtggaggtgggaggatcgcttgagtccaggagttccagaccagcctgggcaacatagtgagaccccatctctatttttaaaaatagaaaaaatttaaaaaaaattaaaaagggaggaatggccagggggcagtggctcatgcctgttatcccagcactttgggaggcagagggaggactgcttgagcctaggagtttaagatcagcccggacaacaccgtgagacctcatctctacaaaatatatatatttttaaattagctgggtgtggtggctcatgtctgtagttcyagtaactcgggaggctgaggtgggaggatagcttgagcctggcaggtggaggctgcagtgaactgtgattgtaccactacactccagcccacacttcagagtgtgacaccctgtatcaaaaaagtgggggagcagaggcatccagaaggggaaggtctttgcttttgttcctgaattgagtccccaggaaccacaagcctgcgtgatctcaggagaccaggacgatgcgccatcccgtgacccaggcttcaagtaattgccaataaatatatacaatgcaggtcagactggaggaagatc

SEQ ID NO: 182496 - DNA, 601 bp, Human
attgactggtcaccgtgaaattaggctctgtcaattaatagtcaggtgatcatatgcacttcattcttgagtcaccgttctcctagaattaaaaatacataatctggcttggagctggggctcatgtctgtaatcccagaactttgtgaggccgaggtgggcggatcatgtgaggtcaggagtttgagaccagcctagccaacatggtgaaaccctgtctctactaaaaatacaaaaaaattagccaggcgtggtggcaggcacctgtaatcccagctactcgggaggctgaggcaggagratcgcttgaacccaggaggcagaggttgcagtgagctgagattgcaccactgcactccagcctgggcaacaagagcaaaactccatcaaaaaacaaaacaaaacaaaacaaaaaaaacacattatctgaggctctaaaattctacccttataactttatgtctcttgggggacactcactcatgctcccaacacttgctgataaacctgctctccaaggaacagggggagccctgatatgtagtatctgtcgatttctgtgccaaagacactcccagcatggacagtttcaagccccaac

SEQ ID NO: 182497 - DNA, 601 bp, Human
caggaggggaggtcactatggtccagctgcctttgctacaaataccacatcagttgtagttacaaatgccagtcacgggtccaatctccctccgtagagtcggggcggggggctctccaccaccttccaacaatttccctcagctttcttagtaacttctccaccctcaaactcagagcagcggagtgtgaatatactagaaagaggactggattgactggtcaccgtgaaattaggctctgtcaattaatagtcaggtgatcatatgcacttcattcttgagtcaccgttctcctagaaytaaaaatacataatctggcttggagctggggctcatgtctgtaatcccagaactttgtgaggccgaggtgggcggatcatgtgaggtcaggagtttgagaccagcctagccaacatggtgaaaccctgtctctactaaaaatacaaaaaaattagccaggcgtggtggcaggcacctgtaatcccagctactcgggaggctgaggcaggagaatcgcttgaacccaggaggcagaggttgcagtgagctgagattgcaccactgcactccagcctgggcaacaagagcaaaactccatca

SEQ ID NO: 182498 - DNA, 601 bp, Human
cagagttaactgaactgaatcgaagcccaacactcagcatcctaacagaacgacttaataacgttcccccaaattaacactcttgtccatgataaagctgagtgtcacatttcagctgattatactaacagccaatgggtctccagatgttgccaaatgtcccttgattaagaaccacggtctcagatgcagacagaaccataatcaatcctccggtttatttttcttccagtcattttttccttatgttaagtatagatttccttcttccagtgactggtacatagaatccactgcacaygcagctactgtcatcatcaacatcatcaatattatcatcatgatcatcatcaatgatcattattgtcatcattttcattatcacctccaggattctggcattttaattcctggaaaaggctgctggagtttggaagcttcattaagaacatcttcttgataatttatgggtagactaaataaggctagtcctcagttttttaggcacagcttcacgcaactagaaaagccgtaagcactgacatcaaggtccagtctaaccactgagtaatcctgtgagcctgcacaggtcacaaaacca

SEQ ID NO: 182499 - DNA, 601 bp, Human
atttaggctgatgtcttccaaaacagtctcaaatcaggagacaaaagtaagtttcacttcaaacaggataacagaatctgtgttgagaaggcaagctgggagctcagcaggaaacatacaaagccagggttgattcatgatgggtgacatgagcagacgagagaaggagaccgataggccagctgtgtgctactgactgctagtccactgctcaggagtggtcctcagacctacagcatcagcgtcacctcggagctggctggaaacccagaacctcagcccccaccctagatctcctggwttagaatctgcattttaacaagaggcccagctcactctaagtccatcaaaacataagaagtcctgacatacactgaggttcaaattcttttccagagttaactgaactgaatcgaagcccaacactcagcatcctaacagaacgacttaataacgttcccccaaattaacactcttgtccatgataaagctgagtgtcacatttcagctgattatactaacagccaatgggtctccagatgttgccaaatgtcccttgattaagaaccacggtctcagatgcagacagaaccataatcaa

SEQ ID NO: 182500 - DNA, 601 bp, Human
caacttcacagtatttcagaagggattatgttttatcagggaagaaagaatgattttgaggatggggagctgtttctcatattcttcctgatgatgcccagggtaacaccagatttctgtcatcgttgctgaaccacatcagaatttaggctgatgtcttccaaaacagtctcaaatcaggagacaaaagtaagtttcacttcaaacaggataacagaatctgtgttgagaaggcaagctgggagctcagcaggaaacatacaaagccagggttgattcatgatgggtgacatgagcagasgagagaaggagaccgataggccagctgtgtgctactgactgctagtccactgctcaggagtggtcctcagacctacagcatcagcgtcacctcggagctggctggaaacccagaacctcagcccccaccctagatctcctggattagaatctgcattttaacaagaggcccagctcactctaagtccatcaaaacataagaagtcctgacatacactgaggttcaaattcttttccagagttaactgaactgaatcgaagcccaacactcagcatcctaacagaacgacttaataacgtt

SEQ ID NO: 182501 - DNA, 601 bp, Human
ccagtgtccattctttaaaatagatgagtaacaacttcacagtatttcagaagggattatgttttatcagggaagaaagaatgattttgaggatggggagctgtttctcatattcttcctgatgatgcccagggtaacaccagatttctgtcatcgttgctgaaccacatcagaatttaggctgatgtcttccaaaacagtctcaaatcaggagacaaaagtaagtttcacttcaaacaggataacagaatctgtgttgagaaggcaagctgggagctcagcaggaaacatacaaagccasggttgattcatgatgggtgacatgagcagacgagagaaggagaccgataggccagctgtgtgctactgactgctagtccactgctcaggagtggtcctcagacctacagcatcagcgtcacctcggagctggctggaaacccagaacctcagcccccaccctagatctcctggattagaatctgcattttaacaagaggcccagctcactctaagtccatcaaaacataagaagtcctgacatacactgaggttcaaattcttttccagagttaactgaactgaatcgaagcccaacact

SEQ ID NO: 182502 - DNA, 601 bp, Human
aaatcagcttctgagatatcagttataccagtgtccattctttaaaatagatgagtaacaacttcacagtatttcagaagggattatgttttatcagggaagaaagaatgattttgaggatggggagctgtttctcatattcttcctgatgatgcccagggtaacaccagatttctgtcatcgttgctgaaccacatcagaatttaggctgatgtcttccaaaacagtctcaaatcaggagacaaaagtaagtttcacttcaaacaggataacagaatctgtgttgagaaggcaagctggsagctcagcaggaaacatacaaagccagggttgattcatgatgggtgacatgagcagacgagagaaggagaccgataggccagctgtgtgctactgactgctagtccactgctcaggagtggtcctcagacctacagcatcagcgtcacctcggagctggctggaaacccagaacctcagcccccaccctagatctcctggattagaatctgcattttaacaagaggcccagctcactctaagtccatcaaaacataagaagtcctgacatacactgaggttcaaattcttttccagagtt

SEQ ID NO: 182503 - DNA, 601 bp, Human
ttgcacataaatcagaacccctcaagataccccaagaacagacactagacaagacatccctgtgtcgatggcttataatgcacagtgttaaatcagcttctgagatatcagttataccagtgtccattctttaaaatagatgagtaacaacttcacagtatttcagaagggattatgttttatcagggaagaaagaatgattttgaggatggggagctgtttctcatattcttcctgatgatgcccagggtaacaccagatttctgtcatcgttgctgaaccacatcagaatttaggctgwtgtcttccaaaacagtctcaaatcaggagacaaaagtaagtttcacttcaaacaggataacagaatctgtgttgagaaggcaagctgggagctcagcaggaaacatacaaagccagggttgattcatgatgggtgacatgagcagacgagagaaggagaccgataggccagctgtgtgctactgactgctagtccactgctcaggagtggtcctcagacctacagcatcagcgtcacctcggagctggctggaaacccagaacctcagcccccaccctagatctcctggattagaatctg

SEQ ID NO: 182504 - DNA, 601 bp, Human
tcctgacctcctgatctgcctgcctcggcctcccaaagtgctgggattacaggcttgagccaccacgaccgccccctccccccaaaattctaatcttcctgatcagcttgctcaaggaggggcagctaagcagggggcggaaagagatcacaaccgggttttgagatctggggctttccagtctaggtttcgtcactgtaaccctgaacatgccactttatccaccccacatgccgcatctcaagtgttcctttgctcatttattcatttattgatgtttaagtgtagttatcatgagtgrtaactgacagcagggatggtgaatctactcgtctgcatgctggagtggggtctatacctggggaccctttgttggtagagctctctgtaaacaccaaaccttcttaacctatttgtatgtttaactcttggcacctttttggataaccagcctgcaggctcacaaaccaggacaaaaagtagtagctagctgggcgtggtggccggcgcctgcagtcccagctactccagaggctgaggcgggaggattgtttgagcccagcagttccaagctgaggtcacagtgatctacgatcacctc

SEQ ID NO: 182505 - DNA, 601 bp, Human
ccgactgccccagggctgcagaattgaaaccctccactgggtggcaccagatcaccacctcctgtgcccacccatccaggtctccaagggctgagtgaaggagcggggcaggcaccctcaggaactgtggggcacccactatcagtcctccccatgacatagtatggtggggacacgttactggtgtccgtggaaagtccctttccccatcccccgacacccaccccccaaaattcttttttttttttttttttggagatggagtctcgctctgtcgcccaggctggagtgcagtggtgcratctcggctcactgcaagctccgcctccctggttcatgccattctcctgcctcagcctcccgagtagctgggactacaggtgcccgccaccacgcccggctaattttttgtatttttagtagagacagggtctcacagtgttagccaggatggtctcgatctcctgacctcctgatctgcctgcctcggcctcccaaagtgctgggattacaggcttgagccaccacgaccgccccctccccccaaaattctaatcttcctgatcagcttgctcaaggaggggcagctaagcagggggcg

SEQ ID NO: 182506 - DNA, 601 bp, Human
acagaggagtggaaattagaatccaagcctgcataactctttcctctatcttccgccatctctccactttgagacctgagacaatattttgttttccatgtgtctttgcaggaaggcaaaaaagatttccatcaaccacaaacatatattttgggaccactgtgtataaatctctgtagaataaggcttgacgcagaggtcgcacctcctccttataacttggctaggataggaatacaagtaatggcattgaggttgggtgttccacgtgttaggtgtcagcaccttccctggtctctgytctattagcagtgttttacttcaaccactgagggccaaggtagatcacaggcaatctcaggctctgcctgtgctgctgataacctgtgcctactgctccaacttcatatacatatcacgtgcattttatacacacacacacacacacacacacacacgtgacacacacactatcataattctccattgaaagggcccagaaggaatgacatctcatcacagtgacaacatctactggctagaaattggtttccaaatattaccggaagctccttggtactaatttcaaaggcaggtattt

SEQ ID NO: 182507 - DNA, 601 bp, Human
gacttgtgcatgaccttattctttttttttttttttaagatggagtgtcattctgtcacccaggttggagtgcagtggcgtgatcatggctcacagcaacctctgcctcccaggttcaagcaattctcctgcctcagcctcctgagtagctgggattacaggtgcccgccagcacgcccagctaatttttgtatttttagtagagacagggtttcaccatgttggccaggctggtctcgaacttttgacctcaggcgatccacctgtctcggcctcccaaagtgctgggattataggcatragccactgcggccagtctggccttactcttccttggtagaatgtaaggaagtggctgtcactttatagataaaggccagaaaaaggatggaggggcttcaacaagaaggaaccaccggcttggagtggggggcaccccgcccctcaggccagcacgaccctggacacctggccaaatgaccatctgcaggtgagggcgagcctttgcctcagaaacccgtcagcaaattaggcaaaccagggagcttgactatgcccctgctaaggtcgcatacccttactcccatacagtcttacttgg

SEQ ID NO: 182508 - DNA, 601 bp, Human
acagggctgaggagcagaggtggagtgtggggctccccttcatctctgcatgggggtgggtggggtgggctccccctcatctccacatggggttgggcatctcgaagcgccctgggaggcaggctggccactctaggcagaagctgcctgctcccctcagggactcctaggaactctattcttaggacgctttctcttgctttttactttgacatcttccagaagttaccccgcacaaaagcaaccctgccgtggctgtaatttacacgtcacatcacttgcgctgagcacagtccacccmcttcaacccactcccgcacgcataccttcccctcctgccctgaaaaaacggcttctgcatcatcccagccatcctccttccacttgttcaccaggagagaagtgaaatgtgaaattgacaggagaaggggaggtgggaggggcatgtggatggggaacttgagtgaaatccgagctttggaacttccccgtttccaggttgggcatcacttctgcttggcggtccacatcgccatggcaacagcccagccaaatgccccagctcgcagcccaccctgagggcgcccctcgggagccactt

SEQ ID NO: 182509 - DNA, 601 bp, Human
attttgtgacaatttgaagatggggactgtaccctctggaactctgcacctgagcctgcccacaccccctacccaccagctccatcaactccaccggtaacagggaggctgctgctaccccacagtccaagcaggctgagtcgttctgcccagcccttggagacaccgtccatcagcacagggcactccaaaggagctcatgacacaaggaacccaagccagctccagaaggggcactgtggtaaggacatagatttcaaatcctgatacttcccagctgggtgaccgtgagcaaggtgcrgctctgtgcctcagtttcctcatctgtaaacagggtgatgagtgtgcacagagcacttactatatgcaggctctgttctaagtgctttccatggatggacccatttagtccctacaccatccctaaggcagagaccacccactaccccccatttccccacttgacagttattgactgagacgggaagaagtcaagaaacttgccccaggctgttgcactgtcattaatataaccgacactctggcctcagagtccacgttcatcatcgttatactatattgattccacgactgacacttc

SEQ ID NO: 182510 - DNA, 601 bp, Human
ttctagaattcaaatatgtctcccactccgacctccccccctttctcctccccctcctttttatgtatttcagaagactctggagagctcctgctgtgccccagcattctggggcattttgtgacaatttgaagatggggactgtaccctctggaactctgcacctgagcctgcccacaccccctacccaccagctccatcaactccaccggtaacagggaggctgctgctaccccacagtccaagcaggctgagtcgttctgcccagcccttggagacaccgtccatcagcacagggcaytccaaaggagctcatgacacaaggaacccaagccagctccagaaggggcactgtggtaaggacatagatttcaaatcctgatacttcccagctgggtgaccgtgagcaaggtgcggctctgtgcctcagtttcctcatctgtaaacagggtgatgagtgtgcacagagcacttactatatgcaggctctgttctaagtgctttccatggatggacccatttagtccctacaccatccctaaggcagagaccacccactaccccccatttccccacttgacagttattgactgagacggga

SEQ ID NO: 182511 - DNA, 601 bp, Human
agggaaggcagggatgggcgaggtgtgctgcccatcaggggcccaacaagggccgccatcagccccctccggccacacccgaagccctggctgtaagatggactccagcaggtgccccaccctgtggcctgggcaccatcactaagcgcctttaaggcaaccctccacgacataacactctgcttttcactttgcatttttgtttttcttctagaattcaaatatgtctcccactccgacctccccccctttctcctccccctcctttttatgtatttcagaagactctggagagctcctrctgtgccccagcattctggggcattttgtgacaatttgaagatggggactgtaccctctggaactctgcacctgagcctgcccacaccccctacccaccagctccatcaactccaccggtaacagggaggctgctgctaccccacagtccaagcaggctgagtcgttctgcccagcccttggagacaccgtccatcagcacagggcactccaaaggagctcatgacacaaggaacccaagccagctccagaaggggcactgtggtaaggacatagatttcaaatcctgatacttcccagc

SEQ ID NO: 182512 - DNA, 601 bp, Human
tcacgccccagcctcctgagacctgagccatccctttccccctgagcatctccttcttgggaaaccatgaactctggaggatcagaacccagaggaagaggctgggcatgggagagcggtgttgtgtggaagggaaaaggcaccaaggcctggagacctgtgggccaaggccaggtggtacaccgggaagtgtcctgggccggcagccaggagacctgggttcaagtcctgggctctgctcctcacttgttttgtgacctctggccagtcgctcctttgctcagtttctctggcaaaaaarttctccaaggcatgagtgtttacttaaaacctctggggaacactggctcaaatgcagattttccagtctggccccagagaaaacaactgaaggtctggggtgccatccaggaatctgcattttaaaaaaggtcttggaggcttgagaatacaatttgcagactccctcatgagaagcaatgatatggctcagcaggaagcgacagggaaggcagggatgggcgaggtgtgctgcccatcaggggcccaacaagggccgccatcagccccctccggccacacccgaagccctggctgtaag

SEQ ID NO: 182513 - DNA, 601 bp, Human
ggaagttcacgccccagcctcctgagacctgagccatccctttccccctgagcatctccttcttgggaaaccatgaactctggaggatcagaacccagaggaagaggctgggcatgggagagcggtgttgtgtggaagggaaaaggcaccaaggcctggagacctgtgggccaaggccaggtggtacaccgggaagtgtcctgggccggcagccaggagacctgggttcaagtcctgggctctgctcctcacttgttttgtgacctctggccagtcgctcctttgctcagtttctctggcaaaaaaattctccaaggcatgagtgtttacttaaaacctctggggaacactggctcaaatgcagattttccagtctggccccagagaaaacaactgaaggtctggggtgccatccaggaatctgcattttaaaaaaggtcttggaggcttgagaatacaatttgcagactccctcatgagaagcaatgatatggctcagcaggaagcgacagggaaggcagggatgggcgaggtgtgctgcccatcaggggcccaacaagggccgccatcagccccctccggccacacccgaagccctggc

SEQ ID NO: 182514 - DNA, 601 bp, Human
gaaaaggaagttcacgccccagcctcctgagacctgagccatccctttccccctgagcatctccttcttgggaaaccatgaactctggaggatcagaacccagaggaagaggctgggcatgggagagcggtgttgtgtggaagggaaaaggcaccaaggcctggagacctgtgggccaaggccaggtggtacaccgggaagtgtcctgggccggcagccaggagacctgggttcaagtcctgggctctgctcctcacttgttttgtgacctctggccagtcgctcctttgctcagtttctytggcaaaaaaattctccaaggcatgagtgtttacttaaaacctctggggaacactggctcaaatgcagattttccagtctggccccagagaaaacaactgaaggtctggggtgccatccaggaatctgcattttaaaaaaggtcttggaggcttgagaatacaatttgcagactccctcatgagaagcaatgatatggctcagcaggaagcgacagggaaggcagggatgggcgaggtgtgctgcccatcaggggcccaacaagggccgccatcagccccctccggccacacccgaagcc

SEQ ID NO: 182515 - DNA, 601 bp, Human
ctggggaaaaaggagcgtcagaatccagctccattctttctctggatccaccaccctttgctgcccaggcctggaaatttctgctctgcgggatcagacggcacgggaagcggctcacctcatccctacacaccacagaaaaggaagttcacgccccagcctcctgagacctgagccatccctttccccctgagcatctccttcttgggaaaccatgaactctggaggatcagaacccagaggaagaggctgggcatgggagagcggtgttgtgtggaagggaaaaggcaccaaggcctgragacctgtgggccaaggccaggtggtacaccgggaagtgtcctgggccggcagccaggagacctgggttcaagtcctgggctctgctcctcacttgttttgtgacctctggccagtcgctcctttgctcagtttctctggcaaaaaaattctccaaggcatgagtgtttacttaaaacctctggggaacactggctcaaatgcagattttccagtctggccccagagaaaacaactgaaggtctggggtgccatccaggaatctgcattttaaaaaaggtcttggaggcttgagaataca

SEQ ID NO: 182516 - DNA, 601 bp, Human
actccacctgccagccccacaccagggacagcggaaacaagacccagcaaggctgccagcccctgcccgttgctgtcagggggcccatgtgtctgtcccctgaaaacccatagcctggggaaaaaggagcgtcagaatccagctccattctttctctggatccaccaccctttgctgcccaggcctggaaatttctgctctgcgggatcagacggcacgggaagcggctcacctcatccctacacaccacagaaaaggaagttcacgccccagcctcctgagacctgagccatccctttcsccctgagcatctccttcttgggaaaccatgaactctggaggatcagaacccagaggaagaggctgggcatgggagagcggtgttgtgtggaagggaaaaggcaccaaggcctggagacctgtgggccaaggccaggtggtacaccgggaagtgtcctgggccggcagccaggagacctgggttcaagtcctgggctctgctcctcacttgttttgtgacctctggccagtcgctcctttgctcagtttctctggcaaaaaaattctccaaggcatgagtgtttacttaaaacctctgggg

SEQ ID NO: 182517 - DNA, 601 bp, Human
tgaaaccctctagattcagacgcgttcatgctcctgccaagggctgtgagctgccatgagcacccgtcactcccaatcaaacagcacactccacctgccagccccacaccagggacagcggaaacaagacccagcaaggctgccagcccctgcccgttgctgtcagggggcccatgtgtctgtcccctgaaaacccatagcctggggaaaaaggagcgtcagaatccagctccattctttctctggatccaccaccctttgctgcccaggcctggaaatttctgctctgcgggatcagacrgcacgggaagcggctcacctcatccctacacaccacagaaaaggaagttcacgccccagcctcctgagacctgagccatccctttccccctgagcatctccttcttgggaaaccatgaactctggaggatcagaacccagaggaagaggctgggcatgggagagcggtgttgtgtggaagggaaaaggcaccaaggcctggagacctgtgggccaaggccaggtggtacaccgggaagtgtcctgggccggcagccaggagacctgggttcaagtcctgggctctgctcctcacttgttt

SEQ ID NO: 182518 - DNA, 601 bp, Human
cagcaggagcctgtggggaacagaggccacaggcttcttgcacggcctgtttgaccaccttgcctgcagcagagaagggaaaatggtttgacaactgagggttcaagtccaacaggctctgaattttctcccagaggaaagctgatctgggagggtatgggagaggaacaagccagccccggagctctgtggaacagagaagaagagtagacaggaccccaagggttcacctccagcccctaccccgggttctgtggctacgctgggaagccctgaagctgaggaccacaggtgtccccarattcctctttccaggtgagagtgtggccgggtggctttgctgtcatcttttctgaaaccctctagattcagacgcgttcatgctcctgccaagggctgtgagctgccatgagcacccgtcactcccaatcaaacagcacactccacctgccagccccacaccagggacagcggaaacaagacccagcaaggctgccagcccctgcccgttgctgtcagggggcccatgtgtctgtcccctgaaaacccatagcctggggaaaaaggagcgtcagaatccagctccattctttctctggat

SEQ ID NO: 182519 - DNA, 601 bp, Human
atgtgccaggtccccaccaaaggcaggggctcaaaaaggaagggtgctcaagagggagccagagaggggcacgcctccccgtgtgtactgctcagggcaagttccagcaggcagtcccaccctcacttcccccgagaccagtgtcctcaacaaagccgcgtcttcgctcttgcaccaactctgttttctccaaccctcaggtaaatggagtgacacccccatccctccccagctgctggggtccactgtgcagctggggttcctgcagggcttttccgcacaggagcagccagaagcacawgggctgcctcccagaagctctctgaggggtacgcagtgggacacagcagccagaaaaccacctggctgaggtgtgagagccactgaacacacgtgtgaccaagggggctgacatacggaggccccaaggcatgcccctcccctaagtcctggcccagcaggagcctgtggggaacagaggccacaggcttcttgcacggcctgtttgaccaccttgcctgcagcagagaagggaaaatggtttgacaactgagggttcaagtccaacaggctctgaattttctcccagaggaaagctgat

SEQ ID NO: 182520 - DNA, 601 bp, Human
tctgaacccacgcaagccggcttcagtctaggctcttagcctctgtcacactacctttccaacacactgaggtataaatgtgccaggtccccaccaaaggcaggggctcaaaaaggaagggtgctcaagagggagccagagaggggcacgcctccccgtgtgtactgctcagggcaagttccagcaggcagtcccaccctcacttcccccgagaccagtgtcctcaacaaagccgcgtcttcgctcttgcaccaactctgttttctccaaccctcaggtaaatggagtgacacccccatcsctccccagctgctggggtccactgtgcagctggggttcctgcagggcttttccgcacaggagcagccagaagcacatgggctgcctcccagaagctctctgaggggtacgcagtgggacacagcagccagaaaaccacctggctgaggtgtgagagccactgaacacacgtgtgaccaagggggctgacatacggaggccccaaggcatgcccctcccctaagtcctggcccagcaggagcctgtggggaacagaggccacaggcttcttgcacggcctgtttgaccaccttgcctgcag

SEQ ID NO: 182521 - DNA, 601 bp, Human
ttatttaatgtttctcctccttgccagacagcctgttctacaaggggatggggaccatcttttccctgccatttccctcctgactggtgcagtgttgggtacatagtgggtgctcaggagatgtttcttggtgcagtggccggaggctaggaatgtaaggcatcatctctgctctcaacagttccgtaaataagtcactgtaattctttgggataaacctgccagtggagtaagcctgaggtgctgaggttactggaaggactgagggtccaggggaggaatcttagatttaggtaataayagtagggcccaggcagacagaggggtgggaaggtgagaagggtactgcaggaagggaaaggactcaggatgagaggatatgccctacaggtggggaccgcgttgctcggtttggctgagctgtgtcccactgcgtacccctcagagagcttctgggaggcagcccttgtgcttctggctgctcctgagtcagggagtagacaagactgagctgagagggggtcttgcaggggtgccaaggtctgtcctgaaggcagcaggacagcgggggccacagaagcaccctgcaggagagtaacaa

SEQ ID NO: 182522 - DNA, 601 bp, Human
gtggctcatgcctgtaatcccagcactttgggaggccgagatgggtggatcacctgaggtcgggagttggagaccagcctgacccacatggagaaaccccatctctactaaaaatacaaaattagccaggcttggtggcgcatgcctataatcccagctacttgggaaggctgaggcaggagaatcgcttgaacctgggaggtggcggttgcggtgagccaagattgcgccattgcatcattccagcctgggcaacaagagcaaaactctgtctcaaaaaaaaaaaaaaaaaaaaaaaaamcaagaagaaaggactttcccatgtcaggaagaggcttggccaaaacgtggggcaggcaggaggagaaatgggtcttggccagtcttgttccccccagaatcttcctgagttgacttaccctcagagtgaggatgccaccgtgcaccccagcaggcctgtgcagacagactgctagccggaagaggagacggtaccaaggacagccccttcaatgatgcatcctggctggctccaagccaaccacctaaaaggccatggaagtcctgaggaggactgagacccacctaagtaccactcagt

SEQ ID NO: 182523 - DNA, 601 bp, Human
gactgtgtctcaaaaaaaaaaaaggtgcacagcttcctgaactctaaaaaattagcactgtgatggattaaaaaaacaaaggctagatgaagatcagctgaggctggggagttttctcccaggcctcagcagcctcagtgagagaagggagggccagttcttgaggccagcagcagaaagccccaagccttggtttcgggccgagtccccaaggtgtgtccagagacaagtctccttccttcctgtgcctccacaacccactgccaagcaggcaatcatgaaaacaagggacgggtttcamaagtgcacagattccttattttgtattccaattattcttatttcaacaaatcacagtcatcacagtccatctttatgttactgaataatgcagtccatgaaaatttcaatcaaatttaatgataaattaactatgacattaaagtaaattgagcattaagaatgatggaacgagtagagttgtgggtactcagaggcgggtctgaatgcttctggagtggcctgccctgcgggcatctctcccctttccatcgtctttcctcactcaaactgctcttggccttgccctcttgtcggggaa

SEQ ID NO: 182524 - DNA, 601 bp, Human
aggcaggcggaccacctgaggttgagagttcgagaccagcctgaccaacagggagaaaccccgtctctactaaaaatacaaaattagctgggcgtagtggcgcatgcgtgtaatcccagctagtcgggaggctgagggaggagaaccacttggacccgggaggcagaggttgcagtgagccgagatggcaccattgctctccagccttgcagtgagctgagatcatgccattgtacgaacgaaactatgtctcaaaaaaaaaaaaaagaaaatttaacaaggaaaatgtgccaggatatawggttaggtgaaggttaaaaacaaaaaaaaaaaaaaagcaagcagagtattatagttccttttcaaaaaggaagacaagaccagcccctcctcttcctcctcctgcttcgcccattcaatgtgaagatgttgaggatgaagaccttgaggatgacccacttccacttaaagaatagtaattatatttttcttgtttataattgtcttaacattttattttctctagcttactttactgtaagaatacagtgtataatacacataaacatgcaaaatatgtgttcatgtcagtaaggcttct

SEQ ID NO: 182525 - DNA, 601 bp, Human; identical to SEQ ID NO: 28260

SEQ ID NO: 182526 - DNA, 601 bp, Human; identical to SEQ ID NO: 28261

SEQ ID NO: 182527 - DNA, 601 bp, Human; identical to SEQ ID NO: 28262

SEQ ID NO: 182528 - DNA, 601 bp, Human; identical to SEQ ID NO: 28263

SEQ ID NO: 182529 - DNA, 601 bp, Human; identical to SEQ ID NO: 28264

SEQ ID NO: 182530 - DNA, 601 bp, Human; identical to SEQ ID NO: 28265

SEQ ID NO: 182531 - DNA, 601 bp, Human; identical to SEQ ID NO: 28266

SEQ ID NO: 182532 - DNA, 601 bp, Human; identical to SEQ ID NO: 28267

SEQ ID NO: 182533 - DNA, 601 bp, Human; identical to SEQ ID NO: 28268

SEQ ID NO: 182534 - DNA, 601 bp, Human; identical to SEQ ID NO: 28269

SEQ ID NO: 182535 - DNA, 601 bp, Human; identical to SEQ ID NO: 28270

SEQ ID NO: 182536 - DNA, 601 bp, Human; identical to SEQ ID NO: 28271

SEQ ID NO: 182537 - DNA, 601 bp, Human; identical to SEQ ID NO: 28272

SEQ ID NO: 182538 - DNA, 601 bp, Human; identical to SEQ ID NO: 28273

SEQ ID NO: 182539 - DNA, 601 bp, Human; identical to SEQ ID NO: 28274

SEQ ID NO: 182540 - DNA, 601 bp, Human; identical to SEQ ID NO: 28275

SEQ ID NO: 182541 - DNA, 601 bp, Human; identical to SEQ ID NO: 28276

SEQ ID NO: 182542 - DNA, 601 bp, Human; identical to SEQ ID NO: 28277

SEQ ID NO: 182543 - DNA, 601 bp, Human; identical to SEQ ID NO: 28278

SEQ ID NO: 182544 - DNA, 601 bp, Human; identical to SEQ ID NO: 28279

SEQ ID NO: 182545 - DNA, 601 bp, Human; identical to SEQ ID NO: 28280

SEQ ID NO: 182546 - DNA, 601 bp, Human; identical to SEQ ID NO: 28281

SEQ ID NO: 182547 - DNA, 601 bp, Human; identical to SEQ ID NO: 28282

SEQ ID NO: 182548 - DNA, 601 bp, Human; identical to SEQ ID NO: 28283

SEQ ID NO: 182549 - DNA, 601 bp, Human; identical to SEQ ID NO: 28284

SEQ ID NO: 182550 - DNA, 601 bp, Human; identical to SEQ ID NO: 28285

SEQ ID NO: 182551 - DNA, 601 bp, Human; identical to SEQ ID NO: 28286

SEQ ID NO: 182552 - DNA, 601 bp, Human; identical to SEQ ID NO: 28287

SEQ ID NO: 182553 - DNA, 601 bp, Human; identical to SEQ ID NO: 28288

SEQ ID NO: 182554 - DNA, 601 bp, Human; identical to SEQ ID NO: 28289

SEQ ID NO: 182555 - DNA, 601 bp, Human; identical to SEQ ID NO: 28290

SEQ ID NO: 182556 - DNA, 601 bp, Human; identical to SEQ ID NO: 28291

SEQ ID NO: 182557 - DNA, 601 bp, Human; identical to SEQ ID NO: 28292

SEQ ID NO: 182558 - DNA, 601 bp, Human; identical to SEQ ID NO: 28293

SEQ ID NO: 182559 - DNA, 601 bp, Human; identical to SEQ ID NO: 28294

SEQ ID NO: 182560 - DNA, 601 bp, Human; identical to SEQ ID NO: 28295

SEQ ID NO: 182561 - DNA, 601 bp, Human; identical to SEQ ID NO: 28296

SEQ ID NO: 182562 - DNA, 601 bp, Human; identical to SEQ ID NO: 28297

SEQ ID NO: 182563 - DNA, 601 bp, Human; identical to SEQ ID NO: 28298

SEQ ID NO: 182564 - DNA, 601 bp, Human; identical to SEQ ID NO: 28299

SEQ ID NO: 182565 - DNA, 601 bp, Human; identical to SEQ ID NO: 28300

SEQ ID NO: 182566 - DNA, 601 bp, Human; identical to SEQ ID NO: 28301

SEQ ID NO: 182567 - DNA, 601 bp, Human; identical to SEQ ID NO: 33347

SEQ ID NO: 182568 - DNA, 601 bp, Human; identical to SEQ ID NO: 33348

SEQ ID NO: 182569 - DNA, 601 bp, Human; identical to SEQ ID NO: 33349

SEQ ID NO: 182570 - DNA, 601 bp, Human; identical to SEQ ID NO: 33350

SEQ ID NO: 182571 - DNA, 601 bp, Human; identical to SEQ ID NO: 33351

SEQ ID NO: 182572 - DNA, 601 bp, Human; identical to SEQ ID NO: 33352

SEQ ID NO: 182573 - DNA, 601 bp, Human; identical to SEQ ID NO: 33353

SEQ ID NO: 182574 - DNA, 601 bp, Human; identical to SEQ ID NO: 33354

SEQ ID NO: 182575 - DNA, 601 bp, Human; identical to SEQ ID NO: 33355

SEQ ID NO: 182576 - DNA, 601 bp, Human; identical to SEQ ID NO: 33356

SEQ ID NO: 182577 - DNA, 601 bp, Human; identical to SEQ ID NO: 33357

SEQ ID NO: 182578 - DNA, 601 bp, Human; identical to SEQ ID NO: 182458

SEQ ID NO: 182579 - DNA, 601 bp, Human; identical to SEQ ID NO: 182459

SEQ ID NO: 182580 - DNA, 601 bp, Human; identical to SEQ ID NO: 182460

SEQ ID NO: 182581 - DNA, 601 bp, Human; identical to SEQ ID NO: 182461

SEQ ID NO: 182582 - DNA, 601 bp, Human; identical to SEQ ID NO: 182462

SEQ ID NO: 182583 - DNA, 601 bp, Human; identical to SEQ ID NO: 182463

SEQ ID NO: 182584 - DNA, 601 bp, Human; identical to SEQ ID NO: 182464

SEQ ID NO: 182585 - DNA, 601 bp, Human; identical to SEQ ID NO: 182465

SEQ ID NO: 182586 - DNA, 601 bp, Human; identical to SEQ ID NO: 182466

SEQ ID NO: 182587 - DNA, 601 bp, Human; identical to SEQ ID NO: 182467

SEQ ID NO: 182588 - DNA, 601 bp, Human; identical to SEQ ID NO: 182468

SEQ ID NO: 182589 - DNA, 601 bp, Human; identical to SEQ ID NO: 182469

SEQ ID NO: 182590 - DNA, 601 bp, Human; identical to SEQ ID NO: 182470

SEQ ID NO: 182591 - DNA, 601 bp, Human; identical to SEQ ID NO: 182471

SEQ ID NO: 182592 - DNA, 601 bp, Human; identical to SEQ ID NO: 182472

SEQ ID NO: 182593 - DNA, 601 bp, Human; identical to SEQ ID NO: 182473

SEQ ID NO: 182594 - DNA, 601 bp, Human; identical to SEQ ID NO: 182474

SEQ ID NO: 182595 - DNA, 601 bp, Human; identical to SEQ ID NO: 182475

SEQ ID NO: 182596 - DNA, 601 bp, Human; identical to SEQ ID NO: 182476

SEQ ID NO: 182597 - DNA, 601 bp, Human; identical to SEQ ID NO: 182477

SEQ ID NO: 182598 - DNA, 601 bp, Human; identical to SEQ ID NO: 182478

SEQ ID NO: 182599 - DNA, 601 bp, Human; identical to SEQ ID NO: 182479

SEQ ID NO: 182600 - DNA, 601 bp, Human; identical to SEQ ID NO: 182480

SEQ ID NO: 182601 - DNA, 601 bp, Human; identical to SEQ ID NO: 182481

SEQ ID NO: 182602 - DNA, 601 bp, Human; identical to SEQ ID NO: 182482

SEQ ID NO: 182603 - DNA, 601 bp, Human; identical to SEQ ID NO: 182483

SEQ ID NO: 182604 - DNA, 601 bp, Human; identical to SEQ ID NO: 182484

SEQ ID NO: 182605 - DNA, 601 bp, Human; identical to SEQ ID NO: 182485

SEQ ID NO: 182606 - DNA, 601 bp, Human; identical to SEQ ID NO: 182486

SEQ ID NO: 182607 - DNA, 601 bp, Human; identical to SEQ ID NO: 182487

SEQ ID NO: 182608 - DNA, 601 bp, Human; identical to SEQ ID NO: 182488

SEQ ID NO: 182609 - DNA, 601 bp, Human; identical to SEQ ID NO: 182489

SEQ ID NO: 182610 - DNA, 601 bp, Human; identical to SEQ ID NO: 182490

SEQ ID NO: 182611 - DNA, 601 bp, Human; identical to SEQ ID NO: 182491

SEQ ID NO: 182612 - DNA, 601 bp, Human; identical to SEQ ID NO: 182492

SEQ ID NO: 182613 - DNA, 601 bp, Human; identical to SEQ ID NO: 182493

SEQ ID NO: 182614 - DNA, 601 bp, Human; identical to SEQ ID NO: 182494

SEQ ID NO: 182615 - DNA, 601 bp, Human; identical to SEQ ID NO: 182495

SEQ ID NO: 182616 - DNA, 601 bp, Human; identical to SEQ ID NO: 182496

SEQ ID NO: 182617 - DNA, 601 bp, Human; identical to SEQ ID NO: 182497

SEQ ID NO: 182618 - DNA, 601 bp, Human; identical to SEQ ID NO: 182498

SEQ ID NO: 182619 - DNA, 601 bp, Human; identical to SEQ ID NO: 182499

SEQ ID NO: 182620 - DNA, 601 bp, Human; identical to SEQ ID NO: 182500

SEQ ID NO: 182621 - DNA, 601 bp, Human; identical to SEQ ID NO: 182501

SEQ ID NO: 182622 - DNA, 601 bp, Human; identical to SEQ ID NO: 182502

SEQ ID NO: 182623 - DNA, 601 bp, Human; identical to SEQ ID NO: 182503

SEQ ID NO: 182624 - DNA, 601 bp, Human; identical to SEQ ID NO: 182504

SEQ ID NO: 182625 - DNA, 601 bp, Human; identical to SEQ ID NO: 182505

SEQ ID NO: 182626 - DNA, 601 bp, Human; identical to SEQ ID NO: 182506

SEQ ID NO: 182627 - DNA, 601 bp, Human; identical to SEQ ID NO: 182507

SEQ ID NO: 182628 - DNA, 601 bp, Human; identical to SEQ ID NO: 182508

SEQ ID NO: 182629 - DNA, 601 bp, Human; identical to SEQ ID NO: 182509

SEQ ID NO: 182630 - DNA, 601 bp, Human; identical to SEQ ID NO: 182510

SEQ ID NO: 182631 - DNA, 601 bp, Human; identical to SEQ ID NO: 182511

SEQ ID NO: 182632 - DNA, 601 bp, Human; identical to SEQ ID NO: 182512

SEQ ID NO: 182633 - DNA, 601 bp, Human; identical to SEQ ID NO: 182513

SEQ ID NO: 182634 - DNA, 601 bp, Human; identical to SEQ ID NO: 182514

SEQ ID NO: 182635 - DNA, 601 bp, Human; identical to SEQ ID NO: 182515

SEQ ID NO: 182636 - DNA, 601 bp, Human; identical to SEQ ID NO: 182516

SEQ ID NO: 182637 - DNA, 601 bp, Human; identical to SEQ ID NO: 182517

SEQ ID NO: 182638 - DNA, 601 bp, Human; identical to SEQ ID NO: 182518

SEQ ID NO: 182639 - DNA, 601 bp, Human; identical to SEQ ID NO: 182519

SEQ ID NO: 182640 - DNA, 601 bp, Human; identical to SEQ ID NO: 182520

SEQ ID NO: 182641 - DNA, 601 bp, Human; identical to SEQ ID NO: 182521

SEQ ID NO: 182642 - DNA, 601 bp, Human; identical to SEQ ID NO: 182522

SEQ ID NO: 182643 - DNA, 601 bp, Human; identical to SEQ ID NO: 182523

SEQ ID NO: 182644 - DNA, 601 bp, Human; identical to SEQ ID NO: 182524

SEQ ID NO: 182645 - DNA, 601 bp, Human; identical to SEQ ID NO: 28260

SEQ ID NO: 182646 - DNA, 601 bp, Human; identical to SEQ ID NO: 28261

SEQ ID NO: 182647 - DNA, 601 bp, Human; identical to SEQ ID NO: 28262

SEQ ID NO: 182648 - DNA, 601 bp, Human; identical to SEQ ID NO: 28263

SEQ ID NO: 182649 - DNA, 601 bp, Human; identical to SEQ ID NO: 28264

SEQ ID NO: 182650 - DNA, 601 bp, Human; identical to SEQ ID NO: 28265

SEQ ID NO: 182651 - DNA, 601 bp, Human; identical to SEQ ID NO: 28266

SEQ ID NO: 182652 - DNA, 601 bp, Human; identical to SEQ ID NO: 28267

SEQ ID NO: 182653 - DNA, 601 bp, Human; identical to SEQ ID NO: 28268

SEQ ID NO: 182654 - DNA, 601 bp, Human; identical to SEQ ID NO: 28269

SEQ ID NO: 182655 - DNA, 601 bp, Human; identical to SEQ ID NO: 28270

SEQ ID NO: 182656 - DNA, 601 bp, Human; identical to SEQ ID NO: 28271

SEQ ID NO: 182657 - DNA, 601 bp, Human; identical to SEQ ID NO: 28272

SEQ ID NO: 182658 - DNA, 601 bp, Human; identical to SEQ ID NO: 28273

SEQ ID NO: 182659 - DNA, 601 bp, Human; identical to SEQ ID NO: 28274

SEQ ID NO: 182660 - DNA, 601 bp, Human; identical to SEQ ID NO: 28275

SEQ ID NO: 182661 - DNA, 601 bp, Human; identical to SEQ ID NO: 28276

SEQ ID NO: 182662 - DNA, 601 bp, Human; identical to SEQ ID NO: 28277

SEQ ID NO: 182663 - DNA, 601 bp, Human; identical to SEQ ID NO: 28278

SEQ ID NO: 182664 - DNA, 601 bp, Human; identical to SEQ ID NO: 28279

SEQ ID NO: 182665 - DNA, 601 bp, Human; identical to SEQ ID NO: 28280

SEQ ID NO: 182666 - DNA, 601 bp, Human; identical to SEQ ID NO: 28281

SEQ ID NO: 182667 - DNA, 601 bp, Human; identical to SEQ ID NO: 28282

SEQ ID NO: 182668 - DNA, 601 bp, Human; identical to SEQ ID NO: 28283

SEQ ID NO: 182669 - DNA, 601 bp, Human; identical to SEQ ID NO: 28284

SEQ ID NO: 182670 - DNA, 601 bp, Human; identical to SEQ ID NO: 28285

SEQ ID NO: 182671 - DNA, 601 bp, Human; identical to SEQ ID NO: 28286

SEQ ID NO: 182672 - DNA, 601 bp, Human; identical to SEQ ID NO: 28287

SEQ ID NO: 182673 - DNA, 601 bp, Human; identical to SEQ ID NO: 28288

SEQ ID NO: 182674 - DNA, 601 bp, Human; identical to SEQ ID NO: 28289

SEQ ID NO: 182675 - DNA, 601 bp, Human; identical to SEQ ID NO: 28290

SEQ ID NO: 182676 - DNA, 601 bp, Human; identical to SEQ ID NO: 28291

SEQ ID NO: 182677 - DNA, 601 bp, Human; identical to SEQ ID NO: 28292

SEQ ID NO: 182678 - DNA, 601 bp, Human; identical to SEQ ID NO: 28293

SEQ ID NO: 182679 - DNA, 601 bp, Human; identical to SEQ ID NO: 28294

SEQ ID NO: 182680 - DNA, 601 bp, Human; identical to SEQ ID NO: 28295

SEQ ID NO: 182681 - DNA, 601 bp, Human; identical to SEQ ID NO: 28296

SEQ ID NO: 182682 - DNA, 601 bp, Human; identical to SEQ ID NO: 28297

SEQ ID NO: 182683 - DNA, 601 bp, Human; identical to SEQ ID NO: 28298

SEQ ID NO: 182684 - DNA, 601 bp, Human; identical to SEQ ID NO: 28299

SEQ ID NO: 182685 - DNA, 601 bp, Human; identical to SEQ ID NO: 28300

SEQ ID NO: 182686 - DNA, 601 bp, Human; identical to SEQ ID NO: 28301

SEQ ID NO: 182687 - DNA, 601 bp, Human; identical to SEQ ID NO: 33347

SEQ ID NO: 182688 - DNA, 601 bp, Human; identical to SEQ ID NO: 33348

SEQ ID NO: 182689 - DNA, 601 bp, Human; identical to SEQ ID NO: 33349

SEQ ID NO: 182690 - DNA, 601 bp, Human; identical to SEQ ID NO: 33350

SEQ ID NO: 182691 - DNA, 601 bp, Human; identical to SEQ ID NO: 33351

SEQ ID NO: 182692 - DNA, 601 bp, Human; identical to SEQ ID NO: 33352

SEQ ID NO: 182693 - DNA, 601 bp, Human; identical to SEQ ID NO: 33353

SEQ ID NO: 182694 - DNA, 601 bp, Human; identical to SEQ ID NO: 33354

SEQ ID NO: 182695 - DNA, 601 bp, Human; identical to SEQ ID NO: 33355

SEQ ID NO: 182696 - DNA, 601 bp, Human; identical to SEQ ID NO: 33356

SEQ ID NO: 182697 - DNA, 601 bp, Human; identical to SEQ ID NO: 33357

SEQ ID NO: 182698 - DNA, 601 bp, Human
gctggaggtcgggagtttgagaccagcctgaccaacatggtgaaaccccgtctctactaaaaatacaaaaattagccaggcatagtggtgcacacctgtaatcccagctactcgggaggctgagacaggagaattgcttgaactcgggaggcagaggttgcagtgagccaagatcgcactattgcactccagctctgggctacagagtgagactccatctcaaaaaaataaaaaataaaaaaccaagatacaaaatggtagacctgtctagggcactcaccatgagtggagcttgcaggaytgggagttgctctgggtgagtcagtgagtgagtagtgagtgaatgtgaagaactaggacattaccgtacactactacagactttacggatacacttaggctacactaaatgcatttgaaaaataaagtaactgtgctatgacgtcactaggcagtaggaatttttcagctccattacaatcttatgggaccacagtggtctatatcgtccgttgttgacccaaacatcgtgaagccaagcataacatggctgtattaggaaacactcagattctgctccgggaagacaacgaagctgtgg

SEQ ID NO: 182699 - DNA, 601 bp, Human
ctccatggtccagccttttgctcctaggctacaaacctgtgcagcatgtgactgtcctgaatgttgcaggcagttgtcacacgatggtaagtatttgtgcatctaaacatagctaaacatagaaatcatgcagtaaaaatacagtataaagataaaaaatgggccgggcacagtggctcatgcctgtaaatcccagcactttgggaggctgaggctggcggatcgctggaggtcgggagtttgagaccagcctgaccaacatggtgaaaccccgtctctactaaaaatacaaaaattagcyaggcatagtggtgcacacctgtaatcccagctactcgggaggctgagacaggagaattgcttgaactcgggaggcagaggttgcagtgagccaagatcgcactattgcactccagctctgggctacagagtgagactccatctcaaaaaaataaaaaataaaaaaccaagatacaaaatggtagacctgtctagggcactcaccatgagtggagcttgcaggattgggagttgctctgggtgagtcagtgagtgagtagtgagtgaatgtgaagaactaggacattaccgtacactacta

SEQ ID NO: 182700 - DNA, 601 bp, Human
atactaagaaaagttttccctggatgttggaattagaggcaattgttagtctcttttgcctaggtttctaaatttcatgagttacttttatatcagataaaccattttcaagacacctacgaggttagtggaaaagtaattatggtttttgccattactttcacaacaaaggatctgacaggaggacagtatggacaggggagaaggcgtgttgggaaccatatggaagcctgtgcgcctcacagggaaactgtcaggagccggggagccacgccgcgcgtgggaagcgggggctcatgcrtggtgccatgatccgccccgcgctggggagaacatgaggactagaactcagagttcatgcccccaactttgacctctttctactttatattagaagcatattgtgtgtttagaatgaacagtgattcaacttgaatgtgtactgctgaaaatttcaaaggacattttaataaaggaacgaagaaacaaaggatggagagaaagaaaaaatgtaaatatagtcacgtgtcgctcagagacaggaatacattccgagaaacacatcttaaggcaacttctatgtgggaacatcatagagcat

SEQ ID NO: 182701 - DNA, 601 bp, Human
gactgaaaaggtatatactgatatactaagaaaagttttccctggatgttggaattagaggcaattgttagtctcttttgcctaggtttctaaatttcatgagttacttttatatcagataaaccattttcaagacacctacgaggttagtggaaaagtaattatggtttttgccattactttcacaacaaaggatctgacaggaggacagtatggacaggggagaaggcgtgttgggaaccatatggaagcctgtgcgcctcacagggaaactgtcaggagccggggagccacgccgcgmgtgggaagcgggggctcatgcgtggtgccatgatccgccccgcgctggggagaacatgaggactagaactcagagttcatgcccccaactttgacctctttctactttatattagaagcatattgtgtgtttagaatgaacagtgattcaacttgaatgtgtactgctgaaaatttcaaaggacattttaataaaggaacgaagaaacaaaggatggagagaaagaaaaaatgtaaatatagtcacgtgtcgctcagagacaggaatacattccgagaaacacatcttaaggcaacttct

SEQ ID NO: 182702 - DNA, 601 bp, Human
agaattgctcaaacccaggagggggaggttgcagtgagctgagatcacgccactgcactccagcctgggcgacaagagcaaaactctgtctgaagaaaaaaaaaaagtgttttggaagaatatgtaatgatatggaaagcactcatgataaaagagtaactgaaaaatgtatgataaaaaatcgtatgtgaatatgtcatagctttaacattatttaaaattatataggtaaaagactgaaaaggtatatactgatatactaagaaaagttttccctggatgttggaattagaggcaattkttagtctcttttgcctaggtttctaaatttcatgagttacttttatatcagataaaccattttcaagacacctacgaggttagtggaaaagtaattatggtttttgccattactttcacaacaaaggatctgacaggaggacagtatggacaggggagaaggcgtgttgggaaccatatggaagcctgtgcgcctcacagggaaactgtcaggagccggggagccacgccgcgcgtgggaagcgggggctcatgcgtggtgccatgatccgccccgcgctggggagaacatgaggactag

SEQ ID NO: 182703 - DNA, 601 bp, Human
ctgaggtcaggagttcgagaccagcctggccaacatggtgaaaccccgtctctactaaaatacaaaaattagctgggcaggtgcctgtaatcccagctactcgtgaggctgaggcaggagaattgctcaaacccaggagggggaggttgcagtgagctgagatcacgccactgcactccagcctgggcgacaagagcaaaactctgtctgaagaaaaaaaaaaagtgttttggaagaatatgtaatgatatggaaagcactcatgataaaagagtaactgaaaaatgtatgataaaaaatygtatgtgaatatgtcatagctttaacattatttaaaattatataggtaaaagactgaaaaggtatatactgatatactaagaaaagttttccctggatgttggaattagaggcaattgttagtctcttttgcctaggtttctaaatttcatgagttacttttatatcagataaaccattttcaagacacctacgaggttagtggaaaagtaattatggtttttgccattactttcacaacaaaggatctgacaggaggacagtatggacaggggagaaggcgtgttgggaaccatatgga

SEQ ID NO: 182704 - DNA, 601 bp, Human
gtctctactaacaggaatggaattagaagaataaggtaagtggcaggggcagggggactgaaaaagaataaattaaaaaaaaatcaaatgaaggaaattagaactggtataataggaaagaaatggaaacaacctaatgtccaaaaacataggaatgttcaataatttccacatttccataagccagaattccaagcagctattaaaagagttttggaagaggttgggtgcggaagctcacgcctgtaatcccagcactttgggaggccgaggcgggcagatcacctgaggtcaggagttygagaccagcctggccaacatggtgaaaccccgtctctactaaaatacaaaaattagctgggcaggtgcctgtaatcccagctactcgtgaggctgaggcaggagaattgctcaaacccaggagggggaggttgcagtgagctgagatcacgccactgcactccagcctgggcgacaagagcaaaactctgtctgaagaaaaaaaaaaagtgttttggaagaatatgtaatgatatggaaagcactcatgataaaagagtaactgaaaaatgtatgataaaaaatcgtatgtgaatatgtc

SEQ ID NO: 182705 - DNA, 601 bp, Human
acaaagttattaacatctaaacaatagtctctactaacaggaatggaattagaagaataaggtaagtggcaggggcagggggactgaaaaagaataaattaaaaaaaaatcaaatgaaggaaattagaactggtataataggaaagaaatggaaacaacctaatgtccaaaaacataggaatgttcaataatttccacatttccataagccagaattccaagcagctattaaaagagttttggaagaggttgggtgcggaagctcacgcctgtaatcccagcactttgggaggccgaggcrggcagatcacctgaggtcaggagttcgagaccagcctggccaacatggtgaaaccccgtctctactaaaatacaaaaattagctgggcaggtgcctgtaatcccagctactcgtgaggctgaggcaggagaattgctcaaacccaggagggggaggttgcagtgagctgagatcacgccactgcactccagcctgggcgacaagagcaaaactctgtctgaagaaaaaaaaaaagtgttttggaagaatatgtaatgatatggaaagcactcatgataaaagagtaactgaaaaatgtat

SEQ ID NO: 182706 - DNA, 601 bp, Human
tcatgcaaatgaaagcatgattgccaatgcacacaaagttattaacatctaaacaatagtctctactaacaggaatggaattagaagaataaggtaagtggcaggggcagggggactgaaaaagaataaattaaaaaaaaatcaaatgaaggaaattagaactggtataataggaaagaaatggaaacaacctaatgtccaaaaacataggaatgttcaataatttccacatttccataagccagaattccaagcagctattaaaagagttttggaagaggttgggtgcggaagctcacgyctgtaatcccagcactttgggaggccgaggcgggcagatcacctgaggtcaggagttcgagaccagcctggccaacatggtgaaaccccgtctctactaaaatacaaaaattagctgggcaggtgcctgtaatcccagctactcgtgaggctgaggcaggagaattgctcaaacccaggagggggaggttgcagtgagctgagatcacgccactgcactccagcctgggcgacaagagcaaaactctgtctgaagaaaaaaaaaaagtgttttggaagaatatgtaatgatatggaaagc

SEQ ID NO: 182707 - DNA, 601 bp, Human
ctttctctgcaggctgtgccaagataacaatgagagagacacatgcctgccagaatgggaggcccgagctgagcattgaggataagcccatggaccacaagctgcatgctctgctgttttatttatgatttctcctaataactgtggaagatttttgtgcatttgtcatcatgcaaatgaaagcatgattgccaatgcacacaaagttattaacatctaaacaatagtctctactaacaggaatggaattagaagaataaggtaagtggcaggggcagggggactgaaaaagaataaattaaaaaaaaatcaaatgaaggaaattagaactggtataataggaaagaaatggaaacaacctaatgtccaaaaacataggaatgttcaataatttccacatttccataagccagaattccaagcagctattaaaagagttttggaagaggttgggtgcggaagctcacgcctgtaatcccagcactttgggaggccgaggcgggcagatcacctgaggtcaggagttcgagaccagcctggccaacatggtgaaaccccgtctctactaaaatacaaaaattagctgggcaggtgcctgtaa

SEQ ID NO: 182708 - DNA, 601 bp, Human
ctccctttcctcctccttttattcaatgagtatcaatttgtaggcttctgctgggccctgcattgtttatgccactctgaagacttagtccctgtcccaggccacccagagaccccacagccaatccgagggagctttctctgcaggctgtgccaagataacaatgagagagacacatgcctgccagaatgggaggcccgagctgagcattgaggataagcccatggaccacaagctgcatgctctgctgttttatttatgatttctcctaataactgtggaagatttttgtgcatttgtmatcatgcaaatgaaagcatgattgccaatgcacacaaagttattaacatctaaacaatagtctctactaacaggaatggaattagaagaataaggtaagtggcaggggcagggggactgaaaaagaataaattaaaaaaaaatcaaatgaaggaaattagaactggtataataggaaagaaatggaaacaacctaatgtccaaaaacataggaatgttcaataatttccacatttccataagccagaattccaagcagctattaaaagagttttggaagaggttgggtgcggaagctcac

SEQ ID NO: 182709 - DNA, 601 bp, Human
ttttaactccctcagtcagtgctctgcccatgaacttgtaatctggtgaatagcagagccttctgccaccttgcacagccccagccattgatggagtctccctccctccctttcctttcttctttcttcctttctctcctcctttccttctcctccctcccttccttctctccttccccttgcttccccctctttccttcctgactcctaccttccctctctccctccctcatttccccctcctccctttcctcctccttttattcaatgagtatcaatttgtaggcttctgctgggcccygcattgtttatgccactctgaagacttagtccctgtcccaggccacccagagaccccacagccaatccgagggagctttctctgcaggctgtgccaagataacaatgagagagacacatgcctgccagaatgggaggcccgagctgagcattgaggataagcccatggaccacaagctgcatgctctgctgttttatttatgatttctcctaataactgtggaagatttttgtgcatttgtcatcatgcaaatgaaagcatgattgccaatgcacacaaagttattaacatctaaacaat

SEQ ID NO: 182710 - DNA, 601 bp, Human
aactttaaggggctggcaaccctggaaaatccacatcttacactgtacacaaaaatctactcaaaatggattaaagacttaaacataagacctcagaccgtcaaactgctggaggaaaacgtaggggaaaagcttcttggcactggtcttgacgataattttttggatatgacaccaaaagcaaaggcaacataaaccagaataaacaagcaggatagcatcacactaaagagcttctccatgtcagaggaaacaatgaacaaaatcaaaatgtaacttatggaatgggagaaaacattcrcaaaccatttgcgttctgcctccccggagacacctgtgagcaggtcaggcaggggcaataatggctgtgaaattatcctggagggaaggtcgacagctttgagaagtttcccttcagccccctggtgctggataaaggagtaaagaggccaaagccacagcccagggcagcagcgtcgctggcagcactcaaagccctgagctggacgccagtgtaggtggctcctacactcctatccatctgtgcagggccttgggcaccatgtgcaggtgtgccagctagaagctggcagtgagtgcc

SEQ ID NO: 182711 - DNA, 601 bp, Human
ttccttcactttttgaggctcaaactggatcagtcgcagaatttccttattggccagtgtcccctcaatgaattctttctctgtaagtttatctgtgcattgggaaaaaatatatacgtacataaaacagtcaggattgatagccaagtgagctgcgatgaggctgacatctagccagtatccccagtgtgaatgtatctattataagaatattgaatactcagtggccctgagtattcaatattcccccaccccagtccagatacccacctcctttcccatgacccttggagctccctgsagaccagcaaagagcggtgaatgactggcactgggggggcccccaagatgccagtcttgtgctatgtgtctcttccgattggccggtgcccctgccttgctggttattaaatacttcaataattaataactattaattgttattctattttctatagtagctcaagtttcaaggatcaagttcaggaggagcttctgggggtctgagcatagcaaaacaatctggatgtcaggcccagagtctcagctgagaagcagggaacaacatccctccagaaataggagtgagaagtgaagggcc

SEQ ID NO: 182712 - DNA, 601 bp, Human
tagcctctttccctgcatggaatataaatgactgtggtgtgtgttctggcaggaagtcttcaaaaatttcacttaatgagaaattctcagggatagtttagtttctaaattcaagcagggaggtagtgttatccccacaccactctctcccacactcgtttaagttatttagcagttgctttggcatcaaaaacataaactatctaaggatttttgagaagtacattgcggcccttttatacatggatggcaggagggtaaaatggtgcatatttaaaatttttaatttttttttttttttggtgagggtagacagtttggcagtcaaaaacctttaaaactatgtgcattctgtgacccagaaattcaaattcaaagaatttctaagaaataaagatgtgctctcaaatgttcaactatgaggattttaatcacagcatcatttacgtcagcaaacatcttaaaacaacataggcattcaacgctagaggatttaaaaactaaattatatcactttttttcatagaatgttatgtagctgttaaaaggatgctttacttcatttattatttatttcttgaaatggaaatatattcacaat

SEQ ID NO: 182713 - DNA, 601 bp, Human
gtaaaatggtgcatatttaaaatttttaatttttttttttttttggtgagggtagacagtttggcagtcaaaaacctttaaaactatgtgcattctgtgacccagaaattcaaattcaaagaatttctaagaaataaagatgtgctctcaaatgttcaactatgaggattttaatcacagcatcatttacgtcagcaaacatcttaaaacaacataggcattcaacgctagaggatttaaaaactaaattatatcactttttttcatagaatgttatgtagctgttaaaaggatgctttayttcatttattatttatttcttgaaatggaaatatattcacaatattggtcttctaatgaaacataaaaggctttgaaacaagattattccctttgaagtcacaataaaaaagaaaagaaagacaatgaatgtgtctttcattcacagagagaagaatctggaagtagatggtaatttctgagtaatgagatgataatttcaccttctcccctttttgcatagctgtgatttctatttcatctacagtgaagtgtattccttctctaacaaagaaaaacagatttatttaaagagagtcag

SEQ ID NO: 182714 - DNA, 601 bp, Human
gaagtgctgtggaaaaattactgagtcaataagtttgggaactgctggtctagtgatgaccacactagctcttcttcaaaaagtcggctgtgtgattgttgctgcactccctactggtataccagtcctacctcattcttttgggataaccttaaatctacctggccctagaaaacatttgagcttgttgccccttgtgagaagagagaaaaccttaaagccaaatgattaactgggtgatattagcccagatcatttactgaacccttcctcatcctccgtctcacaagtgagcctctgraaatgaaggacagcaagagcattaactccagccctgtgctgggggcttgtattcagagatgaaagacacctctcagtcctcaaggagcttatgggatagggaggaagatggataagtggcccaccaatgacattgcagtgtgatgggccatagggatcggtcatgcaggggaagggtgacaagctcaagactcagggagatgagtggttaagtgtggccaagggtctctaggcttgagttgggccttgaaggatgactaggagttcaccaggtgaaaatgagggcagaagcgagtgccaa

SEQ ID NO: 182715 - DNA, 601 bp, Human
aagtttgggaactgctggtctagtgatgaccacactagctcttcttcaaaaagtcggctgtgtgattgttgctgcactccctactggtataccagtcctacctcattcttttgggataaccttaaatctacctggccctagaaaacatttgagcttgttgccccttgtgagaagagagaaaaccttaaagccaaatgattaactgggtgatattagcccagatcatttactgaacccttcctcatcctccgtctcacaagtgagcctctggaaatgaaggacagcaagagcattaactccrgccctgtgctgggggcttgtattcagagatgaaagacacctctcagtcctcaaggagcttatgggatagggaggaagatggataagtggcccaccaatgacattgcagtgtgatgggccatagggatcggtcatgcaggggaagggtgacaagctcaagactcagggagatgagtggttaagtgtggccaagggtctctaggcttgagttgggccttgaaggatgactaggagttcaccaggtgaaaatgagggcagaagcgagtgccaatgggaagtgcaaggatgagaagtcatgaag

SEQ ID NO: 182716 - DNA, 601 bp, Human
tggtaacagattaagactctgtcttaaaaaaaaaaaagaaagaaagaaagaaagaaaagatcctataacctgagcagaaaaaatcatggtcacctccagagcagagaatctgtctactcagagcctttgagcctttgactttggacctgcagatacctgggcaatgcaggcttctgcaatcctctggtccttctgtcacattgttgcgtcttagtgtgatgcgtctctctttgggatctacgtagtcttagaagcatgcaactattcatgtgggaggatgcaaaagtttaggataagaatwttgcgtactcttgaaatgtcaacttcacttaaaggtttttaattttttttcatatttgtattaaagccaatatgattaggttatggagtgaatgtaaaatttgtatgtactcttaagatagaacataagatgctgaagaaatgccatttctttgctgtgggccattgtgggcacttcagtgggaaggttggagaatcatggtgtgaagtgacaacaaggccacatctgtgcttggtcactgggggtgaccatgtttttgtttgctcaggttacaggatccctccttgaggaaacgactcg

SEQ ID NO: 182717 - DNA, 601 bp, Human
ctgtgcttggtcactgggggtgaccatgtttttgtttgctcaggttacaggatccctccttgaggaaacgactcggaagtgggctcagtacaaacaggcatgtctgagagacttactcaaggaaccttctggtaagcatgtgtattagttatccgtggctgtgtaacaaattgccccaaagcttagcggctcaaaacaataactagtcacttattacttctcatagtttctgtgggtgaggaattcagacagggcacactggggatggcttgtttccgctctgtaatgtctagagtttagstggaagactcccatggcctctacacttggccggggcttccatacagcatgatggtggggtctctaagggcctgcctgaccagaggccagactgccttttatgacttggccttggaagtcatacaagatcactttggccatgttcaactggtcagacagctacaaagctctactcaggctaacagtacagaaacacagaccccatgccccactgtaaggaaacatatgaaaccacatgtatgtggatgtggccgtctttgataaaagccatctgccatggcacactcatcacctgatcata

SEQ ID NO: 182718 - DNA, 601 bp, Human
tgcctgaccagaggccagactgccttttatgacttggccttggaagtcatacaagatcactttggccatgttcaactggtcagacagctacaaagctctactcaggctaacagtacagaaacacagaccccatgccccactgtaaggaaacatatgaaaccacatgtatgtggatgtggccgtctttgataaaagccatctgccatggcacactcatcacctgatcatatgacatgattatctgctgtagattagcctgggaatctgttaaaggaatgggggtggggggcgcgggtctccyatctcccagggcattaactaaatctgaatagtaacatttctcttatccaagcatacactaagttcagaacattctagcgaatatgtaattgttgtctgcaggctgactcttcgggtgcagccacgtgcaccatgcccacctccaaaagaaaaaaagaagaaagtaccttggcccgttgcctctgagcctactgaggacaatccccggctccggctgctttcagatcattttattcagaggccttgagattgacaggacactgtgaactctccctgtctttcttcacccaaaggcagtccc

SEQ ID NO: 182719 - DNA, 601 bp, Human
gtggcgcgatctcagctcactacaacctccaactccctggttcaagagattctcctgcctcagcctcctgagtagctgggattacaggcgcccgccaccactcccagctaatttttgtatttttagcagagacggggtttcaccatgttggccaggatggtctcgatcccctgacctcgtgatccagaatcctggccattttagcctaatagggagcagatggtggggaatgatgcttggcttccaggagtcaggagcctgtaatattagaagtttgggacctagtctgaaatacttccayttgattccaggaggcccataaggtggagttttaaggttgttgcttcccattgccaaacaccagggtaaatcatcccctgagatggtccaagtatctaataatgatcattgaattagtgctcaaatggagagatatggcaaatggagagatatgactatatagtacttgtgttggttatgtgtgaccaaggaccttgatcttgatcctccgtattccgctggtcgttttgtacattcacagagtaagtgtgccctgggatctaattggtgaaggtttgatgattatttagctgattgtgga

SEQ ID NO: 182720 - DNA, 601 bp, Human
caagcatttatcttttcagttacaaacaatccaattacactccttagttatttcaaaatggacgatcaagttattattattattattattattactattatatatctattttttgagatggaatctcgctctgtcgcccaggctggagtgtggtggcgcgatctcagctcactgcaacctccgcctcccaggttcaagcgattctcctgcctcagcctcccgagtagctgtgactacaggcacccacccccaccacactcggctaatttttttgtatttttagtagagacgggatttcacygtgttagccaggatggtctcagtctcctgacctcaggtgatccacccgcctccgcctcccaaagtgctgggattacaggcgtgagcactgcgcctggccgattaagttattattgactatcatcaccagttgtgctatcaaagagtagctcttattcattctttctattttttgtacccatcatccctccccacctccactgtcccagccgcccactacccttcccagcctctggcaaccatccttctactctctatgtccatgagttcaattgttttgatttttagatcttacaaataa

SEQ ID NO: 182721 - DNA, 601 bp, Human
gctctgatgctgtttcaaggaagtaaacattacttagatacccaggataatatcccatccctaccagccccagaagcccaacctcttggttattttattctgaaagaggagagaggtgattactggttagattcctgttgccttttaccacagaccaccagcaaatacaaggacaactaaaactgttctcaggaaagataagtggttacaagctccaggcaaaacaaggtgagaaccagcttctgagagggtaagatgatagccttttgtatttaatttcagcccgataaatcatcccatygtgcaactttagtttcaatgttttgcgcctctagagcagagagagagagagtgtttagaaggaagatacatttctgggtgggagagttagtgacctattttatggaagtgttctctgatgaaatccagttggaatcatcccaagaagcatgagaatgtgagattttagggagggtggaagagataactcgctggatcggaggactctgaatgactcaggcacagtacccctgggagcagctcagtgagggaaaagagcactgggtgtggagtcaggagccccgaggtcagacccagtccc

SEQ ID NO: 182722 - DNA, 601 bp, Human
gtcactccgaggagtcaatgagaaggcactcacagggtgcgtcgcacagctgccgcttggtccgcgggagctgaagctgaatccagggaggagccccttggattccttcaagtctagaggccccaaacacctggacttctcagtagcatgtggagccgatccctacttctctgctcactgtctacctgtccctctctgctcactgtctacctgtccctttccaagagctaaaaacacagatccattccactgtaagagaaaatgaagtgttcaaaaagccacatttacaaagaagttaaaktaaagcctctttaaaaaaaaaataggttttgggcttctggaatgtgaagggagtgtgatttgcaagaggtgggaagttactcttccacccgccattctgtgcattaaatctttagaatccaaatggatccctgcagtgaagagaatgtggagaccgtggaagggcgcagaggagaacatgtgcaaatgcacagagtggaggagagtccctgtgagatgggagagaggaaggagcttggtaatatcagaagagggagcgcctggcgcctgtagtcccagctactccggaggctgaggcagg

SEQ ID NO: 182723 - DNA, 601 bp, Human
cctgctgcctggccctgctgacctcgttagcactctcccccacgttcagggttccctgcactccagcccaatgagcaactcccaggctctgcacctggtccagctcttgccactcagtaccttggctcgcacacctgcccaggaggcctcctcacaggctctggccatgctcctctgcctataaagccccttgtaattctcagctcaatcctttcctccttctagaagatttctcagacctctcccctcaactacagacctctcccctctgcctttctgaagcctctttttttttttttttggagacagagtcttgctctgttgcccaggctggagtgtgccgatcttggctcactgcaacctctgcctcctgggctcaaacaattctcctgcctcagcctcccaagtagctgggattacaggcacacatcaccataccaagctaatttgtgtatttttaatagagacagggtttcactatgttggccaggctggtctcgaacttctgacctcgtgaacctcccgccttggcctcccaaaatgctgggattacaggcgtgagccaccgcacccggcctctgaggcctcttctatacctgtg

SEQ ID NO: 182724 - DNA, 601 bp, Human
ttttttttttttttttgagacagagtctccctctgtcacccaggctagaatgcaatggcgtgatctcagctcactgcaacctctgcctcccaggttcaagcaattctcctgcctcagcctccctagtagctgggactacaggagctcgctaccatgcctagctaattttttttttttttttgtatttttagtagagacagggtttcaccatgttggccaggctggtctcgaactcctgacctcaggtgatccacccacctcgacctcccaaagtgctggggttacaggcgtgagccaccaygcctggcctgtgtggctgatattttattcagcttgctctgactgctgggttgcccacagatgtgaggggcaggactgtcagaggagtcccatctcccggtgggaggtgatggttccacaggatggaagcaggaggtgaaagtggcagtcagattctgggtacagatgaaggcagggatgacagattagctagaggacctgaggaaggctatgagagacagaaggggagggtgactctgaagtttagggccgggggattggaaggacgggtttgccatccactgaggtggtaaaataggtg

SEQ ID NO: 182725 - DNA, 601 bp, Human
tggagcagattttgaaaagaagaaaaagggtgtggtttggagtgtgttgtttgagatgtcaattagacaccctacctagcaaagctgtcaggggagtagggggctataccctttggttgtccattcattgaattcagcatatagttactgttggcccatgatatgcagggccaggactaggaaggaccaacagatttcgacttctcgtttgcaagctcagcctctaatcctccaggtggaggaccttctgggagagtctcctgggatagatgtgactgagtcacaatggcagtctgtatgsgcagagggatttttctcatcattttcacatacactttcatttaatcctttcccaaatcatggagagttggtaccaattattatccccagttcctgatgaaaacagaggaaggcttagaggttaggagagctaggcccaggacacactcatgcatggatggcgcatccggcttcagccccagtctgtcagccacgtgcccaccactttctcttctgcatggcatgagcctcaggaagagatgccccacctagcaagcatcaggagcccagattggcatctcccagctgggctgaaccttgg

SEQ ID NO: 182726 - DNA, 601 bp, Human
tcagtttcttaggagaaaacctggtacacggtcagcatggtctatgcaggcactcctgccctatccccagggtctaccacagtaactggtccgcaagtccccatggcttcccaggaaaggttttttggatgaacaaacaaatccatgcttcagacttctctccacatgtgttctttccagaatccttctgcaccatactttctcgttggactcttgctcttctccctgaggacctcctgtttgtccaacatctgctcactttccttcaaagtgcaatgcaagaggctgcacaaagcggagsaacaggtgtttggggatcagacagatatctacggccacaccttggtttctttcattccgatggtcaggccacaaacagtaatgaagcatatacgatgggttaggtttttgcaccaggcactgggaataaacaggggatagcacgtggatactgcctccagggagctcagagtcttgtgaggcatagggacagtgtgatcgttgctgggagggaagtgtcagatgcccagggtcatggaggatggggaaactgatgcagacaggggaccaggaaggctgctcaagcctagccctgcagggt

SEQ ID NO: 182727 - DNA, 601 bp, Human
gtttctttaactttggtgtatgtttgaaattttcataataaatattgaggacaaataaaaaaattctatacctgaatttaacacaaaacattaatcaatgtagtggtgcgatcaaaccttgccaagattaagacacaaaacaaacactttcacactaaggagacaaactggtccaagaaagtaggggtttccatctcaggagacatggttgcctgtagaccaagatttgtttgttctggttgtcaataccagtggtgtaggtgtgttagtaaatgttaacaacaggctccctgcttccacycctgaagaaagaaaggctaggatttgttaacacttgccaattttggtggcattaatgccccccatggccaatttcaagctaccagtgtgaccgcagaggatgcacagtagcgcagcgttagacatgtttctcctcatgcagatacaacagcaaaaataaccccagtggcactgaacacagacatgtagaaatgtaattaggaagtgatgaatttggagtatttattgcttttattctgaatataatttattcattgtaaatttacatcatttaatttttttttcttttttttttgaaacg

SEQ ID NO: 182728 - DNA, 601 bp, Human
atacaacagcaaaaataaccccagtggcactgaacacagacatgtagaaatgtaattaggaagtgatgaatttggagtatttattgcttttattctgaatataatttattcattgtaaatttacatcatttaatttttttttcttttttttttgaaacggagtttcgctcttgttgcccaagctggaatgcagtggcacgatctcggctcactgcaacctccgccttccggtttcaagcgattcttctgcctcagcctccagagtagctgggactacaggggcacgctgccacacccggcwattttttgtatttttagtggagacggggtttcaccatgttggccaggctggtctcgaatgcctgacctcgtgatctgtccgcctcagcctcccaaagtgctgggattacaggtgtgagccaccgcgcccggccatcgtttaatttttaagaatgctcatgttttgcaactggttccctgaaaatttgccaatcagttctcacaagccaggatgaccgtaccactgggtctaccagggtgacttttttcactcttgccaacaagttgagccccaggttcatgtccattagagaaggctgat

SEQ ID NO: 182729 - DNA, 601 bp, Human
tgctcaacatagcaagattccatgtctaatcttccatcagacgtgaagaaccttcaactggatactccacatcctcagggaattctgtctaaacctcttactttcctactggatttgagttaacagaatcctgtgatccttatacagttttactgtgtgagatatcacacctcttaaagggatcagaaggacacctgtagttggattagatccggtttatctcaagaatttgtctgacttttttcacatcaaagttgtgctaatggcatgccttgaattaggcaaactgtgtattttttttctcctgggcttcaaactgtttgagaacaacaacaaagtcacagttatatttgactatcacccccaaacctctgacctagtactgaggtgcacagtggcctttgcatacagtaggcacttaataaatactacatgaatggcttcacaaattctgagccaattggtctgtaggggggtccagccatcaatactagttccaaagttccccagatgattctaatatgcagccaaggttgagaaccacaagtgtgcggacacagtagcaccatccccaagtcagcaaatggggagcgctaagcaa

SEQ ID NO: 182730 - DNA, 601 bp, Human
atcacacctcttaaagggatcagaaggacacctgtagttggattagatccggtttatctcaagaatttgtctgacttttttcacatcaaagttgtgctaatggcatgccttgaattaggcaaactgtgtattttttttctcctgggcttcaaactgtttgagaacaacaacaaagtcacagttatatttgactatcacccccaaacctctgacctagtactgaggtgcacagtggcctttgcatacagtaggcacttaataaatactacatgaatggcttcacaaattctgagccaattgstctgtaggggggtccagccatcaatactagttccaaagttccccagatgattctaatatgcagccaaggttgagaaccacaagtgtgcggacacagtagcaccatccccaagtcagcaaatggggagcgctaagcaagatttgaaaactgcgctttcaaaaacaggaagtaaagatttctctcttcggaaaagtgaggacaagagcattgcctcctcccctctgcaaatggccatatttccaagaattcaaatacttaacaaaaaaaacaacttctggccatgtttacctgtgtttctaa

SEQ ID NO: 182731 - DNA, 601 bp, Human
gcatttctttgctggttctctggttcctgaagcccacttgttcgttgaaatgcaggccataagtgccatgaaattaatgtgccttggaagtcaccttcaatcgatgactggcaagatttggtatgtttctataccaactcccttggtcttggggttagttgactctgaggattccagagcttccccagtgggattaagctccagcttcccaccatggtagctggcttgataacccatgctttatttgtgctaagtgctcccttaccctaccgatgattttttcacttttttttttttttttgagccgggatctctctctctctcacccaggctggagtgcaatggtgcaatattggctcactgcaacctccacctccagggttccagtgattctcctgcctcagcctcctgagtagctgggaatacaggcgcacaccaccatgcccagctaatttttgtatttttagtagagatggggtttgccatgttggccaggttggtctcgaactcctgaactcaggtgatcctcctgcctgggcctcccaaagtgctgggattacaggcttgtgaagcaccatgcccagctgatttttttttcact

SEQ ID NO: 182732 - DNA, 601 bp, Human
gttcctgaagcccacttgttcgttgaaatgcaggccataagtgccatgaaattaatgtgccttggaagtcaccttcaatcgatgactggcaagatttggtatgtttctataccaactcccttggtcttggggttagttgactctgaggattccagagcttccccagtgggattaagctccagcttcccaccatggtagctggcttgataacccatgctttatttgtgctaagtgctcccttaccctaccgatgattttttcacttttttttttttttttgagccgggatctctctctctctcacccaggctggagtgcaatggtgcaatattggctcactgcaacctccacctccagggttccagtgattctcctgcctcagcctcctgagtagctgggaatacaggcgcacaccaccatgcccagctaatttttgtatttttagtagagatggggtttgccatgttggccaggttggtctcgaactcctgaactcaggtgatcctcctgcctgggcctcccaaagtgctgggattacaggcttgtgaagcaccatgcccagctgatttttttttcactttctatgcaagctgcctgcatt

SEQ ID NO: 182733 - DNA, 601 bp, Human
gcccacttgttcgttgaaatgcaggccataagtgccatgaaattaatgtgccttggaagtcaccttcaatcgatgactggcaagatttggtatgtttctataccaactcccttggtcttggggttagttgactctgaggattccagagcttccccagtgggattaagctccagcttcccaccatggtagctggcttgataacccatgctttatttgtgctaagtgctcccttaccctaccgatgattttttcacttttttttttttttttgagccgggatctctctctctctcacccaggstggagtgcaatggtgcaatattggctcactgcaacctccacctccagggttccagtgattctcctgcctcagcctcctgagtagctgggaatacaggcgcacaccaccatgcccagctaatttttgtatttttagtagagatggggtttgccatgttggccaggttggtctcgaactcctgaactcaggtgatcctcctgcctgggcctcccaaagtgctgggattacaggcttgtgaagcaccatgcccagctgatttttttttcactttctatgcaagctgcctgcattccaattctt

SEQ ID NO: 182734 - DNA, 601 bp, Human
ttggaagtcaccttcaatcgatgactggcaagatttggtatgtttctataccaactcccttggtcttggggttagttgactctgaggattccagagcttccccagtgggattaagctccagcttcccaccatggtagctggcttgataacccatgctttatttgtgctaagtgctcccttaccctaccgatgattttttcacttttttttttttttttgagccgggatctctctctctctcacccaggctggagtgcaatggtgcaatattggctcactgcaacctccacctccagggttycagtgattctcctgcctcagcctcctgagtagctgggaatacaggcgcacaccaccatgcccagctaatttttgtatttttagtagagatggggtttgccatgttggccaggttggtctcgaactcctgaactcaggtgatcctcctgcctgggcctcccaaagtgctgggattacaggcttgtgaagcaccatgcccagctgatttttttttcactttctatgcaagctgcctgcattccaattcttgtctcaggatctgcttcttggaaacccaaactaattaggacacagacaaaaa

SEQ ID NO: 182735 - DNA, 601 bp, Human
ggatctagatgaagtccatagagaataattctagagagaaacgtggttgggattgatctggaagagctcaaagtctacaccgagagttctgcctccagaccaccactgcaaaaaatgataacagagaaagaaaaaaacatacgacatagacattttaatctacaaaaaggaatgaagaacactagaaatagtacatataaaggtaaatttttatctcatttaaaaaatgttctaaaaagagaaataaatttagtttttaaaatcacacaaaatatattagaaatcaaaaacagtaagttgyttggaaaattccccaaatattaaaaaaaaaataacaacatacttctaaataacccataagtcaagtaaaaaagtataaaataaattagtaaatattttaactaaataaagacaaaaatacaatatgccaataattttgtgatgcaaccaaagcagtcatggagagaaatgtatagcatttgtttttttttttgtttttttttttactttaagttctgggatacatgtgcagaacgggcaggtttgttacataagtatacatgtgccatggtggtttgctgcacccatcaacccatcatct

SEQ ID NO: 182736 - DNA, 601 bp, Human
tggaagagctcaaagtctacaccgagagttctgcctccagaccaccactgcaaaaaatgataacagagaaagaaaaaaacatacgacatagacattttaatctacaaaaaggaatgaagaacactagaaatagtacatataaaggtaaatttttatctcatttaaaaaatgttctaaaaagagaaataaatttagtttttaaaatcacacaaaatatattagaaatcaaaaacagtaagttgtttggaaaattccccaaatattaaaaaaaaaataacaacatacttctaaataacccatragtcaagtaaaaaagtataaaataaattagtaaatattttaactaaataaagacaaaaatacaatatgccaataattttgtgatgcaaccaaagcagtcatggagagaaatgtatagcatttgtttttttttttgtttttttttttactttaagttctgggatacatgtgcagaacgggcaggtttgttacataagtatacatgtgccatggtggtttgctgcacccatcaacccatcatctaggttttaagccccacatgcattaggtatttgctgtaatgctctctctccccttggcc

SEQ ID NO: 182737 - DNA, 601 bp, Human
ctaggttttaagccccacatgcattaggtatttgctgtaatgctctctctccccttggccccaaccccctgacaggcccccgtgtgtgatgttcccctctctgtgtccatgtgttctcattgtttaacttccacttatgagtgaggacgtgtggtatttggttttctgttcctgtgttagtttgctgagaatgatggcttccagtttcatccatgcccctgcaaaggacatgaactcattcttttttatggctgcatagtattccatggtgtatatgtgccacattttctttatccaatcyatagcattcttatattagaaaattggaaaaatatcaagtcagtggcctaactgccatcttaagaaactaggaaaaaaacctcagcaaattaaactcaaagtaagcaaaagaaaagaattacaaagtatgaatagaatttaattaaatggaaaacggaaagacaatatgaaaataaataaataaaacccaaacttggttatttaatcttggtgttgatggttttgagtcttttccattctggtttgatttttgtgcatttttgcctggagtgtttcatagatttctccactgctgcttttt

SEQ ID NO: 182738 - DNA, 601 bp, Human
gttcctgtgttagtttgctgagaatgatggcttccagtttcatccatgcccctgcaaaggacatgaactcattcttttttatggctgcatagtattccatggtgtatatgtgccacattttctttatccaatctatagcattcttatattagaaaattggaaaaatatcaagtcagtggcctaactgccatcttaagaaactaggaaaaaaacctcagcaaattaaactcaaagtaagcaaaagaaaagaattacaaagtatgaatagaatttaattaaatggaaaacggaaagacaataygaaaataaataaataaaacccaaacttggttatttaatcttggtgttgatggttttgagtcttttccattctggtttgatttttgtgcatttttgcctggagtgtttcatagatttctccactgctgctttttcttcagtttcctcatcaaaatcatcatcttcttcaacatcatcatcttcatcatcatcatcatcttctccatcagcaggaagttttaattttttctgtggaaacttgctaccacttccaggggcagattactttccagatatacttaagagtttcacattcttctcc

SEQ ID NO: 182739 - DNA, 601 bp, Human
attagtagaggtggggtttcaccatgttggccagggtggtctcgatctcctgacgtcatgatccgcctgtctcggcctccaaagtgctgggattacaggtgtgagccaccgcgcctggccggtgataactattattactctcattttacaaatgacgaaactgaggcacagagatttacggtcacataatccagcagtccagctctgcagcctatactatgaccctctgtctttagtgatagatacacaggcataaaaggcagaggcctgttggttggagccattctttcctgagggaagkcatttggttttctcctcgcacagaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagaggtaatccccttccccactgtttacactggactccccacctgatgggtcagtactgggaatcagaaggcaggcaggtgggactagggaggggcagcgggagataagagggtttccaagactttc

SEQ ID NO: 182740 - DNA, 601 bp, Human
taagtattacaagcaatctagcgatgatttaaagtatatgaaaggatgtgcataggttataggcaaatattccaccattttatagaagggacttgagcatctgtggattttggtatccacagggggtcctagaaacaatcccccaaggatactgagggacaattgtactattttcttgaagcagcaatgctttttcacattgaaatctgcatctattgagatagtttttcctttatcctgctaatgacgcagtaacctattaaactaaccttgcattcctggaataaatccaactaggttytgacatattattttctttctcctaagttgctgtctttagttcgctaatactgtgttttgttgagtatttccttgttgccattcatgagaaagattggcttgtaatgcctttgtcaggttggggatcaaatttgtgctagcctcgtaaaacaaattagagctggtttcctctttcactattctctggaagaatgtattaaagataagtattatttcttccttaaatgtttgatagattgtgccaattaagcattttggacccagaggtttctttattggtaagttttaaactatggattaa

SEQ ID NO: 182741 - DNA, 601 bp, Human
tgttcgaatttattggcataatattgttcatgatattctctttggatctttttcaagtccattggatctgtaagagtgttctcattttcattcctgatattgattatttgtatctttgctcttttttctaccctttgatcatgttggcaacaagtttctcaactttattggacttttcaaagaataaacttttggcattgttgattatctttatctcatgttctctatttcattaacttctgcttttattatttcctcccatgtactttctttgggcttaatttgctattctttttctaayttttttttacatgatccttaaaataattgatattcagcatttttcttttttaaaaaatgcacttaaggctatacgttttattatataaggtttggtattaaccgtatgttgtaagttcatgcaatattttctttacattcagttaagaaataatttctaatttgtttcaattttttctttgatccatggattgcttagaagtctattttctaatttccaatcatatgaacattttttagttattgattttagcttaattgaactgaggttagagtactcttcagtgtttccattagggca

SEQ ID NO: 182742 - DNA, 601 bp, Human
ttatttgtatctttgctcttttttctaccctttgatcatgttggcaacaagtttctcaactttattggacttttcaaagaataaacttttggcattgttgattatctttatctcatgttctctatttcattaacttctgcttttattatttcctcccatgtactttctttgggcttaatttgctattctttttctaacttttttttacatgatccttaaaataattgatattcagcatttttcttttttaaaaaatgcacttaaggctatacgttttattatataaggtttggtattaacygtatgttgtaagttcatgcaatattttctttacattcagttaagaaataatttctaatttgtttcaattttttctttgatccatggattgcttagaagtctattttctaatttccaatcatatgaacattttttagttattgattttagcttaattgaactgaggttagagtactcttcagtgtttccattagggcagttgctgatggtgaattttctacatttttgtttgtctaaaaatgtctagaatgttaaggaggaggctggccttgaacacctacctgaagccctccttccttca

SEQ ID NO: 182743 - DNA, 601 bp, Human
gtatctttgctcttttttctaccctttgatcatgttggcaacaagtttctcaactttattggacttttcaaagaataaacttttggcattgttgattatctttatctcatgttctctatttcattaacttctgcttttattatttcctcccatgtactttctttgggcttaatttgctattctttttctaacttttttttacatgatccttaaaataattgatattcagcatttttcttttttaaaaaatgcacttaaggctatacgttttattatataaggtttggtattaaccgtatgytgtaagttcatgcaatattttctttacattcagttaagaaataatttctaatttgtttcaattttttctttgatccatggattgcttagaagtctattttctaatttccaatcatatgaacattttttagttattgattttagcttaattgaactgaggttagagtactcttcagtgtttccattagggcagttgctgatggtgaattttctacatttttgtttgtctaaaaatgtctagaatgttaaggaggaggctggccttgaacacctacctgaagccctccttccttcatatttt

SEQ ID NO: 182744 - DNA, 601 bp, Human
gctcagtccaggttctcttgcattactttgtgggtgccaattacttatggctgctggttgaaggcctctacctccacacgctgctggagcccacagtgcttcctgagaggcggctgtggcccagatacctgctgttgggttggggtgagtgacctgaccttcagcttcctttcctggggatccatcaaaatatgggagcctgatagagactttagttggacttagaaacctaactggaggttgcttctgggacatataagtcctcaaagacagggagctttgaagaggggtatgtgtgtgmacacaaatgcacacatatgcacaggggccataggcccaacagcccaatggacacattcaaaaattgagaaagtctttggtggaatctgatgatattcctcctaccctgtccccaactgtattagtctgcttggaatgtcaaaacaaaatacctgtgtagtttaaataacagacattgatttcctatggttctggagggtgggaagttcaccatggttgggttctggtgagggctcttttcctggcttgcagtcagctgccttcttcctgtattctcacatggtgaggagagtgagaaagc

SEQ ID NO: 182745 - DNA, 601 bp, Human
tttgtgggtgccaattacttatggctgctggttgaaggcctctacctccacacgctgctggagcccacagtgcttcctgagaggcggctgtggcccagatacctgctgttgggttggggtgagtgacctgaccttcagcttcctttcctggggatccatcaaaatatgggagcctgatagagactttagttggacttagaaacctaactggaggttgcttctgggacatataagtcctcaaagacagggagctttgaagaggggtatgtgtgtgcacacaaatgcacacatatgcacaggkgccataggcccaacagcccaatggacacattcaaaaattgagaaagtctttggtggaatctgatgatattcctcctaccctgtccccaactgtattagtctgcttggaatgtcaaaacaaaatacctgtgtagtttaaataacagacattgatttcctatggttctggagggtgggaagttcaccatggttgggttctggtgagggctcttttcctggcttgcagtcagctgccttcttcctgtattctcacatggtgaggagagtgagaaagcaagctctctcgtctctttttaaaagg

SEQ ID NO: 182746 - DNA, 601 bp, Human
acaagtatccagtcgctttccccctctgggccctggtttcttgggtggtaaaacaatggatgggccatgtgccaccctgggtctctccagctctcacagtccacaactccatgatgttaggtttgatgttgtaaccacctgtggttagcctcatccgctgtggtgggaggcaagcaggtttggccaaccaactcctaactacatttccctgtgttttctccccagccttccctgtgctatttgttgtaccctggggtttcgcccgtgcacacctggagaacacagggtaggtaattcaccrggtgttattctttcacgagccggtaattcccaggcatgcctaaatacaaagaatgacatcattttaccgtagaaaatatctgtcccttctcattttggccatctagaatattcttaggaatgggagataaaataatcagagatcttatagcaattagtttattaatttagttacacatgcaaattagctcaaagatgctgtataggttagctgcagccctgggtacgtaaggacaaaaatacaagagtggttactgcagtattgttcatagtgagaaaaaaaattaacaaaactaaacaa

SEQ ID NO: 182747 - DNA, 601 bp, Human
tttagaggaagaaaacacacaattaatattaacccaaaattgtgatgcagcttagaatcaagacatagatgctactctgagaccttagggaggaaggacctttaatcattgtggtccagaatatttggaatggaaagggatggccaatccagagtcaaaaattcctttagataatagggtgtgagaatgagaactgtcaaagaagctagcaggaaggggcagaaagttagcaaacactgggaagggttagcaagatcccagagggaggcggaaagtattcctgcctagacacaccaccatratcttcgcgtgcccaccaggtgctgaacactacgtgttgttctctgcccaccctgttccccaaggggttgctggatgatctgtttttgccattttatataaataatctggcatttgtggtaccatcaaagaaaaaggctagtttttataggggagtttcaatatttgtcaataatagaaggcaactctctgtttagacctgggtgtgacctggagggaaaaatggtcctagaagtggtgggaaaaccgagagtgtggacaggcctgtgtcatctctggtctatgaggtggcacgtatgct

SEQ ID NO: 182748 - DNA, 601 bp, Human
atctctggtctatgaggtggcacgtatgctgcggtatcttccctcctgtcactggacctgcagctgatagtgtgccagatgaggtctgggcacacacaccccacacatggcgtgcttagccctgccacatcctcctgccctccacagtcctctctccagccacactgcccagctggggtcctgtctggacaattccaccaacgtcccagaaacatttattaagcacttctgcataccagctccatttgtaagtgctttgtgtatgagtgtatgaactcatttaatcttcccaaccaacctrtgaagatatgccattcttaggtttattttactggtgagcacactgagatgagaaattacttgcctaaaatcatagagccagtcaatggaaactggatctcagcccaaagggtgtgatgggatgacagctggcacttttaaccgtagcactgtgcagctcaaaaactatttactgcctccagcccccacgcctgccatactgaatgctgcaggctcttttgcaccttagtaccttggttcagactctcctctggctccaactccttccctcgccatcttttccacctggtgatctgttcct

SEQ ID NO: 182749 - DNA, 601 bp, Human
tgtttgtttgtttgtttgtttgttttgttttttgttttttgtttttttgagacggagtcttgctttgtcacccaggctggaatgcagcagtgcaatcttgactcactgcaacctctgcttcctgggttcaagcgattcttgtgcctcagcctccctagtagttgggactacaggcttccaccaccacacccggctaatttttgtatttttagtagagatggggtttcaccatgttggtcaggctggtctcgaactcctgacctcaagcaatctacccacctcggcctcccagactgctggratttcaggcatgagccaccgtgtctggccccactgtagttttaaaacccctgaaatgatcctagtggctagaactactgctttgggccttgctgctttggccttctatggctggctgacccgcattctagtttcccttggtgcttcctagttgggacaagagaacatgctctatcttctcactttggataaaatgacctttacatgctgttgcttctgtgactccagtcatggtcagctctactgaaatggccactctcaccttagcttgtggtggactcctcatcttcccattcagacc

SEQ ID NO: 182750 - DNA, 601 bp, Human
ccctcccaatctgcacagctctaggattctaggactcctagaattggttctagggctccccagagagtggaatttatgtgtcccaccagacatggaagggaaaagaaaggccatgcagaaagaagtgaaagaggcaggctaggagtcaggagcctgggctctatgactgacttgtgatgtgtccttcagccaggtgagttggcctctctgggcctctgtttcttcatctatgaaatcagtcttgaactagaccagtggttttcaaccagaggagattctgacccctggggacatttggctrtgtctggagacatttttaattgtcataaattggggatggggataggaggagaatgttgctactggcatctagtgggtggaggtcagggatgctgctcaacaccctacaacacacagaaccacccccagaataaataattatcctgccccaaatattaagagtgccaacattgaaaaaccctggactagacagtagctgcacattaaaacaacctggggaggattaaaaaaatacccagcccagacttacccagactgatggaatcaaatctcctgccatgtagagcttccttagcactgg

SEQ ID NO: 182751 - DNA, 601 bp, Human
ctcggaaactggcatattcttacagcctagtctccccagccctcagtagaatattggtaaagtcttgattagtcctgctcaaggacagccttagacaataattacatcatgcaaggtcattctatccataccctgcaccctgcagttaacagacccggtgaaatggctgttttgagctaacaaattgaatgaaccatctgttgactttatgaaatcataaagtcaaaagcctgcatttgctattgttgaatcttccgtgatagcctcagaacttggcaaagttgatgcactggtaaaattygtcttcactggccttgtccctctttaggtcctctgccccaccaggaacccaggggctttctgtggcttcaggcttcccaagacatttcctcactcctgtgctctcctcttctaaagacttaaagtgtgactctccctgtactctgggttttcccaccccatcaaaacttagctttgctacaccccatcttctgctttaaatggtgataataagccagagcctaggtaacttactgaagtcttcattgttgcaaaaatgaatgaatgaatgaaaggagaaagggcttccttcctcctctcc

SEQ ID NO: 182752 - DNA, 601 bp, Human
atgttggcatggagcaggaggtggaacggagggagctggccacgaccctagacttgcctactggccttaggcaagtgccttggcccctttggcctgctttctggtgtgtaaaaatgggagtgtcactgcagactcatctcctgcttattatgaggattcaaggagtctgtagatatggttataaatatgggtggccactctaccctccctctaggaggtctagaagggtaaacatacccggttcaataatgggcagacatactatagttgctagttggagctttggtccaaacattttgcwagaaacccgtagccctggggagctggcctggcctgggctccagggagccacgctgtctctcttggcgcctccagtcgaggctccaagtggccaagcagtctctctggctcccttcccaaaggcttagcctctctcaccactctttcagggtggagcttcaaagcctgctctagtccaccctgctgggtgcactcagggaggagagttctctcaataaacaggtgccaggaaaaccagggtgccccagaaagtggacagaggctagtgtttccaggagacagaaatggtgcagttgacccc

SEQ ID NO: 182753 - DNA, 601 bp, Human
aacggagggagctggccacgaccctagacttgcctactggccttaggcaagtgccttggcccctttggcctgctttctggtgtgtaaaaatgggagtgtcactgcagactcatctcctgcttattatgaggattcaaggagtctgtagatatggttataaatatgggtggccactctaccctccctctaggaggtctagaagggtaaacatacccggttcaataatgggcagacatactatagttgctagttggagctttggtccaaacattttgctagaaacccgtagccctggggagcyggcctggcctgggctccagggagccacgctgtctctcttggcgcctccagtcgaggctccaagtggccaagcagtctctctggctcccttcccaaaggcttagcctctctcaccactctttcagggtggagcttcaaagcctgctctagtccaccctgctgggtgcactcagggaggagagttctctcaataaacaggtgccaggaaaaccagggtgccccagaaagtggacagaggctagtgtttccaggagacagaaatggtgcagttgaccccaaagggactcagagctgacacact

SEQ ID NO: 182754 - DNA, 601 bp, Human
ccactctaccctccctctaggaggtctagaagggtaaacatacccggttcaataatgggcagacatactatagttgctagttggagctttggtccaaacattttgctagaaacccgtagccctggggagctggcctggcctgggctccagggagccacgctgtctctcttggcgcctccagtcgaggctccaagtggccaagcagtctctctggctcccttcccaaaggcttagcctctctcaccactctttcagggtggagcttcaaagcctgctctagtccaccctgctgggtgcactyagggaggagagttctctcaataaacaggtgccaggaaaaccagggtgccccagaaagtggacagaggctagtgtttccaggagacagaaatggtgcagttgaccccaaagggactcagagctgacacactgctgctttgtgcccccaaagcctatcacgggccactggcaccttcgccatgcccaagacccacagcaacccctaaatagtttttcatcatagctcctcatcagcatccccggacagctggccagaagtgcagccttgtgagccctaccactgggtattctgactccataa

SEQ ID NO: 182755 - DNA, 601 bp, Human
aggagccattggtctaggaaagggtaaatcaagatactggggagaccctcatggctgagcgatgatccagggtgactgctttgtggggagaaagagcaaccctgcctgacatatgcagtctgtctggaaattccttttttcctctcccctgcccttgttcaaagaaaaagcttaagaagaagaacttggggctgggtgcagtggttcatgcctgcaatcctagcactttgggagcctaaggggaagggatcacatgaggctaggagttctagaccagcctgagccagagtgagaccctttytctttaataataataataataaaagaggtaccttggtgtgtgtctacccaaagtcctcctagggtgagatgcctcaccttggtgagtttgccaccacctgggtatagtacagggaacccatctatattcttgagtggctgagactttgggaggctgactgaccccagctgagctcacaatatatataaactagaacactgttcatttttaacgtctgtggaaggtggggatggggtagagcattcctttcttgtgcccacatgcctcccaaaatttcctaatccgcaacaccagaagatc

SEQ ID NO: 182756 - DNA, 601 bp, Human
tgagaacttttagaatgtaaccctgatctggcctccctccaggattatattttaggaaagtttaaattaaacacatttaggccctgccaaagaggcaagttgctaggagctagagaaccttctgtagtcttagcccttgtccctgggcttccaccgtcaagcaaaggaaataaaaaatggtccatctgtctggcttggagaaagagaactgagccaagtgtgaaggaggaactttggggctataaacagggtaagcaatgccctaggaatgcggacagagttcagcagaccgtcagctcarctggagttctctgttctttgtggttcccagctcagaggcagctctcttcccctagataaagggccttaactctccatgggatgcacctgggcagagctcttgattcatttataaaggagaagcatttcattttcatttttatttttttgaaatggagtttcactcttgttgcccatgctggaatgcaatggcacgatcttggctcagcacaacttccgtctcccaggttcaagtgattctcctgccccagcctctgaagtagttgggattacaggcatgagacaccatgcccggttaatt

SEQ ID NO: 182757 - DNA, 601 bp, Human
atgtgggatcagggaacaggaaaaggacattagcgggaaatccacataaaccccgaactttagttcctagtaatataccgtgttggtttcttagttttgacaaacgggcatggttatgtagtatgctaacattaggggaaactatgccgggggcggtggctcaaacctgtaatcccagcactttgggaggccgaggcgggcggatcacaaggtcaggagatcgagaccacggtgaaatcccgtctctactaaaaatacaaaaaattagctgggcacagtggcgggcgcctgtattcccagstactcgggaagctgaggcaggagaatggcatgaacccggaaggcggaggttgcagtgagccgagatcccgccactgcactccagcctgggcgacagaacgagactccgtctcaaaaaaaaaaaaaaaaaacgttagggaaaactgagtgaagagacatgggaactctctgtactgccttagctaattttctgtaaatctaaaattattccaaaattaaaagtttgttttaaaaaaccataacaccataacatggcatcagaataagctgacaagacacaggtctgcttgtaggcatataa

SEQ ID NO: 182758 - DNA, 601 bp, Human
taccaagatgtcttcttcactcacatgactggtgcctaagttggatggctcaaatagctgaggctagtcttatttgggtcaaatttctgaggcctcatttctcagtgtccatgacattccttaggcgttccatgtgttttctccttgtggtctctccacaggatagggcagttcagggctcccaagagtataaaagcaggagctgtcaggccttttttttttttttttttttgagacggagtctcgctctgtcgcccaggctggagtgcagtggcgggatctcggctcactgcaagctccscctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgctcccctgccaggccttttaaatgcctatgcctggaactggcacagtgatgcttctgctgcattctgtcatttaaagcaagtcacagacccagccta

SEQ ID NO: 182759 - DNA, 601 bp, Human
aaaagaaatgagaaggattcagtcaagaaaaattactgaaattcagtaataacagtgggagtctatgttacttttgtctgggactgcttttgttctctaatccctgctccaccagtgaggaaattctagtgaaaactagcagcttcactgaagagggaggctgacttgatttggatcaaagagcagaaaaactctcatccttgggcattgccagatacagtggccgtcttggtgacaaagaaacagggaaggacagtgttacagcctgaagttatcattctatctggggtgaaaaaacatrctgatgggctagccagaaattttacgggaagatttggggaatgagacagccacagtgggccttgacaagcccccacatatttctcaggttgactggaaggttgtgtacatgcataaggttgcatacacactcaagaaggaccagaaaggacattcacacatttctggctgaatgtgagtttctgcacacatacagaggaaacatgagggggtctggtggaaagtaaaagccagggaaggcttcaaactgaactttgaatgtgttccccaagtgacatatggatccattggcaaagggtat

SEQ ID NO: 182760 - DNA, 601 bp, Human
taaaaggtagtcctaaattagagggggaaaaaaaactctgcagctgttatgtagtaatatttggtggccttttttctccggaaggcatgggtcaggcaatgtgagcccttgatcacctgatctcactcacccaaggcccggtaaagacaagtaattcatgtggagctatgtgaggcagatttctgagaaagaatcctagactatcagactcttctgccttgggaggatgtgttggtcatctgattctgtgtaataaaccatgccaaaacttcatggcttaaaatagtaaccattttattaatattattattattattattattattattattaccattatcattatcattttgagatggagttttgctcttgttgcccaggctggagtgcaatggtgttatctcggctcaccgcaacctccacctcccaggttcaagccattctcctgcctcagcctcccgagtagctgggattgcaagcatgagccaccacacacggcctcattttaatatttttaatgattcagtagactgggctgcttgggctcagggtagatagttcttttgatacatgtgattttcggctggggctgcaaacgtct

SEQ ID NO: 182761 - DNA, 601 bp, Human
taaacaaacattagccagtgcccactatgaccaagtagagatgcaacagtgaccttgcccaatatttgtataattgaatgaatgacacaaggtcttgggggtttaatcatcattgacccatgtgcacctgtgaacaatctaagcaaacacctaggctgatataggcggagcagggcgggcggggcgctggatgtcaaagtaagaacagatgccatggaaatccaagttaatgtaaccagtatgactaattctagttagtgtaagcaatgcagttgcacgcctcttctggagactccttacracctgtgcagggctttggacgttgccagtaactctcagacacatcttctccggagtcagattttatgccatgtcctccttttgtttcaggggttcctggtggccttgcagtatggttttgccaatggagaggtatgatttccacgttgccatcctggtttcatgtgaggttgggactgcaaccctacccacctctggaggtttctgtggatgggatgatgctacgggagaatgtgcagtgaccagcatgtgtggggacaaatttgtattgtgagcttccggtacagagagcaggaggcag

SEQ ID NO: 182762 - DNA, 601 bp, Human
ttcttgacagcaaaaccatcttctgttttgctcactgctgcttcttctgtatcttcatgcagggggctcctcacctatcaagcaggtttcagctcacatgccaccccggcagagtcctttcctgaacaccctgtcttaagtttttgtttctttaccgtattgtcctgcttagtactctcacagtgtcatcaccaccagacatgtttatgtatctttgtttctccttgtctcccccagttaaaaggtaaatttcccaagggtggcacagagtagctactcaattaatatttgctaaatggayacatggctaaatgactccaagacagtaacctctcacttgtctcacccggcaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggcc

SEQ ID NO: 182763 - DNA, 601 bp, Human
aatcccagcactttgggaggtcgaggtgggtggatcacctgaggtcaagagtttgagaccagcctggccaacatggtgaaaccctgtctctactaaaaatacaaaaaattagccaaacgtggtggtaagcacccgtaattccagccactcaggaggctgaggcagaacaatcgcttgaacccgggtagcagaggctgcagtgagccgagatcatgccactgcactccagcctgggcaacagagggagactgtctccaaaaaaaaaaaaaaaagaaaagaaaagataaataagaatccaactgagtccagtccacactgcagccacataaatgatggctttaacgttatttgatgattactgccacagcaaattaacattcaagtactagacagtaggttacctattattataagaatactatcactacttctgcaaaatattagtatactttatttcctaagtaggtcgaacattttgttcaaataataagcataattcttctaaggaaaacagttaagttaaagcttacctgaacaaggatcatatttaattttccgatatacaccttttctttctaaggaaaagtaaaagattaaatga

SEQ ID NO: 182764 - DNA, 601 bp, Human
tccggccaggtgcagcggctcacacctataatcccagcactttgggaggtcgaggtgggtggatcacctgaggtcaagagtttgagaccagcctggccaacatggtgaaaccctgtctctactaaaaatacaaaaaattagccaaacgtggtggtaagcacccgtaattccagccactcaggaggctgaggcagaacaatcgcttgaacccgggtagcagaggctgcagtgagccgagatcatgccactgcactccagcctgggcaacagagggagactgtctccaaaaaaaaaaaaaaaagaaaagaaaagataaataagaatccaacagagtccagtccacactgcagccacataaatgatggctttaacgttatttgatgattactgccacagcaaattaacattcaagtactagacagtaggttacctattattataagaatactatcactacttctgcaaaatattagtatactttatttcctaagtaggtcgaacattttgttcaaataataagcataattcttctaaggaaaacagttaagttaaagcttacctgaacaaggatcatatttaattttccgatatacaccttttc

SEQ ID NO: 182765 - DNA, 601 bp, Human
tcaagagtttaagaatcaccatattattttgacagagactttcgctggtcctacttgctccaacaatatcactgataaaagttggccaatgtttgggccattcttgtttcagtatctaaaacaagacatgaaatgttaatcgcacttcatttctcaaaggcaaataaaacaaacttcaaagaaattatgtaatggataaaggcaggagtaaggataaatcacttttcattttctcctcctttattaaaggaagaaatgtgccaccctcttcaccctactgggtagaaaacaaaacacaaartcttttatcttaatcaccgcaggacccttttcaattatcctaatgaaaggtccaatccgtctaatgggtctgtctgtgtattagtatctgcctgatagatatgtagaaattattctaggaggccttgcgcggttgctcatgcctgtaatcccagcactttgtggggagccagggtgggcagatcacttgaggccaggagtctgagaacagcctggccaggctgggcgtggtagctcgtgcctgtaatcccagcactttgggaggccgaggtaggaggatcacgaggtcaggagttcaaga

SEQ ID NO: 182766 - DNA, 601 bp, Human
gtaacagtgattatctctggataaaccactgtagaactttacttattttgagacagggtctcgctctgttgcccaggctggagtgcagtggcacgatcttggctcactgcaccttctgcctcctgagtttgagattctcctgccacagcctcccgagtagctgggactacaggcatacaccaccacgcctggctgttttgtatttttagtagagaccggtttcaccaacttgcccaggctaaaccattatagaacttaagccataacatggtatcaattttaaattatcagttaaaagatraacttttcatttttcagaaatagcacttgacttacctcactgtaacttactcaaactaaaagcaatataatcaaatccattgttcaaaatgaattcataaaattacatggtctaagtggcagaatcagatttgaaactcactttaaataatttactaggtgtgaatatgggaaatttctcctgagcagcgtcctcgtgttagaaacaaggttgaataaggtttagaatgcagagatgagagctttacatgtgaaaagaatatatgtggctatccggtgacaaataactgaaatgtattca

SEQ ID NO: 182767 - DNA, 601 bp, Human
agtgaatgaacatattttatcatgcagatatactgagagggaattttattgcctacctagtatacagtaaatgctttaggagcaaactttttttgtttttttgagacagagtctcgctcgcccaggctgaaatgcaggggcttgatctcggctcactgcaacctcacctcttggattcaagcgattctcctgcctcagcctctcaaatagctgggactacacatgcatgccaccacgcccggctaatttttgtatttttagtagagacagggttttgccacgttgggccaggctggtctcratctcctgacctcgtgatccgctcacctcgacctcccaaagtgctgggattacaggcgtgagccacagcgcccggcctaaactgctttcttttgatgtgtcctaaaataacaaggctccttaacaactttcctagaatctgtgatatgacttttaggaatgttatactttctgtgtaattacacaggacctaaaacttgtgattgcttagaattttgggaaatggtcaatgtatctaagagtaataagaatatgggaaaattggcttatatattctattgttgagaagataaacagttat

SEQ ID NO: 182768 - DNA, 601 bp, Human
aaaccagacacaaaaggtcacatgcatgattccctttatatggtataatcagaatagatatatctacagagacagaaaccaaaataatggttgccagaagttggggagagaacaaaggagaaagtgactgttttaggggtaaagggtcaccttcgggtgatgaaaatgttttggatctaggtattaatggttgtataacattgtatatatactaatatgccactgaattgtgtgtgtgtgtgtatatatatatatacttatgtttatatatatatatacttaagtttatatatatatataragagagagagagagacattttcttccttcagacagagtcttgctctgtcactcaggctggagtgcagtactgtgatcttggctcactgcaacctcagcctactgggctaaagcaattcctgtgcttcagcctcctgaggagctgggattacagtcatgtgacaccacgcacagctaatttttttgtatttttaatagagacagagattcacgatgtaggccaggctggtctcgaactcctgcctcaagtgatccacccacctccgcctcccaaagtgctgggattacacgatgaattgta

SEQ ID NO: 182769 - DNA, 601 bp, Human
agaaaccagacacaaaaggtcacatgcatgattccctttatatggtataatcagaatagatatatctacagagacagaaaccaaaataatggttgccagaagttggggagagaacaaaggagaaagtgactgttttaggggtaaagggtcaccttcgggtgatgaaaatgttttggatctaggtattaatggttgtataacattgtatatatactaatatgccactgaattgtgtgtgtgtgtgtatatatatatatacttatgtttatatatatatatacttaagtttatatatatatakaaagagagagagagagacattttcttccttcagacagagtcttgctctgtcactcaggctggagtgcagtactgtgatcttggctcactgcaacctcagcctactgggctaaagcaattcctgtgcttcagcctcctgaggagctgggattacagtcatgtgacaccacgcacagctaatttttttgtatttttaatagagacagagattcacgatgtaggccaggctggtctcgaactcctgcctcaagtgatccacccacctccgcctcccaaagtgctgggattacacgatgaattg

SEQ ID NO: 182770 - DNA, 601 bp, Human
ggttacaacatggaagaacattgaaaacacaacaccaaataaaagaaaccagacacaaaaggtcacatgcatgattccctttatatggtataatcagaatagatatatctacagagacagaaaccaaaataatggttgccagaagttggggagagaacaaaggagaaagtgactgttttaggggtaaagggtcaccttcgggtgatgaaaatgttttggatctaggtattaatggttgtataacattgtatatatactaatatgccactgaattgtgtgtgtgtgtgtatatatatatattcttatgtttatatatatatatacttaagtttatatatatatataaagagagagagagagacattttcttccttcagacagagtcttgctctgtcactcaggctggagtgcagtactgtgatcttggctcactgcaacctcagcctactgggctaaagcaattcctgtgcttcagcctcctgaggagctgggattacagtcatgtgacaccacgcacagctaatttttttgtatttttaatagagacagagattcacgatgtaggccaggctggtctcgaactcctgcctcaagtgatcca

SEQ ID NO: 182771 - DNA, 601 bp, Human
ttgaccccaggaggcaaggctgcagtgagccgagattgcgccactgcactccagcatggacgacagagtgaaactccatctcaaaaaacaaacacacacacacacacacacacacacacacacacacaccccaaaacaaaacaaaacaaaaaacacctgattttgtttgttcggaataattttacataggacaacagcctaacaatcttctggtcaagaatctgtctcactatgaaaatttaaccaggctgggcgtggtggctcacacatataaaatcattttgggaggctgaggcaagcktatcgcttgaagctaggagttcaagaccagcctgggccacttggcaaaaccccatctctaccaagggggggaaaaaggttagctgagtgtgatggcagtgcatgcctgtagtcccagctacccacgaggccaaggtgggaggatcacctgagcctgggagttcaaggctgcagtgagccgtaattgtgccactgcactcaagcctgggcaacagagtaagaccctgtctcaaggaaaaaagaaagaaaatttaatcagaaacacttctattggatccaatagttgccctcctatttccat

SEQ ID NO: 182772 - DNA, 601 bp, Human
tactgtttgatctgtttgtgcaccaatcatgtaccccacagcttcataaaacgtatgaacctattttaaaaagcagacattttaacgtttatgttatacaccctaataaggaaaaccacacacaagcaattcacaaacgtcttgaaactgattttggcccaggtgcagtggatcactcctgtaatcccaatactttgagaagccaaggcaggccaatcacttgtggtcaggagttgcagaccagcctgaccaacgtggtgaaaccccatctcttctacaaatacaaagaaattagccaagsgtggtggcaggtgcctataattccagttacttgggaggtttgaattgcttgaacctgggaggcagaggttgcagtgagccgagattgcaatactgcactcgagcctgggtgacagaggaagactccacctcaaaaaacaaacaaacaaacaacccaaactggccaggcatggtggtggctcacgcctgtaatcccagcactttgggaggccgaggcgggcggatcatgaggtcaggagttggagatgagcctgaccaacatggagaaaccccgtctctactaaaaataaaaaaattagct

SEQ ID NO: 182773 - DNA, 601 bp, Human
catataagaattatccacggctgggaacagtggctcacgcctgtaatcccagcactctgagaggccgaggcgggcggatgatgagttcaggagatcgggaccatcctggataacacggtgaaaccccgtctctactaaaaatacaaaaaaaatagccaggcgtggtggcagccgcctgtagtcccacctactcgggaggttgaggcaggagaacggcgtgaacgctagagatggagtttgcagtgagccgagatcgcaccactgcactccagcctgggcgaaagagcaagactccgtctcaaaaaaaaaaaagaattatccatcataatggccaggcgaggtggctcacacctataatcccagcactttgggaggctgagtcgggtgcatcacctgaggtcgggagttcaagaccagcctgaccaacatggagaaaccctgtctctactaaaaatacaaaattagccaggcacaatggtgcttgcttgtaatcccagccacttgggaggctgaggcaggagaactgcttgagctcgggaggcagaggttgcagtgagccgagatcacgccattgcactccagcccgggcaccaagagtgaa

SEQ ID NO: 182774 - DNA, 601 bp, Human
ccccccccccacttcagcctttcgagtagttgggactaccggcacatgccaccatgactggttactttttgaactttttgtagagatgaagtctcactatattgcccaggttggtttcaaactcctgggaagtaagttcttgaaaaccaagaaagtatttccctaatatacaagtttaaatatttaaactccatggcattaaaattatgttatatccacagacatactttagctttcaagaattaaggctatcctgcagaatttcccccttacataactgaaatattacacaccttatttatcatattcaatgtgcattcaaaaacagcatcaaatatttgaggtatttcagctgttatatgtccccctaacttgttgacaattatggccatagtactaagcacttctggttctctagcagctgggacatttctctgataatcaatgagaactgcatccaacagagggggaacaaaattttcagcgacctgttggggagggaaaaaaaagttatgttttaatttaggtacatggtgactattttaaacaacaaggttattcctgtctatgagatgtagcatgatcatctactgaaaacagg

SEQ ID NO: 182775 - DNA, 601 bp, Human
actcatgatagtatttagctcttatcaaagtattctgaatctaaccctgttctcccttttttttgggatgatgactaataattacttgcataaggtttcttaaattaataatggaatacaactatatccaatgctggcttacttataaattataataagttgtgtgagagctaaactgtgaagatgtaaaggcataaagatcatataatggactttggggacttgtggggaagggcaggagtgggtgagggataagactacacataaggtggagttcatacacatgagggataagactacmcataaagtagagttcatactgctcacatgacaggtgcaccaaaatctcagaaatcaccactgaagaacttattcatgtaaccaaaaaccacctgttccccaaaaactattgaaataaaaaaagaacctcatgaatattttttaaaagcctatgggaaaaaaattacaatctaagttatgactattaccaccctttcaccatttctgaaagctcagctgattctatatgaacttctacaacatcactacccagtagaactttgtattacgcaaaccaattattactaggccgctctcccca

SEQ ID NO: 182776 - DNA, 601 bp, Human
tttagtagaaacggggtttcaccatcttggccaggctggtcttgaactcctgaccttgtgattcacccacctcagcctcccaaagtgttgggattacagtcatgagccaccgtgcgtggcctttttttttttttttttttttttgcttttttaaagaggcagggtctcactctatcacccaggctggtgtacagtggtgcgatcatagctcactgcagtcttaaactccaggatgcaaacaaccctctcgcctcagcctctccaacagctggtcctacagatgcataccacttctgactamttttttttttgtagagacgggatcttgttttgttgtctaggttggtctccaacttttgggcccaagcaatcctcccaccttaggcttcccaaagtgctgggattacaggtgtgagccactgtgcccgaccaggaacattctacgtttattaaaaggtatatttactcttgtaggtgagggaaggccgacttaaggagattagccacatattcctgaagaaagatttggttgttaactggatttccaggatttaatgatgtacttatttttccttcttcaaccaaattaaacatatatgca

SEQ ID NO: 182777 - DNA, 601 bp, Human
gagacagtcttgctctgtcacccacactggagtgcagtggcacaatctcggctcactgcaacctctgcctcctgggttcaagcagttctccccctcagcctcccaagtagctgggatttcaggcacccaccaccatgcccaactaattttttgtatttttagtagaaacggggtttcaccatcttggccaggctggtcttgaactcctgaccttgtgattcacccacctcagcctcccaaagtgttgggattacagtcatgagccaccgtgcgtggccttttttttttttttttttttttygcttttttaaagaggcagggtctcactctatcacccaggctggtgtacagtggtgcgatcatagctcactgcagtcttaaactccaggatgcaaacaaccctctcgcctcagcctctccaacagctggtcctacagatgcataccacttctgactacttttttttttgtagagacgggatcttgttttgttgtctaggttggtctccaacttttgggcccaagcaatcctcccaccttaggcttcccaaagtgctgggattacaggtgtgagccactgtgcccgaccaggaacattctac

SEQ ID NO: 182778 - DNA, 601 bp, Human
tgggggggaagattacaaaagaatcatgggccccggcatggtggctcacgcctgtaatcccaactttgggaggcagagacgggaagaatacttgatgtcaggagaccaccctggccaacatggtgaaaccctgtcattactaaaattagccatgcatggtggcacaggcgcctgtaatcccagctacttgggaggctgaggcaggagaatcacttgaacctgcatggcggaggttgcagtgagccaagatcacgccactgctctccagcctgggtgataaaagcgagactgtgcccccccaaaaaaaacaaaaaaaatggtgtgataccttacagtaaatagtcttcaatgtgattattatgcattgtatgcttctaccgaagtatctcatgcatcccatcccctaagtatatacacctactatgtattcacacaaattttgttctctttgtgatagagtcttgttctgtagccccagcacattatctcaacctcttcctccaagatgcaagcaattctcctgcctcagcctccccagcagctgggattacaggcaccaccacatctggctcattttttgtatttttactagagacgtagt

SEQ ID NO: 182779 - DNA, 601 bp, Human
cataacttcatttgagattgtcctttctatctgctgaatgcacaaaccgtctgcaggtgcccttatggctgcagcattaccagagacaaaacaaaacaggtcaaaaatgcacaacaaagacaccaatctgactcaaatggttactttgtttgacacatatcatatcacagttggtagctgcagtgcttatttgaatttaaacattgatgaggtcctttgctagctctgttttggcaaacatatgcaaagctaaatataccaaccctcattagatcaaaaaaaacacgcatagcatgtcagrcagtcattgttgttattaccaataaacaaaaatgtatgtttccctaatcacagtgctgaaatgtgctctgtgtttatggagaaagctaaagaaaaaaaaaatttttccttgttgagtctgtggactctggccctggggtgtacctgggtctcaacatctgtcagctttctggtctgctctgcagtctgagagaggaggctggttcctatctccagcatggtagccgtgtggttctgaactgcattctgctgtatctgggccatctccgacttcatgttttccacaatgtaattctcaagc

SEQ ID NO: 182780 - DNA, 601 bp, Human
ttcaagggatcctccagccttagctccgtgagtaactaggctacaggcacgcattaccatgcctggcttttttttttttttttgtagagataggatcttgctattttgcccaggctggtgtcaaactcctgggctcaagtcatttttccacctggctcttccctaaagtgctgagattttaggtgcgggccactctacctggcttgccttatatttctaatgagtgctattgaggtccaaacggcagatgtaatcatttgtgatgtctgaaaagatgattaaatgggattaaacatgcagraaatatattaggggaaatgcccacgaggaaaaattgggaggaagccagaggaggtttggagaggcttcagaccgggatggtctaattacaggaaagaggagagggaaggaagaagagttgggtggaagtcttatccctcaaggcagccgtgcaacagttccagcaaggctgatgaagagcccctagccaaagtcatgtgtcagtggacttctacagctcccaggagcaggcctacatatccctgccacaatgagtggaagtgactgctggaaattgtggtctctggaccaacacagcaat

SEQ ID NO: 182781 - DNA, 601 bp, Human
cttgaacttcctaggttcaagggatcctccagccttagctccgtgagtaactaggctacaggcacgcattaccatgcctggcttttttttttttttttgtagagataggatcttgctattttgcccaggctggtgtcaaactcctgggctcaagtcatttttccacctggctcttccctaaagtgctgagattttaggtgcgggccactctacctggcttgccttatatttctaatgagtgctattgaggtccaaacggcagatgtaatcatttgtgatgtctgaaaagatgattaaatgkgattaaacatgcaggaaatatattaggggaaatgcccacgaggaaaaattgggaggaagccagaggaggtttggagaggcttcagaccgggatggtctaattacaggaaagaggagagggaaggaagaagagttgggtggaagtcttatccctcaaggcagccgtgcaacagttccagcaaggctgatgaagagcccctagccaaagtcatgtgtcagtggacttctacagctcccaggagcaggcctacatatccctgccacaatgagtggaagtgactgctggaaattgtggtctctg

SEQ ID NO: 182782 - DNA, 601 bp, Human
accatgctggagtgcagtggtgtgatcacagctcattgtaaccttgaacttcctaggttcaagggatcctccagccttagctccgtgagtaactaggctacaggcacgcattaccatgcctggcttttttttttttttttgtagagataggatcttgctattttgcccaggctggtgtcaaactcctgggctcaagtcatttttccacctggctcttccctaaagtgctgagattttaggtgcgggccactctacctggcttgccttatatttctaatgagtgctattgaggtccaaacgkcagatgtaatcatttgtgatgtctgaaaagatgattaaatgggattaaacatgcaggaaatatattaggggaaatgcccacgaggaaaaattgggaggaagccagaggaggtttggagaggcttcagaccgggatggtctaattacaggaaagaggagagggaaggaagaagagttgggtggaagtcttatccctcaaggcagccgtgcaacagttccagcaaggctgatgaagagcccctagccaaagtcatgtgtcagtggacttctacagctcccaggagcaggcctacatatccct

SEQ ID NO: 182783 - DNA, 601 bp, Human
actgttcctgaactgcctaatacacacacacacacacacacacacacacacacacacacacacaagtgtatatatatatatatttaaagatagggtcttgctctgtcaaccatgctggagtgcagtggtgtgatcacagctcattgtaaccttgaacttcctaggttcaagggatcctccagccttagctccgtgagtaactaggctacaggcacgcattaccatgcctggcttttttttttttttttgtagagataggatcttgctattttgcccaggctggtgtcaaactcctgggctyaagtcatttttccacctggctcttccctaaagtgctgagattttaggtgcgggccactctacctggcttgccttatatttctaatgagtgctattgaggtccaaacggcagatgtaatcatttgtgatgtctgaaaagatgattaaatgggattaaacatgcaggaaatatattaggggaaatgcccacgaggaaaaattgggaggaagccagaggaggtttggagaggcttcagaccgggatggtctaattacaggaaagaggagagggaaggaagaagagttgggtggaagtcttatc

SEQ ID NO: 182784 - DNA, 601 bp, Human
ttatggaattattgttcatcttagttgtgatgtaatatataattaatattatataactattacataatattctctatttatttatatataaatatattttatttataatggtaataccctcattatatatgtatatattataacataataatataaccctatattatatttataatataataaccacttcatttggttacagaatttaatagagataagacttatattacagacagagaactgtgggtagaaataactctcccaatacagctaatgctcagtagagtcagaatgcaacccrgagagtctatctccggagtctgggttgtttcccacaggcttatcgagtagctgtaaataagcagcttccctctggttagtgacaccctctagtcactaacaactgctaccaaaatggcttctttcaagtcgccatgaggtgctctgcttgttgcagctgatggcatccaactctctctccctgcccctgccccctaaattagcatcacgagtaaggaaggagtccaaatttcttatgcttctcagagtacggaaaagaaaaacaaacaaacaaaaaaacccaaaaaaacattcactcagt

SEQ ID NO: 182785 - DNA, 601 bp, Human
aaaggagtaaagcgtatgtgaaacatgcccctcaaggaacaatttcaaagaataaattttccaaaatatacctaagagtaagagagacataaaacctgaaattgaggatttacgggctacaaaattttagttcttttttttaaaaaagtaaacatttaaaaatgaaaattattagtttccaagagaaagtgagctggaaaatttcacccagctccctttaatattttcaagagtgcctctgatcctttaaattaatattaatgctaaaagtcagagattgaggtagaaagaaaatctcttytttttagagacagagtctcactctgtcacccaggctggaatgcagtggcatgaccacagtcactgcagcctcttgggctccggtgaggtgtgcccagcaattgtttgtattttttttttttttgtaaagacagggctctgccatgttgcccaggctggtctcaaactcctgggttcaagcaatctgcccacctcagcctcctaacgtgctgggataacaggtgtgagccagcgtgcctggccaaaaatctctttcaacgactcattaactttgaaataggccctgtttttagggttatgt

SEQ ID NO: 182786 - DNA, 601 bp, Human
ataatgaaatagggaatgaaacacttgtatgttttggtgacatttagaacaaagcttggcacagagacaacactcaatatttgtttatggatactcagtatttgcttatgaggtacattgtctcactaaatcaagcatatcatatgcagttaaatgaaatctattttctttcttattcgccgtactctctgatcacagttcctgacattctcagacaccaaaaattttaatttccaaaagacagtaagtattctcctccatgtccattgagaacaaaatggaaccatttaaaattgaaaayaaagctgcccatatctcagtctggagaccactacagttcccagtttgtcttccttctcctacttgccctacctcaagtccatttgtcacacagcatccagagggatctttttgaacacataaatcagatcatgccatctcctttgcaacatgctaatggcttccctttgcaattagaatgaattccaaagccctcagcctggtctgaaaagacccacgtgatcagaaccctgttcacttcttgtttattatgctccaactacacagtcttctttctgccacattgactagccaaattcat

SEQ ID NO: 182787 - DNA, 601 bp, Human
caaacgacgactcagaaaaataagggaaaattgtcatcgttttacttatccatgattcctgggcaaagccttcacaaatagcatcttgaaatatgactgtaaatgtggttcacttttggtgacaaaattaaaccataaaggggtgaccctagattaaggggtggttgaagcatacctattacatacatgtataggtctggttactgtgaaattgcaggagaataaatggtatatttcaacaggattgttagttctagaacatttaatcatgcaataagggtcaagtcctgtcaagtttatytgtagttatacagctaaccccatgtcacagtacaaggataaataaatgtaacacttagaaatacaagtcatacagcatgagtgacccctttcagattctaaaccaacagccaggtttgtatttttcatgcagaagtttaattgtaattgttgcattatgctctacttttagcatgaagttgggaaattcttttagtttgtagataatatgaagaggccatgtgttatagtggaaagatcctgacacctaaattacattccaatttcggccactagcaagttgtgtgaccttggacaggtc

SEQ ID NO: 182788 - DNA, 601 bp, Human
taaagctgtggtttttaattttcctgtgtgtttttttttgtccttatgctataataaacgtgctattgtataattataaaaccaaacgacgactcagaaaaataagggaaaattgtcatcgttttacttatccatgattcctgggcaaagccttcacaaatagcatcttgaaatatgactgtaaatgtggttcacttttggtgacaaaattaaaccataaaggggtgaccctagattaaggggtggttgaagcatacctattacatacatgtataggtctggttactgtgaaattgcaggrgaataaatggtatatttcaacaggattgttagttctagaacatttaatcatgcaataagggtcaagtcctgtcaagtttatttgtagttatacagctaaccccatgtcacagtacaaggataaataaatgtaacacttagaaatacaagtcatacagcatgagtgacccctttcagattctaaaccaacagccaggtttgtatttttcatgcagaagtttaattgtaattgttgcattatgctctacttttagcatgaagttgggaaattcttttagtttgtagataatatgaagaggcc

SEQ ID NO: 182789 - DNA, 601 bp, Human
aataaatcaggtggtaacataactactgagagatggattcaaaccaccttaggttataccagtaaaatgaaatatgcagttattaagaatattagagaatattttattaatgtaaaatgacatctatctccaaagaagtcagacttccagactgtgtgtaaggtatgacagaactttttgtgaaaatgatatttatatataaaatgcagcaaaatatgcagctctttctgtatgataaagctgtggtttttaattttcctgtgtgtttttttttgtccttatgctataataaacgtgctattgtataattataaaaccaaacgacgactcagaaaaataagggaaaattgtcatcgttttacttatccatgattcctgggcaaagccttcacaaatagcatcttgaaatatgactgtaaatgtggttcacttttggtgacaaaattaaaccataaaggggtgaccctagattaaggggtggttgaagcatacctattacatacatgtataggtctggttactgtgaaattgcaggagaataaatggtatatttcaacaggattgttagttctagaacatttaatcatgcaataagggtcaa

SEQ ID NO: 182790 - DNA, 601 bp, Human
ttttgcagttagggaggagacttttcaggcctcccagtttatgttatggtatcatgacagctcaagggtcagatacagacaaagatataatatgcagatcagtagggaaaaactaaagaatgtaaattcatgctggcaactctttcagaaataaatcaggtggtaacataactactgagagatggattcaaaccaccttaggttataccagtaaaatgaaatatgcagttattaagaatattagagaatattttattaatgtaaaatgacatctatctccaaagaagtcagacttccagaytgtgtgtaaggtatgacagaactttttgtgaaaatgatatttatatataaaatgcagcaaaatatgcagctctttctgtatgataaagctgtggtttttaattttcctgtgtgtttttttttgtccttatgctataataaacgtgctattgtataattataaaaccaaacgacgactcagaaaaataagggaaaattgtcatcgttttacttatccatgattcctgggcaaagccttcacaaatagcatcttgaaatatgactgtaaatgtggttcacttttggtgacaaaattaaacca

SEQ ID NO: 182791 - DNA, 601 bp, Human
acattaggcccttagacaagaagatagacagataactatagagatacagcaataccaggaggcatagaaattgatagaaaaataccccagaaccacatgtgagataatgccatacttgaggggtccactgtcgaaaaagaaagagatgtggaatggaagtgtaagatgcatgcaggtttttgtctgtgtgagcacagaaatgaatttccaattaaaacccaaatctctgaatttgtagtgaaatacctatattactagaaaaggaaattgctataatcctgaaaaaattaacattagcaayaaatgatgtgatttacacgtgtaagaaaacctgagttttctgttgaaattagaatttaatgagaggggaaagttcatcagcagaaggcacaaatatgtttgggatcagaagtcagattcctttgagatactgaagtgcatggaagccccttctacctgacccagagtggagctcttttgagagcttgcaccctaactcacttttactgatagagcagagagaacaactttaaagcagtttgcctttaaaatataatatttcatagtgagaattctatagtaggaaatgataccagatgct

SEQ ID NO: 182792 - DNA, 601 bp, Human
tcagagatgccttaatgtagaaatagcttcttgttgcatttggaggattaagattcatataaggaataaccagtggtaatcgataaactatttttttaaaacataaacagcttcatgcttgactttgaacctctctccacttaaataggaggagcacatttctttgttgcaatataaattgcctggcagagctcccctaattccattgcacatatgaaaataaacaataacaataaacagaatagggaaagtatgctatgtatcacaaatgggtattttttatttgtataaagaaaaacayttctcttttttttaagttgtttatggaagactatgtctaatttaagaacagatgttctgccaatactccatcacacacattaggcccttagacaagaagatagacagataactatagagatacagcaataccaggaggcatagaaattgatagaaaaataccccagaaccacatgtgagataatgccatacttgaggggtccactgtcgaaaaagaaagagatgtggaatggaagtgtaagatgcatgcaggtttttgtctgtgtgagcacagaaatgaatttccaattaaaacccaaat

SEQ ID NO: 182793 - DNA, 601 bp, Human
ctgtacacctctattccattgttttagaaagcagtaggaaacatactggaggaaactagtgaaagtttacattttgtgtcctactttgtgttcatctcactccctttgtgggcaaggtaaaatattaatgtttcccatttacttaggttcttggttgtgtaattccaattatatggttgagttacagattccttactcccaagtgttgtttctttgaggtaagaaacaaaaccaggttttaagtttcgggtagcatccaacaaaagaaaaacatattgcctaaagagagcaaactggaagstttttagagtgactccctctggactgttaggaaaacaaacagcagagcaaacgttgctaatcctgtttctgctttgtgcttctggccatgtaggggatagagaagtgaatctcatgaggccaaaaatccatttccaatcctacaagtgatgcatttaatttgtcaggatgtaaatcagcaggacctctcagcatgtttgtgtagtataatcctaaccataaaatattcctcctcattttgccaaagcagtggtggaccttcctaagggccagctcactgacttggcggctgaagccccat

SEQ ID NO: 182794 - DNA, 601 bp, Human
tagtttaatgttagaagttagcaagttactttagcattttgtaaataatttatcaaatgaaagatagctttaatttaaaagactatgatttcatttttcatttctttaggcatattaagcattaaatatcaatactgtattttattgcaataattagtaaggcataatttggtatcttgaagttgcacatgtttcaatcacttaaaattaattaacttaataacttcccataactccagctagaagatagatgagcatgtcaaataagttcagtgaattcccaaggtaaaataaatagttyatatcttctgctctaatattagaaggactaaataatgacctatatagtgacaggccaaaaacaactggtctacccctttcttcaaatgaatatttgtttgttttaagagaataacttgacaactacatcaattatacttgaggcctcatcacattgcaaaaatatttttataataattaaggcagagaatcaccatgaacttgaactctaattttgccatatccttagctgtttggtcataagcaacttacttgatttctgtgagcctcagggctttttttaagtgtaaaatagaaataa

SEQ ID NO: 182795 - DNA, 601 bp, Human
actcaatcttcatcttaacttcatacagtacaattattgtcattgttatgttacaaattaggaaaccaaaacacatagagtctatgtaagttgcacaaagtcacacaaataatatgtgacttagtcgattatcccaggaatcaaggaaaagtgaaaccaggcagtctggcctcagagctcatgctcttaactattagcgtgtatcctctaaaaaataagattattggaagtaagtctgcaaaagtaagattatagtgatcatggactgtattgtgtgctaaagaacttgaactctcttctrtcagttatagagaattgtcatttggttgagagggaattaatagaggaaaatagtctgacttgcattttagaaagaagactttggcacagcttctggataaggactggagtggcacatagcttaaacccagaggtcactgcagtggcctagacaagaattcatggcagcttgacctaagacatagtcagtgggaatggaaaggatgggacggattagaaaaatatttagaagatggaattgatagcatcaacagtgactggtgagttgtgggggattagggaaagagaagaattaagatga

SEQ ID NO: 182796 - DNA, 601 bp, Human
ctcatgtcaggcactgttctcagtgatttacacacattaactcaatcttcatcttaacttcatacagtacaattattgtcattgttatgttacaaattaggaaaccaaaacacatagagtctatgtaagttgcacaaagtcacacaaataatatgtgacttagtcgattatcccaggaatcaaggaaaagtgaaaccaggcagtctggcctcagagctcatgctcttaactattagcgtgtatcctctaaaaaataagattattggaagtaagtctgcaaaagtaagattatagtgatcayggactgtattgtgtgctaaagaacttgaactctcttctatcagttatagagaattgtcatttggttgagagggaattaatagaggaaaatagtctgacttgcattttagaaagaagactttggcacagcttctggataaggactggagtggcacatagcttaaacccagaggtcactgcagtggcctagacaagaattcatggcagcttgacctaagacatagtcagtgggaatggaaaggatgggacggattagaaaaatatttagaagatggaattgatagcatcaacagtgactggt

SEQ ID NO: 182797 - DNA, 601 bp, Human
acatttcccagttccttattcatttaacattcaaaatgcatttaatactaaatatgcttatgtgtagaaaattgtgcccgggagcaggaagacaatgaaaataaaacacattctctgtgtcctagaaggtcacagcctaatagtatggatatagataaataaacatgcacacacagaaacatacatatattataatgtgatcagataagtgaaattatggggaggaaacaggtacagggctatcacataggtcataatgagcaaatctatctggtagagccagagacggactgttagagamgctgacacatgcaatgagtttccaaggatgaacagaaatttgtgagttgaataaggaatgtcaggcaaacatcaaatatgtctgaaataacatcatgtgttcagtgtcatactaacaactaacatgattaaacactgctgctcatgtcaggcactgttctcagtgatttacacacattaactcaatcttcatcttaacttcatacagtacaattattgtcattgttatgttacaaattaggaaaccaaaacacatagagtctatgtaagttgcacaaagtcacacaaataatatgtgact

SEQ ID NO: 182798 - DNA, 601 bp, Human
tgggctgaattagtgaacctcagagtatacaatagtaacattgagtgccatgcaatgggcttttgacaatgcagaatagtggtgtaaacacgatctctattttattcatgttgaaaacgataaatggatttacagtatttaatgtaaacaatatgatttgttttttccactataagtatttttattagttgtgtgtgtgtgtgagtctttgtgtgtgtgtgagtctctgtgtgtcgtatggataaatggcatttgttgggttagagctattgggacatttcccagttccttattcatttarcattcaaaatgcatttaatactaaatatgcttatgtgtagaaaattgtgcccgggagcaggaagacaatgaaaataaaacacattctctgtgtcctagaaggtcacagcctaatagtatggatatagataaataaacatgcacacacagaaacatacatatattataatgtgatcagataagtgaaattatggggaggaaacaggtacagggctatcacataggtcataatgagcaaatctatctggtagagccagagacggactgttagagacgctgacacatgcaatgagtttccaag

SEQ ID NO: 182799 - DNA, 601 bp, Human
atatacatgtatatacaacaagtttgtcttacttgtttttatttatcatagaaatggaggaaacagtcataggtctagaatggcctgtgcaaatgctatccagaaattttaaaggtgggctgaattagtgaacctcagagtatacaatagtaacattgagtgccatgcaatgggcttttgacaatgcagaatagtggtgtaaacacgatctctattttattcatgttgaaaacgataaatggatttacagtatttaatgtaaacaatatgatttgttttttccactataagtatttttatyagttgtgtgtgtgtgtgagtctttgtgtgtgtgtgagtctctgtgtgtcgtatggataaatggcatttgttgggttagagctattgggacatttcccagttccttattcatttaacattcaaaatgcatttaatactaaatatgcttatgtgtagaaaattgtgcccgggagcaggaagacaatgaaaataaaacacattctctgtgtcctagaaggtcacagcctaatagtatggatatagataaataaacatgcacacacagaaacatacatatattataatgtgatcagataagtga

SEQ ID NO: 182800 - DNA, 601 bp, Human
ctggaagagtaagcactgaatttaatctcttaatgatgattctctgctagcaggtggtatggtgtaggggtgtggaattaggggaaatttgacttacaactgtatatgcatgtatataatttaatatacatgtatatacaacaagtttgtcttacttgtttttatttatcatagaaatggaggaaacagtcataggtctagaatggcctgtgcaaatgctatccagaaattttaaaggtgggctgaattagtgaacctcagagtatacaatagtaacattgagtgccatgcaatgggcttytgacaatgcagaatagtggtgtaaacacgatctctattttattcatgttgaaaacgataaatggatttacagtatttaatgtaaacaatatgatttgttttttccactataagtatttttattagttgtgtgtgtgtgtgagtctttgtgtgtgtgtgagtctctgtgtgtcgtatggataaatggcatttgttgggttagagctattgggacatttcccagttccttattcatttaacattcaaaatgcatttaatactaaatatgcttatgtgtagaaaattgtgcccgggagcagga

SEQ ID NO: 182801 - DNA, 601 bp, Human
ttcaaatttggagtagaagcatagatactataagtaaatattggcaaataaatgtaaagtttggggtaaagaagaataagctaaatgtattataaaaaccagcaactaagaaaaaaaaagattgatacatttcataacacagagatgtaatgtttctattaaaaaataagttggacaataaataataaactagagaaaattttgtaacatatattacaaagttttaatatccattaaagagctcatatgagttaatttaaaaaaggataaacaatatagtagaaaaaatgttaaacatacrtaaataggctagtatgtagtcacagaaaaagaaatctagtcacagaagaaatgcaaatggttaatacacacaaaaacatgcacaacttaacttctgaagaagccgagattaattagatggctagcaaagttttgggaaatttgaaagcccaggtactcttagggagaaggtaaaatgtgaagataacttgtgaatatctataaaaaatttaaattatcacatcactaattatagttttgataaattatatatctattaacataaataatacttataataggttataaattatagtgcatc

SEQ ID NO: 182802 - DNA, 601 bp, Human
ttgaacctgtttatctttcccacgtataaaaacagaattactttgtcaagtcgatttttaacatctggactagaattttcttaaatactaccctgtcttaatacctcttccattaaatttatgtgttaattttaattatattgttaatatactgctcatatttcattttgtccctgaagcctttcattgattctttactattttcgttatccaggtccgttgggagtggccacctcagctagcatggggatctttatatagagaggttgatatgaaggacaacactgcagccccagtgtcytaaagttagatagtcaaagtagtcagattttccctgatgacagtctcagctacatgtttagcttaggtttgcattttaaacacaaaacctggatggttactgaacaccagtgcactgtttcctagagcatattcagtatgttctttgaagcaaaataagagtttcattgttaagatttagggaggcctatattaaacaaacagtttttattaagatgcttcttttaggattagggttccatggaacaacactttatgaaaccatgcacctaaatctatacaaattgagctagaaatccaa

SEQ ID NO: 182803 - DNA, 601 bp, Human
gagcactgctgcctcaagccaaggaactactggcaggtaggagagaggcctggaaccgagtcttccctagggccttcagagagagcctagccctgcaggcaccttgatccttgatctgggactttcagcctccagaatattcagagaatacatttccattgtttagaagaagaggaagaggaaaaagaagtgtggccagaactactcctgggcattccaaatctttgccaacaaacttgtactcgaagaatatggcaggaaagctgcctgtgaagtcaagcctgaaaaatacctgaggctkctaagactctactaatttataatacctttagtagtgtgcacacattcacataagaaagtttctcattgagacccattagcagaaactgtgtgacttctgcagtagaagtcccatttctgttttgaattgctttcattctaccaataccaagagagaaaggagccctgccctgcaccgatcataaagtaaacccaatttagatagagcttgggtacagtaatatagggaaactgtgatgatcacttattttttaaaaattcttttggaaatgaaaaacttaggcaaggtaagcagtgtaag

SEQ ID NO: 182804 - DNA, 601 bp, Human
aggaagtgaaaataaaacttagatttgaaaaaatgttatacaaaaaaacccttataattcaattggttcctgaatttatttaagatgagaaattttacatttcactgtaaaaatatttttaagtgagagacttaagaatatgtattcttcagaataggagttacacatataacatgtcaaataaaaaataagtaaaccagatattgtcagagtaatgtttgcttttaactatgatttagtttcttggtttccttgggtgtatcttatatccaaggtagctaacttacacccaaatagctayactctaaagaagttatagtataactttcactaaagaaatgggcctaagaggaaacagaatagttcaggaaaaaaacaaacaacacgtagaaactactttttattcactttgcttcatttatttggggttttcaaaacgttaacattgactaaatttcacgatagttctgtgggatcaagaatagtatattgaccatctgcaaaatcagaaataaagagaaaaatatgaaataatcagaaacacaaaggtttatgtacaatgacattaagaaagaaaaaaatctcttattttgaaactgtt

SEQ ID NO: 182805 - DNA, 601 bp, Human
ttaaatctatcctgcacaggactaagcacaagtgatcttaataaacatttttaataacaataatcctgcctcactcataatacttgtttcaaatagtctgtctccgtttctctgcaacccacaatttcctaccccattccctttaaaaggaaataataaatattcatttaaaaatggaaatcctcctgaaactctcccagcactatgaactaatttttaacattggctcatctctgtcctatatatagttaagtgtctaacaccataataccaattatttattcacgacagtatcacagaytttatctaaggttaaaagacaaagaaagaagaaattagaaagctctttcagaaagacattgtggattcacaaatttaggcttatgaatacattctccaggtagaaacatgagaaaattatcaacataacttcataaatgattctaaccataaagttcttctgctattttttacacagcaatcaatgcactgtagaaagctatattgagtatttacttgatcaaaggaaataaaatattaacaataccaaagtgaggaagacattcttaccaccttctttagtgcaaagattgacaaggtt

SEQ ID NO: 182806 - DNA, 601 bp, Human
ctttccctattgtggtgaaatagacagaattctcctgactttatacatgatgagacagcttccttaaggttaaactggttgccaatgacaggggaagctcattaacatttttttagtctggccttgcagtattatattcaggctgtctccacagattagtgggtcagattgaaaccagaagaccttttagggtcaattaaaatgtttggctttttggatgacgacacagctcgtgttttttaagatcttgtagaatacctatatttgagctttaaaatgtacattttagaatatttgatgygtttattctggtatgcttattttgaaatatttgcatatatataaatttataagtaaaatatttacatataatccttcaataaataataaatttatatgatatataaattttggtcataaaacaaagaaaggctttacccatgtgttttagaatttgaataaaagttcattttaataactgatattcaatctagtattatgctattagccatttaaaattttaaattcaccatagccaacgactaaggctccagtgaaaataaagatatgcagacaatgaaaatcttcataaaaaccttat

SEQ ID NO: 182807 - DNA, 601 bp, Human
ataattgacaaaagttgtatatatttatggtgtactacatacctaccgggtagatattatgatcccattttagagatcagaaaatggaggccaaaaaagctgcctggatgactgtcaacactcaaacactccggggcattgtatttaaacattttctgcagaggaagttttgcttataaagcacataatgaatgtacttaactgaatcttgtccatcgaaggagaaagaagaaactaaagtttaatgaatcaactgtgtcttcagcaatgggatcttcgcttgtatattgagcatctaatrtaattctttccctattgtggtgaaatagacagaattctcctgactttatacatgatgagacagcttccttaaggttaaactggttgccaatgacaggggaagctcattaacatttttttagtctggccttgcagtattatattcaggctgtctccacagattagtgggtcagattgaaaccagaagaccttttagggtcaattaaaatgtttggctttttggatgacgacacagctcgtgttttttaagatcttgtagaatacctatatttgagctttaaaatgtacattttagaatatt

SEQ ID NO: 182808 - DNA, 601 bp, Human
taagtttataatacagtctaaatactttttttaaaaactttttcttttcttttttccttccttcctttttttacatgctgttagtaattaaattcccaattatatatttgccacgtgtatgttcaacatgagatgacattttaatcaccagtgtacatagataaccagtgaatttatttttatttttattttttttttttttgagacagagtcttactctgttgcccaggctggagtgcagtggcgtgatctcagctcactgcaaccttcgcctcctgggttcaagcaattctcctgcctyagcctcctgagtagctgggattacaggcatgtgccaccatgcccagctaatttctgtatttttagtagagatggggtttcaccatattggccaagctggtcttgaacttctgacctcaagtgatccacccactttggcctcccaaagttctgggattacaggcatgagccaccgcgcctggccaactagtggttttttaatagtcacagtaactgattactctcccctgaaagattccaaaccttgtttgtatgccttattaatgtaaattacttaattccagcaaatatttaattttgg

SEQ ID NO: 182809 - DNA, 601 bp, Human
ttaaataaaaatgaataaatatcatttccccagaacagaacagttgctgcagaactgttttgaatgaatggataaatttatgaaccacatcctgctacagcagaaatgagcttcgagctgatttgagcagtgtgagacaatcagactatgtaagtttataatacagtctaaatactttttttaaaaactttttcttttcttttttccttccttcctttttttacatgctgttagtaattaaattcccaattatatatttgccacgtgtatgttcaacatgagatgacattttaatcaccastgtacatagataaccagtgaatttatttttatttttattttttttttttttgagacagagtcttactctgttgcccaggctggagtgcagtggcgtgatctcagctcactgcaaccttcgcctcctgggttcaagcaattctcctgcctcagcctcctgagtagctgggattacaggcatgtgccaccatgcccagctaatttctgtatttttagtagagatggggtttcaccatattggccaagctggtcttgaacttctgacctcaagtgatccacccactttggcctcccaaagttc

SEQ ID NO: 182810 - DNA, 601 bp, Human
gcacattatagaaacttaccaaatatttgttaaataaaaatgaataaatatcatttccccagaacagaacagttgctgcagaactgttttgaatgaatggataaatttatgaaccacatcctgctacagcagaaatgagcttcgagctgatttgagcagtgtgagacaatcagactatgtaagtttataatacagtctaaatactttttttaaaaactttttcttttcttttttccttccttcctttttttacatgctgttagtaattaaattcccaattatatatttgccacgtgtatgytcaacatgagatgacattttaatcaccagtgtacatagataaccagtgaatttatttttatttttattttttttttttttgagacagagtcttactctgttgcccaggctggagtgcagtggcgtgatctcagctcactgcaaccttcgcctcctgggttcaagcaattctcctgcctcagcctcctgagtagctgggattacaggcatgtgccaccatgcccagctaatttctgtatttttagtagagatggggtttcaccatattggccaagctggtcttgaacttctgacctcaagt

SEQ ID NO: 182811 - DNA, 601 bp, Human
ttcccagtagtctgagcaatatttggcacattatagaaacttaccaaatatttgttaaataaaaatgaataaatatcatttccccagaacagaacagttgctgcagaactgttttgaatgaatggataaatttatgaaccacatcctgctacagcagaaatgagcttcgagctgatttgagcagtgtgagacaatcagactatgtaagtttataatacagtctaaatactttttttaaaaactttttcttttcttttttccttccttcctttttttacatgctgttagtaattaaattccyaattatatatttgccacgtgtatgttcaacatgagatgacattttaatcaccagtgtacatagataaccagtgaatttatttttatttttattttttttttttttgagacagagtcttactctgttgcccaggctggagtgcagtggcgtgatctcagctcactgcaaccttcgcctcctgggttcaagcaattctcctgcctcagcctcctgagtagctgggattacaggcatgtgccaccatgcccagctaatttctgtatttttagtagagatggggtttcaccatattggccaagc

SEQ ID NO: 182812 - DNA, 601 bp, Human
cattcaaaaagttttaatttcctcccatcacttgtgatgtttttagagtcattcttaactcaagggacttgcagttcaaactatctcatcccttacagaatgatataaacttcataaactcaacagacacaacatgggaggtaaattcctttcagatggtagaattattctgagaatcaagccaaatgactcctcagcactgagaagaaagcaaatgcctcatttccccctttaagaagactagaggacccataataatgatcaaatgttccataccactgcaatcagcttctgggaaagrcactttagctcaaatagtggtcacttaaacatttgtagtatcagccattatgtctctgtgataatgtgaaatgattcttaaaaatgaacttcatgagaagctcctatgagttgaaatttgaacttcttatgagagaattaagtatataaacatgttcttgtctctcagtacttatttttaagtttcctctactccgtgtgcctccctacttaaagttgttatctgtcctttcacattcaagtttcttgaatgcaggtatataatgatttctgttaacttcctctcactcattttagtctc

SEQ ID NO: 182813 - DNA, 601 bp, Human
ataacacgctccatcaaaaaggagaaatataccatttccaaaaataaacagtcaattttgccttaagccactgggttttatgaaaggaagtgctagatagtgtggttcattttaaggaaattgtaaatgtttgacatataattttctgtcaagataaagcatttccctcattaaatggaaacaagtactcactgcagtgttcagcagatgacttcctgtatttttctttctctttctacctaatcttaaattgtgcactacaagtagtaaatgaaaaaccaagtattttacccagtcaacraaactgatatattccatttttatcaatgtttatatgactgacattcaaaaagttttaatttcctcccatcacttgtgatgtttttagagtcattcttaactcaagggacttgcagttcaaactatctcatcccttacagaatgatataaacttcataaactcaacagacacaacatgggaggtaaattcctttcagatggtagaattattctgagaatcaagccaaatgactcctcagcactgagaagaaagcaaatgcctcatttccccctttaagaagactagaggacccataataat

SEQ ID NO: 182814 - DNA, 601 bp, Human
atttaaagctaagtgtacagttgcaacattccccagattttaccttctttttctcccttcttacagtataaaaaatttcatgaggtcttcactctatagttgatatgatgcatacatatttaatgctgttaataaaacattttttcttactgtctctcagagtaattataggtgtcatttggttcagtgtaaagtgccatatcttatccgtgactaatgtctactgttctgttttgtccctggtttagaaaatatctgttgaatttgacttgagtgtggatgagaccaggaaatgacttarttgaaagtctattcaaactatctgtgctccttcgctttagccaaccaggctatgaaagcataagggaagaaggatggagtttgctcatggtaatattggaacatcaaggaaacactctttttgtggccttttacccctgtaacttccaagcccagctggaaccaggagatatcccttttcagatagttcatcttgtttctgaagttaaaaactccaattccaaaagagaattaaccacaaaatttcaaatctcctccgaaagatggggtttagaaatagttcatgggagaggtcaaggac

SEQ ID NO: 182815 - DNA, 601 bp, Human
ttttttttttttttttttttttgagacagagtcttgctctgtcgcccaggctggagtgcagcggcgcaatctcaactcactgcaagctccacctcccaggtttctgccattctcctgcctcagcctcccgagtagttgggactacaggcgcccaccaccactcctggctaattttttttttgtatttttagtagagatgggatttcactgtgttagccaggatggtctcgatctcctgacctcgtgatccacctgcctcggcctcccaaagtgctgggactacaggcgtgagccaccacgmctggccaaaatgttactagttttaaagattctttgcaattgacttttagaaaatcttatgctaaaaataaatatttgtttatacacatttaaagctaagtgtacagttgcaacattccccagattttaccttctttttctcccttcttacagtataaaaaatttcatgaggtcttcactctatagttgatatgatgcatacatatttaatgctgttaataaaacattttttcttactgtctctcagagtaattataggtgtcatttggttcagtgtaaagtgccatatcttatccgtgac

SEQ ID NO: 182816 - DNA, 601 bp, Human
tttttttttttttttttttttttgagacagagtcttgctctgtcgcccaggctggagtgcagcggcgcaatctcaactcactgcaagctccacctcccaggtttctgccattctcctgcctcagcctcccgagtagttgggactacaggcgcccaccaccactcctggctaattttttttttgtatttttagtagagatgggatttcactgtgttagccaggatggtctcgatctcctgacctcgtgatccacctgcctcggcctcccaaagtgctgggactacaggcgtgagccaccacractggccaaaatgttactagttttaaagattctttgcaattgacttttagaaaatcttatgctaaaaataaatatttgtttatacacatttaaagctaagtgtacagttgcaacattccccagattttaccttctttttctcccttcttacagtataaaaaatttcatgaggtcttcactctatagttgatatgatgcatacatatttaatgctgttaataaaacattttttcttactgtctctcagagtaattataggtgtcatttggttcagtgtaaagtgccatatcttatccgtga

SEQ ID NO: 182817 - DNA, 601 bp, Human
ccttgccatttgttcaggagctcattttattcacaaagacatttcaggtgtttcgtgtgtgttaatttcccatatactttttttcagcctggctaaaatatattggttttgtacaaaagatttcccatacatgtgggaaagcttaaggggcatcttttgtgctctgctatgagcagacaaatataatttatttcagcaacagccattaaaaatggaatgaaagtccttgggcaatgctgtaaacatagaaagcagttgccagatgtttttgaaaactgacacatacacaaaattccacttygaagttttaagtaaataagtcctgactgtcaccacaagtacgtcaccttgattcttactcttgtggtgtgatatacttaaagaacagtacttgactaccagccctggctctacatgggcttctcctctgaatacagggcttcaccggttattaggagtgacacaaaaccaagagacaaagttggaatgcttgatatgagtcataaagtatgtaggtttgtgtaggataccaggcaaactctaaggtgtgccatacttctatgttaagcaatctgacagcagagctgggactagaacagag

SEQ ID NO: 182818 - DNA, 601 bp, Human
taaatatcaattctacatatttgtactgtagtttgattaccatgttcaaataaattttgcaattatcttccaatgtgaaacgaatctcatgtgtataacaacgtatattcaatgcctattactacctaaagtaatcaagaatggggaaaaagctgggtgcggtggctcacgcctgtaatcccagcactctggaagtccgaggcgggcggatcacaaggtcaggagatggagaccatcctggctaaaatggtgaaaccccgtctctactaaaaatacaaaaaattaggtgggcgtggtggcrggcgcctgtagtcccagctactcgggaggctgaggcaggagaatggagtgaacctgggaggcggagcttgcagtgagcagagatcgcaccactgcactccagcctgggcgacagagcgagactccgtttcaaaaaaaaaaaaaaaaaaagaatggggaaaaatacttgactaaaaggtacaactggaaatacacaccatctttgtttaatcaagtaatctttcattttacataaaattaatttctttgttttccctttgggcaccctgttgggcagttacgaatgctgcacggcccttgc

SEQ ID NO: 182819 - DNA, 601 bp, Human
aagggggcatgctatatacttttccagaggcatcacggtattatgatgaaaattaattcatatggataataacggattaaattattagaaaaaaagccataattttattcaattttctcttccaaaaaaagaaaggagaggataaaaaatgcaggtaatttttcatcacatttaaaaattttcataaaattttactaaagggatacattttaattatctgaagaatatattgcccatgatatataattgcagatatacaaattttcaataatactacgatatacataagacatacaaactsttacatttatgtagagatgcaaagcatcctatgtcataagtgtagctctaatttaaagtctgttttaaagtggaagaataattaaatatcaattctacatatttgtactgtagtttgattaccatgttcaaataaattttgcaattatcttccaatgtgaaacgaatctcatgtgtataacaacgtatattcaatgcctattactacctaaagtaatcaagaatggggaaaaagctgggtgcggtggctcacgcctgtaatcccagcactctggaagtccgaggcgggcggatcacaagg

SEQ ID NO: 182820 - DNA, 601 bp, Human
tcagcagaaaagtgaagccgtgacagcccacaatgtcaagagctaacagaggataagtgagaggtcccaaagcagccatattggattttatcatgttcatacccttaaagtcacactgactcaggatttacccctattaattttaggtattattctcataagcctggtagttggtctcccagcctacggactatttgctagaagcttcaaagacagagaggataggctggcggggtagtgagagtgggaatatgtgtgtgtgtgtatgtgttagtgtgagtgtgtgtgtgtgtgtatgtaggtgtgtgtgtatgagtgtgtatgtgagtgtgtgtgtatgtgtgtgactgtgtgtatgtatgtgagtgtgtgtgagtgtgtgtgtgttcatcttctagtatcaggcatggagacaagaaattggatcattgaaagtatgtgtgtgtgtgtctgtgttcatcttctagtatcaggcatggagacaaggaattggatcattgaaagtacgtgtgtatgtgtgtgaggaaaagacagaaaattttaaaaagtaggcaaaactaagaaatgataagaatttgggcactgaacaatataaaggggg

SEQ ID NO: 182821 - DNA, 601 bp, Human
gcagtagaattgtctgagatgaaaaccctcagcagaaaagtgaagccgtgacagcccacaatgtcaagagctaacagaggataagtgagaggtcccaaagcagccatattggattttatcatgttcatacccttaaagtcacactgactcaggatttacccctattaattttaggtattattctcataagcctggtagttggtctcccagcctacggactatttgctagaagcttcaaagacagagaggataggctggcggggtagtgagagtgggaatatgtgtgtgtgtgtatgtgttagtgtgagtgtgtgtgtgtgtgtatgtatgtgtgtgtgtatgagtgtgtatgtgagtgtgtgtgtatgtgtgtgactgtgtgtatgtatgtgagtgtgtgtgagtgtgtgtgtgttcatcttctagtatcaggcatggagacaagaaattggatcattgaaagtatgtgtgtgtgtgtctgtgttcatcttctagtatcaggcatggagacaaggaattggatcattgaaagtacgtgtgtatgtgtgtgaggaaaagacagaaaattttaaaaagtaggcaaaactaagaaatgataaga

SEQ ID NO: 182822 - DNA, 601 bp, Human
tcttcaatcgttcattttaaaccttaaatatggctaatggttcatgtatttccagtatttaccgaacatcagaatacatgtggatcaggttatttgttcaaggatagtccttgagacatcattattaggaagatcatagcactagaaattgaccctgaacctgtgatttcaacacaacaggtcactgaaattaactgagcatataaaggaagaaaacagcacatctgacaaggtgcaaacaagcaaacaattgatggattagattttgtgcttttcagccaggtgtgtgggcatttcataragaaaacattttgaagacactctctggaatcctaatttattcaaaagaatctttaaaagtggaagaaggtaatgtcttgcatttcaagggtgtggaagaattaaaagatttccaggcagtccaagtttcaatattttatgggtaggtataggggtgagggatatttaccaatgactttataaacagatatacaaatatatatagctacacaaatacatacaagctgtatgcttataaatggaaaatgttgaggttggtatttttttcttatagaaagcatatgcatacaaacctaaatat

SEQ ID NO: 182823 - DNA, 601 bp, Human
ctcaattcaaggtggcttaagcaaaaagataatttattggatcatgtaactaaagaatccaatgtagtactttaagtaagtcatggtaaggtttcaaacaatgtgaccagaaattggtttcttagtctttttcttgacccacttattcttggcaatcaacctggtcacaagatagctggcaataacttgtaaggctataatgtcaccagtttaaatacagcaccaaagagagagaatgcagacaattgttatcttagaggtatgtatcaagcacattgggaacatgcaagaatatactccwtctgccaggtggacaccaggaaggctacctagaagagataacagttgaaagaatataacatatagaaaagcttatctgacctaaatttaagagcctggtatgctagttcaaagactttgcccacaccaatatcagcaaataaatctagaaagtcctaggaaggaatcattattcattcttttcatttagccttatctatacaaccaaatctttgtcatctaaagggatagaatagagacacaaacaggtgcatgtctgtctttcaccagccaacattcagtcaataagcaacctgagacc

SEQ ID NO: 182824 - DNA, 601 bp, Human
ttcagattcatatatctacttgcctgttgggcagtccttcctgctacaccaactttcatttgtttaatgttccataatctttccttccaaaccaggtgtttgctctttcccttattagtcccactatccttctccagtttttatcagttaaaaattaattaaagtgttaatttttttctaataagacaattagagtatggcttttccatttgtccctctgcttcttatcctctcttagttcaatcatcctatattattatttcaacaaatattgatggacatttgctatttttaagacttytcctaggcaatggagatacagacataagaaagcccaagcctgcctgtcatgtgatcacagcctgatgcgaaaaagatcttccatgaacgctatacccatgattagtaacttttatgataggacaaaactcaattcaaggtggcttaagcaaaaagataatttattggatcatgtaactaaagaatccaatgtagtactttaagtaagtcatggtaaggtttcaaacaatgtgaccagaaattggtttcttagtctttttcttgacccacttattcttggcaatcaacctggtcacaagat

SEQ ID NO: 182825 - DNA, 601 bp, Human
ctaacagtataaatttgttgtcaaaaccatgaatacaaattctatacttgggaaaatggtttgagaattctaccatcaaaaggtacacctagtattatggttatattatggattttttgttgttatggtaacatatctgaaatagatattgtattttcttgaaatttaatttggtatgtttgaaaaattgagatacttatattctttcaaaaaagtcattctttccagaaagattagattgattgtttttaattacttaccaactagcaagcatatgcctgaaagttaatttaggctacaytttagagtagcaaggcattgaaaatcattgtaaaagtttcatccacagcttacctttggtatttttattatatactacggtttgaataaggtccctttgataagggtagattgacctttagagttttttttgtccttaatctataaagtgaggtagttataaatacctctgagatgggtgtatgaattacctaacacagtgcaaagacagtgaagcataataagtactcaagaatggtagttgttatggtaatgacaacactgttaacagcaatattatcctgttactccttcttatgga

SEQ ID NO: 182826 - DNA, 601 bp, Human
actttacggactgctatttttctaaaacaaaaaaaaattttaaatcccacctactggatcctttattctgttggaaagttgaaaataagcaaatcagatgcccagaaaaagagatgtgaagaaataccaactaaaatttatgatcacttgagaggacaaaaaacacaggaagatgtggtcagcaggaacccaacggtaaacccatttttctcttttgagagagagaaagtcatttatctatggagaaaatgcttctcttgtatataccacatcctgccctcccttttttagttatgtatgragaacacattcccttcactcttgtctgccatctctcctcccatttttgctttttctttccacttcaggaagatgttggtgaagtggctatgtgtgggaagaggaagctatttcacacacatttttagtaaccgagaaaaaaggaaaaagttgggtattaacttatttttgtgaaaactaacagtataaatttgttgtcaaaaccatgaatacaaattctatacttgggaaaatggtttgagaattctaccatcaaaaggtacacctagtattatggttatattatggattttttgttgtt

SEQ ID NO: 182827 - DNA, 601 bp, Human
cagaacttttacattaattttaaatgatctaaaaatctaaaatcctggcctaacttaatactggtttcatactaaatactggcctttagttgcctaatgtttactaacttataggtattgagcagtctaatctttatggaaataattactatttcaatataaattactcagatttttaaaaaatattaaattatatttcaagaaaatgaaatatttatgtcagatatgttgccacagcagaaaaatagtactaaagcatttaataacattatgattttctatgtagctcaagtctgcactmatggttttaatgaatcatactaataattacatctaaataccaccatcacaattgccatgtcaacacaaaataaatcaactaattaaagggctacagattcatatgatagtgaagaagtactgcacagaatgtatgcaaatagcaatttaaagatgcatatataaatgcttactcaaaagccatctttaatgacactgaggatgtcaatggattatataaaggtatccatttcaaaagcattgacgtagtttactggtattcgtttattctaactttacggactgctatttttctaaaaca

SEQ ID NO: 182828 - DNA, 601 bp, Human
tatggaaagcaaattctttcaagattatgaagtaagataggaaatgtttctcctatcctaacaggagcaataacttgcaaatagctatatctacccctccctctcctcacagtatttggctttggataatgtgtgttctctggattgttgggtctttggaagatggcttctctttcccatagactcacggtagacatgacctcaacatgtaatctgtacaaggcaaacatgtatgagcaaggggacatcctagggacaccagggaataaatgcaaaattttgtgtgaaagaaaaggtgtgkggattggggatttctgtacaatagggttttcatcctttatggacctgggaaacagagtatctctgggagaaaaaagttcaggcatctctatatatatttccagtttaacaagctcacaaatcaatctgattatccagcaattcaactgggatctggcttacatcttgtaaacaaacacttctggttttacctttttgggttctggcatattattaatataaatagtgtagattccacttttattaaaaccagcttgatatacatctgcacagtctctaaatggtttctcttcctctcttt

SEQ ID NO: 182829 - DNA, 601 bp, Human
caagtaatttaggtgggggcatgaggggaggacagttgttttatcctgtaagggcatgcggtcctcttgggaccctgggcttccagttaaaactcacagacactgaagagcaaggttcttgcctaatctcactctcttcagctgtctcacctcaaaacttcccatataccctgctttacacagaccatttctatcactatacttattgatagcattttataactatctgcataattgtctatcttcatcattacactagaaactgtttgctctatattcatgttcctaacaaatgcatgayatccacttaacagtattgaatgaaggcatagatggatgatttaatgaataaatggtggaagacagtatacaaaagagatgttacagcaggaagataatgtttgcttactccaaagtttaccttgggtcctgttcaacatactgatgaatccgatcctccaacccactcttttatgtaaatatggaaagcaaattctttcaagattatgaagtaagataggaaatgtttctcctatcctaacaggagcaataacttgcaaatagctatatctacccctccctctcctcacagtatttggct

SEQ ID NO: 182830 - DNA, 601 bp, Human
ggtagtgagaaagtcatgtaaagttgcctgagggaatcagagaagattccaagagcattgcacaggccccagaggaaatggggataagagacaagtaatttaggtgggggcatgaggggaggacagttgttttatcctgtaagggcatgcggtcctcttgggaccctgggcttccagttaaaactcacagacactgaagagcaaggttcttgcctaatctcactctcttcagctgtctcacctcaaaacttcccatataccctgctttacacagaccatttctatcactatacttattgayagcattttataactatctgcataattgtctatcttcatcattacactagaaactgtttgctctatattcatgttcctaacaaatgcatgacatccacttaacagtattgaatgaaggcatagatggatgatttaatgaataaatggtggaagacagtatacaaaagagatgttacagcaggaagataatgtttgcttactccaaagtttaccttgggtcctgttcaacatactgatgaatccgatcctccaacccactcttttatgtaaatatggaaagcaaattctttcaagattatga

SEQ ID NO: 182831 - DNA, 601 bp, Human
atatgtactaagcatatatatacactaagcatatatatagatatttagatatacatagcatatatagatatatatagcatatatagatatagacagcagatatataggtatattatatatctatatatagatctctatatatagatataaatatctatatatagatatatagttatatagtatatttagatacatactatactatactatatatactatatatatagttatatctagatatactatatatctagatatgtagttatatctagatatactatatatctagatatgtagttayatctagatatactatatatttagatatgtagttatatctagatatactatatatctagatatgtagttatatctagatatactatatatctagatatgtagttatatctagatatactgtatatatactatatactagttatatctagatatctagatataactagttatatctaggtatctagatatgtagttatatctagatataactatatatatagttatatctagatataggtatctatatctatagagatctatatatatctctatatatctatatatagtatatatatagtat

SEQ ID NO: 182832 - DNA, 556 bp, Human
atatatatataaaaacatacatatatatactaagcatatatatatacactaagcatatatatatactaagcatatatatactaagcatatatatgtactaagcatatatatacactaagcatatatatagatatttagatatacatagcatatatagatatatatagcatatatagatatagacagcagatatataggtatattatatatctatatatagatctctatatatagatataaatatctatatatagayatatagttatatagtatatttagatacatactatactatactatatatactatatatatagttatatctagatatactatatatctagatatgtagttatatctagatatactatatatctagatatgtagttacatctagatatactatatatttagatatgtagttatatctagatatactatatatctagatatgtagttatatctagatatactatatatctagatatgtagttatatctagatatactgtatatatactatatactagttatatctagatatctagatataacta

SEQ ID NO: 182833 - DNA, 601 bp, Human
acttaaataagtaaagaaaaaggtggaaacagatgtgtgtggcagggagtgagaagggtcaaagaacgggctttggtgaacacctgagaaggacagaatacatcaggaaactttaggtgggcagggatttctttcaattgactgctgtccccagtacctagaggtgtgcttagcctgtagcgggtactgaatgaatatttgataaacaaatagagatggaacaggagagataaaataggaaaatttgattaatggaatgctaagaaagatggatttagagttggggaggtgatcatcaaakgtttcagaaaagtcaagataaaaaatgattaagaaaatataacttcaatttgaatgaagaagcctttagtgaccttggtgagagagaatgcagattcctgtgggaataaaatcagatggcatagtttcaagagggcataggtggtgattcaagagaagtggtcaaagtggagctttaccagtgaaattcaaatgagaaaaaagggaagtgaaaatatcaaggaaacatttttctagaagcagctaatatcactagtttctcaattaaattttatcgtgccctgacttgttaatccagaat

SEQ ID NO: 182834 - DNA, 601 bp, Human
ctgaaaattaagtctttgtctcagactatacaacattttaaaaaatctttgttttaaatgaaaataagcatttgagtatgttcaaagttttggaaatgctaccaaatttccaaagttacagaccatttgattgccaaaacacatgactcagaattttaaaactttaaattgattgaaatgggagtacaataagaataaaaaatttttaaaatataatgtctttaactatcacatatttcattgcctatcaattcttatatatgtacatgttacagtagatatccttgagtcaatatttcaytagaggcaacatttgtggcatagcatatgtagaatatattatttgcttgtattttagtcacgaacaataacaggagaacatgacatattgtatctcttctgactgtgacaataacttctttcccatgtggaaaatttatacaaatctttcaaagacttatgcatattttaattattcaaaatacaatggtatttatttagaaattgactcatttcccccagggtctacccaagaagagaaacatatctgtaatgggattatcgtcggagagcaatcactgtaattgatgtagcatgaatg

SEQ ID NO: 182835 - DNA, 601 bp, Human
tttggaaatctagacttccatcttcacgatgttgtattacagtccaacctcccccattgacatccatattgcaaaacacctgacaaatggaaaacaaagtcaagtaaaaaatacttctactttaaaaaacatatatcctacatgtttcaaaataggaataaggcgaacaggtctgcagattacaaaaaccgaaattactatattgaacaatgttaatttagatatattattggttatttcttcctctgattcatatttgagttatttctgattaaattccatcaatgatgaataaattacrtgcacaaattttagtcagctgaaaattaagtctttgtctcagactatacaacattttaaaaaatctttgttttaaatgaaaataagcatttgagtatgttcaaagttttggaaatgctaccaaatttccaaagttacagaccatttgattgccaaaacacatgactcagaattttaaaactttaaattgattgaaatgggagtacaataagaataaaaaatttttaaaatataatgtctttaactatcacatatttcattgcctatcaattcttatatatgtacatgttacagtagatat

SEQ ID NO: 182836 - DNA, 601 bp, Human; identical to SEQ ID NO: 20872

SEQ ID NO: 182837 - DNA, 601 bp, Human; identical to SEQ ID NO: 20873

SEQ ID NO: 182838 - DNA, 601 bp, Human; identical to SEQ ID NO: 20874

SEQ ID NO: 182839 - DNA, 601 bp, Human; identical to SEQ ID NO: 20875

SEQ ID NO: 182840 - DNA, 601 bp, Human; identical to SEQ ID NO: 20876

SEQ ID NO: 182841 - DNA, 601 bp, Human; identical to SEQ ID NO: 20877

SEQ ID NO: 182842 - DNA, 601 bp, Human
caagtttcaggtcaaaacatttacataagagtatccctgatgtttaacagtggttttcttgttataaaactttcaaaatattgacctccttggaaacatttcttcttacactccattgcattttataaatgtctcttctttggtttcttgagctgccattaagtacaccctcgcttcccctccacccccaccatgagactatcaactcttttagatctatttctcattctctgttgtggtgacatcattactatttgtcgagaaaatgattattatgtctccaaggatccaaccccatacrtaatccattaaaatgaaatgagttgtgcctatgaaaatatgcagaattcaaacttttaaaaaattaaaaaaaaaaggtttgtcttgaaaagacaaataagcagcagaaacagttgaactatgagataaccacacaggttgaaacaaaacacacgcaagggttgggttgctattgttgcaattacttgaagcaatgtgcccaccctttaattcatacaatcatattttcaagacagaggtagagcagtcacaatattgagagttaaaaatcattacaactctaatttactaagaatgaaac

SEQ ID NO: 182843 - DNA, 518 bp, Human
acctatgaaaaactgagagacattttggaaaggaaccaaagcaaattcttcaggagcctaggaaaagactagactaattatttgctagtcctattgtcaggctgtctgacattagccaagtttcatatagtttcaagtttcaggtcaaaacatttacataagagtatccctgatgtttaacagtggttttcttgttataaaactttcaaaatattgamctccttggaaacatttcttcttacactccattgcattttataaatgtctcttctttggtttcttgagctgccattaagtacaccctcgcttcccctccacccccaccatgagactatcaactcttttagatctatttctcattctctgttgtggtgacatcattactatttgtcgagaaaatgattattatgtctccaaggatccaaccccatacataatccattaaaatgaaatgagttgtgcctatgaaaatatgcagaattcaaacttttaaaaaattaaaaaaaaaaggtttgtct

SEQ ID NO: 182844 - DNA, 601 bp, Human
aaaatacaaaaaattagccaggcatggtggcaggcacctgtagtcccagctactagagaggctgaggcgggagaattgcttgaaccggtgaggcggaggttgcagtgagccgagatcgcgccattgcactccagcctgggcgataagagtgagactccgtctcaaaaaaacaatgtgtctaataatacctacctccaaaagaggtttatatgcttgtagtgttaaaaatcatttcataggttatggaatactgtgcaaatcttagtattaatacttgaaacaattgatcacaaagacacaygccaattcagagggacgagacatgaatggacaaaaagcacatgaggcagtgatggacaatgtgagttctaactgcaggccacgggaggcattaatgggcctagagaagcagtactgggcatacgtgatgatacaggcagggagaaaagttgcaagggcttagcttctgttttcaggcttctgttccatttttctttgaaaaagcgaataacaccatcttatagtgtgtttactttaatgaatctttcaccagagtaagcattatgttttaatgagttctcatttcccatttcatgtcaac

SEQ ID NO: 182845 - DNA, 601 bp, Human
aataaactctcaagtgtttattagagagatcaaatttaattttttatcaaagaattgaaaggtaataaaaatagtgatgcacaggtaaaggtagttctattgtagaaaatttttgagctacaaggtgctttacaaatactttaacttgtaagaatagaaaattgagaactggaaagataggtaatgtgtccaaaggcattcaaattattaaagagagaagtagggttagaataaacatatactatatcttagagtatgtgttttgggtttatttaattctagaaattaactgatgaacttstttatttgaggatgcccatatggtgggtagttataagaccaaatttcaaatcggactcctactcatcgttatcagtgcctgtgaccttgtgcaaagtactatgcctcagttttctcttgtgaaaacaagacatctggtgtatagtatgtgtgcctcaaatatagctagcttagtcagtaatttggctaaattagttacatatcttgaatttttccaaaatgggttctacactttaaaagcttagaacacacacacatacacacacacgtgtacacacacacacacactcaaaggaagggg

SEQ ID NO: 182846 - DNA, 601 bp, Human
catcaacagtcagttctaatctaatgatgtcatttatcctcaataaataatataaagtcaataaaatataaatatccacaaaatgtgcattataaattatgtagtaagattataatgacaagatgtgcattaaaaaatgttaaacattatcattcggacttaactaatactaattttctattgcttaaaagagaggctcatgataccatctgtgacagaggatttactaattaagttaatagcataaaagacaacaaaataatgaactgtaaggaacaaactgttcccaagatctgaaaawaattacctgcaaaatgactttataatggaatatgttcactaaaattgtgtccttttaatattaaggcagaaaaatttttatatagttttcttttaacatttaaaaatagtacagtgaaatttatttccaactggtaaattctacttttttatttataataatataacacaatggtttttaaactgtgctgtactaatgtttgagataatagcaagaggaaatattatactaccttcccacaaccatttcaaaatagatcagctttacgtgtttcatacattatgatcctttgtaagaatt

SEQ ID NO: 182847 - DNA, 601 bp, Human
gcaaagtgactgtaagaatgtgctcatccgtgcctctgaagacctaggaagccttttttgtcttcagtaattcatctcagtcaaggggattaaaatataaattttgatgattaaaacaacttctctgttttaggaagtaaccacaacaaaaatcacagtctaaataaaagtaatgcaccttccaagttggagaaattatttgaaaacacaaataagactctttaaaaccttgagtttgaaaacctatgttaggaattgagggaagtagaaactgccaggagatttcctacatattttttcrtaccttgatcagtccagaactgctgtaaaaaaataactttcctcttagtatttcaacatatttgctactggttccatccaggactatgtagcccagaggatcagagaaataagaaacatttcactgaaagaaaaaaaaaatgaaacaagttttgcaatatctacaaaaatgtagggcttaaatttacatgggaggctcgagagaattcttttcaatccacatgaatttgttttgtccttgaaatacatacacggcatgggagtactttaatgatttaaaaaaaaaaatggattggggaac

SEQ ID NO: 182848 - DNA, 601 bp, Human
gctagctggttctggcaacttttgccaacctgtaagtttctaggacagcagtggtctgagtcttagcattacccattctgtgacaggaatcctctgggaatccttagacctaacagcatgcaggcatttgttttcatcagcttgaaaaatatccaagactctagagactgacattcaactgcatttttaagtgaagagattttcccaacacttaaaagacctaaagaaggtgcaaagtgactgtaagaatgtgctcatccgtgcctctgaagacctaggaagccttttttgtcttcagtawttcatctcagtcaaggggattaaaatataaattttgatgattaaaacaacttctctgttttaggaagtaaccacaacaaaaatcacagtctaaataaaagtaatgcaccttccaagttggagaaattatttgaaaacacaaataagactctttaaaaccttgagtttgaaaacctatgttaggaattgagggaagtagaaactgccaggagatttcctacatattttttcgtaccttgatcagtccagaactgctgtaaaaaaataactttcctcttagtatttcaacatatttgctact

SEQ ID NO: 182849 - DNA, 601 bp, Human
gccctctttagtcacagcatatttgtgattgtaagtgaactgactgtgttcgtggcattgtaattgcctgtttggctgtctgcaaccatccgaccccactccatatccatcacatatgggtatgcacctgcatgaacacacgtatacatgactgtactgaaatctctgtggacattttatcctaggatagcacatgatggatgcataacaaatatttcatggagccatcatctttttgatagtgaacagcagtaggggaacctagagcagtggatcacaggacatcaccttagataatttrttggaggcagtgcttgctagctggttctggcaacttttgccaacctgtaagtttctaggacagcagtggtctgagtcttagcattacccattctgtgacaggaatcctctgggaatccttagacctaacagcatgcaggcatttgttttcatcagcttgaaaaatatccaagactctagagactgacattcaactgcatttttaagtgaagagattttcccaacacttaaaagacctaaagaaggtgcaaagtgactgtaagaatgtgctcatccgtgcctctgaagacctaggaagcct

SEQ ID NO: 182850 - DNA, 601 bp, Human
cccccagaggccatggctgcttacctgtcccaagtctgccacaagcagcggttctcctttctcttagcatcatgattgctcattattacccccttacgctctaagcttaagcaacagttaaccacttgtagtttcctagcaagacgtgctgagtctcacttctgagctaatccctcttctacccccatctctgaactattccccaactaataccaatttgccacatttatgtcactttaggccactatttggaagctttctcaaccttccaaaactggttagccctctttagtcacagcayatttgtgattgtaagtgaactgactgtgttcgtggcattgtaattgcctgtttggctgtctgcaaccatccgaccccactccatatccatcacatatgggtatgcacctgcatgaacacacgtatacatgactgtactgaaatctctgtggacattttatcctaggatagcacatgatggatgcataacaaatatttcatggagccatcatctttttgatagtgaacagcagtaggggaacctagagcagtggatcacaggacatcaccttagataatttgttggaggcagtgcttgcta

SEQ ID NO: 182851 - DNA, 601 bp, Human
aaactgtagccagttaagagaaatgaacaatgtatgctgtgggacaattttattaatttttttatttacttgccaacaagcaatatagaaattcttgcatatcatttgcagttaaagataaaagagataaagataaaagaaggtagagtttaatagttctagaaaataaatcttatttaagcaacaacaatccagggaacttaaggacatgatactttattagaaatcttagtggcaactgtcattttataccataaacctttggaggcaggatttttgacttgttgctctttgaatttcyggtatctagatcaagaattgccatgtattagtcagctgtgtggattcgcacaaaaaaatcacctgtgttgaatgcacaaaaaaaccttgtcaatatgtcttttatatacctattaagaaatgcttttttttcgagacatgtgccaagcattgtgaagaggttcctgtcctcctagagattacagtctaataatagggaacagcaattacaacccagtgtgatgtgtactctgataaagacatgcccagagcacagtgggaggacatggaaggggctcctaacccaatcaaggacgaagag

SEQ ID NO: 182852 - DNA, 601 bp, Human
aataaaacaactggcatagtgccaggaaaataatagtaacacggtaagtgtatggtggttggctggctggataaagcaatgaaggcagactctgatttcaaaagaactataataacttttaagagagtaattttagtaaagttatgtaggtaaaagcaaaactgtagccagttaagagaaatgaacaatgtatgctgtgggacaattttattaatttttttatttacttgccaacaagcaatatagaaattcttgcatatcatttgcagttaaagataaaagagataaagataaaagaagstagagtttaatagttctagaaaataaatcttatttaagcaacaacaatccagggaacttaaggacatgatactttattagaaatcttagtggcaactgtcattttataccataaacctttggaggcaggatttttgacttgttgctctttgaatttctggtatctagatcaagaattgccatgtattagtcagctgtgtggattcgcacaaaaaaatcacctgtgttgaatgcacaaaaaaaccttgtcaatatgtcttttatatacctattaagaaatgcttttttttcgagacatgtg

SEQ ID NO: 182853 - DNA, 601 bp, Human
cttaaacatatttggatttccttggcatcatgtgtgactgatagagtcagcttccagtgagtgactctctggtctgaccctcttgtggtgcctaaaagaccaggccaatggccatctcagagagtttatgggttttgctttgttaccaaaaattaagtcaggaccttgtaaaacttgtgattgaaattggtgatttttcagtctaaacaaattctcgggaggtagatttgttctcattttttatttgtgtttaaagagcaataagaaactttctttccagcattcccttggggtagatagrgagaggagagggtaagcaaaatgttgaaaaccattgagatgcattgtctgaggtttcttgcaaagagaaaatactttcccttgttgtacttggacattgtgttgctataaggtctgcaaataagcctccagcatgcattagcagattcttctgatgaccaaagtcatcagtgtgcttatttgtctccacaatcagtataagctagagtcgaaaatctttgtcatggattctagccctctgttatatgtagcacagtaaagccctgcatacaagatgtcctctaaatacttgctgtcctct

SEQ ID NO: 182854 - DNA, 601 bp, Human
tgtatatatatgagatctgtgacaatgaaatatttcccaaatttcagaaatacatgctcagtgattatgtttttagttcaaaataagataaatagttattccagtattccttcccttttttaagaatacataaaaaaaaaaaaaactgagtgccaaaatgaatcacgtgacaccaagacccctgtttaaaacacaaacagtcccttaaacatatttggatttccttggcatcatgtgtgactgatagagtcagcttccagtgagtgactctctggtctgaccctcttgtggtgcctaaaakaccaggccaatggccatctcagagagtttatgggttttgctttgttaccaaaaattaagtcaggaccttgtaaaacttgtgattgaaattggtgatttttcagtctaaacaaattctcgggaggtagatttgttctcattttttatttgtgtttaaagagcaataagaaactttctttccagcattcccttggggtagatagagagaggagagggtaagcaaaatgttgaaaaccattgagatgcattgtctgaggtttcttgcaaagagaaaatactttcccttgttgtacttggacat

SEQ ID NO: 182855 - DNA, 601 bp, Human
tgcagtgatagacatgaagcttgcatatgctcaaaactcatgataaatttttcctccaaagaaaatagcaaacccacgtactgttattgttgtgtgcctttcaatagtgctgacagagtgctctctattctgtacatcatatacatatataatatatattatatatgtatgtatatatatgagatctgtgacaatgaaatatttcccaaatttcagaaatacatgctcagtgattatgtttttagttcaaaataagataaatagttattccagtattccttcccttttttaagaatacataaaaaaaaaaaaaactgagtgccaaaatgaatcacgtgacaccaagacccctgtttaaaacacaaacagtcccttaaacatatttggatttccttggcatcatgtgtgactgatagagtcagcttccagtgagtgactctctggtctgaccctcttgtggtgcctaaaagaccaggccaatggccatctcagagagtttatgggttttgctttgttaccaaaaattaagtcaggaccttgtaaaacttgtgattgaaattggtgatttttcagtctaaacaaattctcgggaggtagattt

SEQ ID NO: 182856 - DNA, 601 bp, Human
gtataaattgtactctggatttccatgtaagtttttgataatatacatttttaatgtctccccttcacttacaaacattaatatcttgtagaatttagataaaatgagcttatcaaccttccaggtcttcccaagctcttgacattaggaacagtgttagcagtaatttttgtttcaaaactctggtaaaatacagttcttagtgttttgcagtgatagacatgaagcttgcatatgctcaaaactcatgataaatttttcctccaaagaaaatagcaaacccacgtactgttattgttgygtgcctttcaatagtgctgacagagtgctctctattctgtacatcatatacatatataatatatattatatatgtatgtatatatatgagatctgtgacaatgaaatatttcccaaatttcagaaatacatgctcagtgattatgtttttagttcaaaataagataaatagttattccagtattccttcccttttttaagaatacataaaaaaaaaaaaaactgagtgccaaaatgaatcacgtgacaccaagacccctgtttaaaacacaaacagtcccttaaacatatttggatttcc

SEQ ID NO: 182857 - DNA, 601 bp, Human
gaggccccatatcctttggaagtttttcttattttctatagaggaagcagagtactaaacatgaaggacaagaaaccaaagagttgctttgctgactgactatgtagttaagatctatgttaatttgactctagatggtctgaataaatatccttcaattaaaatgtttatcttttaataaattaaaatttcagacttttgagaaccctacaattttcttgccatcatataatattttgttgaatgaatccaatatatatttgtttggttttcctttctttactcataattgatactggtaaaaaaaaaaaaaaaaaaattcctggaaaaatcatccatgccaacctagcctttaattctcatgactacttgctgaaagctttctttttctcattaaaccttccacaattggtgtcatttgttttaacagggaactggataattgggaatcaccagaatttgtgcataataattttaccattatgttaagaaggaagacattatcttatttgtttcagaagctacagatgtcctgaggtagatatgctattcattttggaatatgtgtaatggaagatgtacacaaaagtgtgaaaaaata

SEQ ID NO: 182858 - DNA, 601 bp, Human
tataaacatatgaccttgatagacatatgtaagtgttctgagagtgataaaaacaatgacatagagatacagctcatgaggacaggcatggaggcaacaagccagagaaattaaagatgaaaaggatcaattttctcaaacccatgaggccccatatcctttggaagtttttcttattttctatagaggaagcagagtactaaacatgaaggacaagaaaccaaagagttgctttgctgactgactatgtagttaagatctatgttaatttgactctagatggtctgaataaatatccttyaattaaaatgtttatcttttaataaattaaaatttcagacttttgagaaccctacaattttcttgccatcatataatattttgttgaatgaatccaatatatatttgtttggttttcctttctttactcataattgatactggtaaaaaaaaaaaaaaaaaaattcctggaaaaatcatccatgccaacctagcctttaattctcatgactacttgctgaaagctttctttttctcattaaaccttccacaattggtgtcatttgttttaacagggaactggataattgggaatcaccag

SEQ ID NO: 182859 - DNA, 601 bp, Human
ataggcatgaattacgggaatgactaagtctaaattacacaggtataaacatatgaccttgatagacatatgtaagtgttctgagagtgataaaaacaatgacatagagatacagctcatgaggacaggcatggaggcaacaagccagagaaattaaagatgaaaaggatcaattttctcaaacccatgaggccccatatcctttggaagtttttcttattttctatagaggaagcagagtactaaacatgaaggacaagaaaccaaagagttgctttgctgactgactatgtagttaagrtctatgttaatttgactctagatggtctgaataaatatccttcaattaaaatgtttatcttttaataaattaaaatttcagacttttgagaaccctacaattttcttgccatcatataatattttgttgaatgaatccaatatatatttgtttggttttcctttctttactcataattgatactggtaaaaaaaaaaaaaaaaaaattcctggaaaaatcatccatgccaacctagcctttaattctcatgactacttgctgaaagctttctttttctcattaaaccttccacaattggt

SEQ ID NO: 182860 - DNA, 601 bp, Human
agacattcagttatatgacaataatctataatccagaaaagaaatgtttgaaagaagtttccaaagaaaagaggatgtgagtaggaagactaaaagaattgataatgtaaagtgtgactaatcaagaattaaggctgtgataaagacttatagatatctaaaaacattttaaaaatatacagatcaagcagatacaggtaatttggtacaaaataagtacgaatgaaagaaataaccctctataaagccattaaccaaaactcttccttttttcctcctcctccacacacacgaaatggaraaataaataagccattggcttctgcaaattaaggctgtgtcatgaccacttgtgtctggaaagacagcatgacatcacagagtttgtagtgtacctgtttgggtttgcaatctagctcttattctttctgatcctcagttgcctcatctgtaaaatacctctatgtcctgccaatattttgtgaagattaaatgaggtgatacccggaaagcccttaaaaagactgctgcatgcaaaataaagtaagtacttgactatttgcaaaaaaattaaagtaatcaaacttccttaagcaataac

SEQ ID NO: 182861 - DNA, 601 bp, Human
caaaacaaaacaaaaaactccagagaatctaatttgatgtgaccaaaaagcagccacgacatagaattatggcatttattctcatccatgtattttctcctaataaagaaaaaaaaatgagtcccttcgacggatgactataaagaatgtcagcatttttattttttcaattagcatatcatgggaaaactgatgtccattgaaattagtcattattctctagtcatctttgataaaagttactccttttcaatcacttttagaaatttcagtaattataaagactaaatcatcacatttyttaatgaatataggacaacagtgagttctattatggaagaacaggcttcaaaatattcctatatatcatccaagagattctagaactttcttttctttaaaatgggcagcccaatctcatgaacccagtttcttactaattttctctacttaagagactcactctcttcacatttttgcatcttcaccatactcaggtggccaagtgtctctttcatgatccaaggcagtgggagttgtttgtatgacaaattgaagtttggcctcaacccttttaaacagtagacagactcgcagatat

SEQ ID NO: 182862 - DNA, 601 bp, Human
gatacttagtagcacttgtaatttacatgaagtagtattcatccccccatgtttatatccttagcatgtcacagaggagcggcttatgctcttctaaggaagagacacacagtctcttgcactgggagataaagatgaaatgtcataaaaatcatttcttctaaacaatattttaaaaactttgcacatgaggacaactgtacttctgtggaatcccagaaggactctgggagaaactatgcagtccagagaaggtctcctgcacagttcaggggctcattctttcttagcagctctttasctagctcagagtcccaatttttggcccaaagccaacgaccacagctagttatttgatacaggtaaattaaggaccagtcactcattagtgccaagtatttctgtaattagatttaaaaaaaaaaaacttctttgagttgaggctcaaacagaacatttggatgattctttttaacactggttctggctaatatctagtccttatgtgtaattaactatcatctgtggctttctctatgaagctaataattgttccaaatagactttcagtttatcaaagaaaaatcaatatacaggatgg

SEQ ID NO: 182863 - DNA, 601 bp, Human
taggtatataggtataggtattaggattacaatataatccacatttctttcctgacctttccccgtatgaatgttatcaatgctatgttaggctatcagtaaagagacatctttccagatctatttaagacttggaggtcagtttctagtcttggcagttcttctctggattatcaaagaagacttacaactagtctccctgccttgagtttcacttcttcttccccttccccatgaagtccatgcagctcattcaaaaacatgcatctcatcattcctctattctggttaaagttgctcrgttgttcctccaaaattcaaagataaagtccaaattttttactgtgatttgcaaggcctttgaagtctagtcctttactgtctactttttcccatgtctcacccaccctaaccctcccatatcttgttattttctgcacgtacacatagtgctccagccttacccactcacttattccctctaagcaacactcttatttctccatacatttgcaagtaccatcccctcttcctagaaggtactctccaggtttgaacagctgctgaactcctatccatcctttaagatttgttccaagta

SEQ ID NO: 182864 - DNA, 601 bp, Human
tccaaaattaagtagctacgtctctcctagcgtgaaatctgctctactgggcctgggagagtttagcccataggcgctcttgaatgagcaatggcaattttaactctgattttttgtttctctgtgatttgtaatggccttcctttttacggtaagtcaatgccattttctccgcagtagctttaagctcactaataaagacagactttccaggatgtaatgattttctatagtgtctttgcagggaattcagcacaaatgtttgattttaaataagagactgctatgtgcttgaatacayagtttatacttttaccctttcacataagatttacaatctaagtctcataatttataattatttatttgtgtaatcaaggcaatacaaatgcatgattataaatttgagaagaaaagcaaaaagaagaaataaaaatcaacccaaatctcatcactgagtataactactcttttcatattaacaatttttagtattttacttgtttctcccctctaaatataaaatattatttatttttaaatatatacgtatctgaacacattcttataaaatttttgaacactataagtaaagcttctg

SEQ ID NO: 182865 - DNA, 601 bp, Human
attccaaaattaagtagctacgtctctcctagcgtgaaatctgctctactgggcctgggagagtttagcccataggcgctcttgaatgagcaatggcaattttaactctgattttttgtttctctgtgatttgtaatggccttcctttttacggtaagtcaatgccattttctccgcagtagctttaagctcactaataaagacagactttccaggatgtaatgattttctatagtgtctttgcagggaattcagcacaaatgtttgattttaaataagagactgctatgtgcttgaatayatagtttatacttttaccctttcacataagatttacaatctaagtctcataatttataattatttatttgtgtaatcaaggcaatacaaatgcatgattataaatttgagaagaaaagcaaaaagaagaaataaaaatcaacccaaatctcatcactgagtataactactcttttcatattaacaatttttagtattttacttgtttctcccctctaaatataaaatattatttatttttaaatatatacgtatctgaacacattcttataaaatttttgaacactataagtaaagcttc

SEQ ID NO: 182866 - DNA, 601 bp, Human
tgggtttattgtattaatacaggtattaacctctaaacataaacgctttttacaatgtcaattcagcatgtcactcccttaatccattaatatctaatagtgcagatgtactaaacattattaatagcaataaaaggaggaagtttcattgattggggatttcctctgtgccaggcactatgttaaatgatttccagtgtttatttgattaaatttttatattaaatctgtgatccagacattaatatccccaatttgtatactaaggtttagggaagctatgtaagctggaatttagctkgtatgagtctaaaactcaagctttgaatcattatgcattccctggacaaatatttgctgagcacaaactacataccagttattgatctaggcacttaagatatataagaaaagaaaacaaaaatctgtgcttttgagggacttgtattctagaggtatccctaaaattaaattcaaaatcccatctgtttaatatggcattcttcgaagaacctctcttactatctagaaacatttcttatataaaacttgcattaacctagatcagtggccctctaatggatgtgcatataacaaatca

SEQ ID NO: 182867 - DNA, 601 bp, Human
atacaacctgaagtcaaaaagaaaaaaaagaaagataagccattcgacagaataacagaacccagaagaccagcttgttgaatgtttgcctttttcatcattttcttctttctttgaactcagcccttccaacaaacctctaggagacccaagctatctgaaccaaaagaacaaaggaaggaaaaagtttatttcattatgcatgctcaaactcatgtggttctctgatactgcaggatccagaaaacataaaaacttgggtttattgtattaatacaggtattaacctctaaacataaaygctttttacaatgtcaattcagcatgtcactcccttaatccattaatatctaatagtgcagatgtactaaacattattaatagcaataaaaggaggaagtttcattgattggggatttcctctgtgccaggcactatgttaaatgatttccagtgtttatttgattaaatttttatattaaatctgtgatccagacattaatatccccaatttgtatactaaggtttagggaagctatgtaagctggaatttagctggtatgagtctaaaactcaagctttgaatcattatgcattccct

SEQ ID NO: 182868 - DNA, 601 bp, Human
aggcaagaagagcaaaactcagtttcaaaaaaaaaaaaaaaaaaaaaaaaggaagtagataaaaaactcataaaattaaaacaaactaacattatttaattttaggtatgtgccattgcttaaccaaggctctgagactatggataagggttttttgttgttgttattgttgttgttttttgttgtttgtttgttttgccaagaagcatcattggtaagtgatgcattacatcactgaagaagtattacagaaatgagagcaccaaattgagaatttctctgtggggctatcagaaggctrgaaaaatatttaaaatgtacaaaaggattaactttcttactctatgatatgatactatttaatggtatctcctatactagctaaaatatcttgcaatgattaatattatgtaatgcaaaactctggtatagctggtctgaactgtgttacctttggtttaactacacctctttatttttcttatctcatttcaacaaaatgatcaattaacttactacataattgcgaagtattttataagaagtaattgctgtatatgctgagttcccaaactattgttcattttactaaggatatcaa

SEQ ID NO: 182869 - DNA, 601 bp, Human
ctgaggcaggagaatcgcttgaacccaggaggtggaggctgcagtgagccgagacagcaccactgcactccagcctaggcaagaagagcaaaactcagtttcaaaaaaaaaaaaaaaaaaaaaaaaggaagtagataaaaaactcataaaattaaaacaaactaacattatttaattttaggtatgtgccattgcttaaccaaggctctgagactatggataagggttttttgttgttgttattgttgttgttttttgttgtttgtttgttttgccaagaagcatcattggtaagtgatgyattacatcactgaagaagtattacagaaatgagagcaccaaattgagaatttctctgtggggctatcagaaggctggaaaaatatttaaaatgtacaaaaggattaactttcttactctatgatatgatactatttaatggtatctcctatactagctaaaatatcttgcaatgattaatattatgtaatgcaaaactctggtatagctggtctgaactgtgttacctttggtttaactacacctctttatttttcttatctcatttcaacaaaatgatcaattaacttactacataatt

SEQ ID NO: 182870 - DNA, 601 bp, Human
taacagaataagacagaaagtatatcagaacaattgaaggtggtagtgattattacagtaagagagaagcagcactaaaactgtgagaggagaaacactgaaataggaatttctcttacaattttgtttgttgtcaactcctttcctgccagagcctataacattcttgagtgatatcatttgccattgggttttatcttagtgtttcccaaacttcagacagtcatgtatcaacttcacagttttgccatatccatttataactcttattaatatgtaacaattttttctttaaatctaytatttgttaaatacagaatattgtgaatgcattctaaaatgcaagtttatatcattcatttaaagaggaaatcagcatcatttgctgtaacagaagttagatatagccaggtgccatggtggctcatgcctctaatcccagcactttgggagagcaaggtgggcggatcacttgaggtccggagttcaagaccagcctggccaacatggtgaaaccccgtctttactaaaaatagaaaaattagccgggcgtggtggtgggcacctgtaatcccaactactcgggaggctgaggcaggag

SEQ ID NO: 182871 - DNA, 601 bp, Human
gtacaacatagagatgagtttctctccctgctatctcacagagtggatctggagttcaagtaagatagtacaacatgtgcagaaacacgtaatatgttttaataatggtagtaacgtagtgttgggaaaggaaaatattagatttgaacaattttttccttgctaatatgaaatcatgttttgtaacagaataagacagaaagtatatcagaacaattgaaggtggtagtgattattacagtaagagagaagcagcactaaaactgtgagaggagaaacactgaaataggaatttctcttrcaattttgtttgttgtcaactcctttcctgccagagcctataacattcttgagtgatatcatttgccattgggttttatcttagtgtttcccaaacttcagacagtcatgtatcaacttcacagttttgccatatccatttataactcttattaatatgtaacaattttttctttaaatctattatttgttaaatacagaatattgtgaatgcattctaaaatgcaagtttatatcattcatttaaagaggaaatcagcatcatttgctgtaacagaagttagatatagccaggtgccat

SEQ ID NO: 182872 - DNA, 601 bp, Human
attgcactccagcctgggcaacagagtgagacttggtctcaaaaaaatgataatcatcatcatccaaaactttcacctatactctaccaagctctattcgtggatgaagataacatcaacctaatgatttatttatttggttttaaaatttgaaagttatttcaagagttaaaagatggtaattcatgtactatgctcattcatgtacactactacttcactaattcaggtactacattttctaataagtttctatgtgtcacagtcagctgtgctagatgtttgggatgaaatggcaaaygctagctgtcattcattttcctcatgtacaacatagagatgagtttctctccctgctatctcacagagtggatctggagttcaagtaagatagtacaacatgtgcagaaacacgtaatatgttttaataatggtagtaacgtagtgttgggaaaggaaaatattagatttgaacaattttttccttgctaatatgaaatcatgttttgtaacagaataagacagaaagtatatcagaacaattgaaggtggtagtgattattacagtaagagagaagcagcactaaaactgtgagaggag

SEQ ID NO: 182873 - DNA, 601 bp, Human
aaatacaaaaattagccaggcatggtggcacgcacctgtagtcccagctactcaggaggctgaggcaagataatcacttgaaccagggaggcggaggttacagtgagcctagattgcgccattgcactccagcctgggcaacagagtgagacttggtctcaaaaaaatgataatcatcatcatccaaaactttcacctatactctaccaagctctattcgtggatgaagataacatcaacctaatgatttatttatttggttttaaaatttgaaagttatttcaagagttaaaagatggtmattcatgtactatgctcattcatgtacactactacttcactaattcaggtactacattttctaataagtttctatgtgtcacagtcagctgtgctagatgtttgggatgaaatggcaaacgctagctgtcattcattttcctcatgtacaacatagagatgagtttctctccctgctatctcacagagtggatctggagttcaagtaagatagtacaacatgtgcagaaacacgtaatatgttttaataatggtagtaacgtagtgttgggaaaggaaaatattagatttgaacaatttt

SEQ ID NO: 182874 - DNA, 601 bp, Human
tgtgtaccatttaaaaaaaaaatattagatttgtagcaactagttttgggggtgagggctgagggaggagtcataaaattacatataggagactttttaatatttgatgatgttaaatatgatgccaaaaggatagttcaaagattaaggaaaagaacatgaagccgggcacggtggctcacacctgtaatcccagcactttgggaggccgaggcggtcggatcatgaggtcaggagattcagaccatcctggctaacacagtgaaaccctgtctctagtaaaaatacaaaaaattagccrggcgtggtggcaggtgcctgcagtcccagcaacttgggaggctgaggcaggagaatggcaagaaccctggaagtggagcttgcagtgagccaagatcgtgtcactgcactccagcctgggtgacagagcaagactccgtctaaaaaaaaaaaaagaaagaaagaaagaatatgatagaatatgatagaggcagaatcataataggttagttttgataatattggggctggtatcatattgaaaagatatcaacataggtggcatggatggggtcaatgggctgtgatttggtgataatag

SEQ ID NO: 182875 - DNA, 601 bp, Human
gttgctgacaatttcatttatgagatcagggaagtaataaaaataaaaattttctatcaggaaaaagctcaagacctaccttgtgtgtaccatttaaaaaaaaaatattagatttgtagcaactagttttgggggtgagggctgagggaggagtcataaaattacatataggagactttttaatatttgatgatgttaaatatgatgccaaaaggatagttcaaagattaaggaaaagaacatgaagccgggcacggtggctcacacctgtaatcccagcactttgggaggccgaggcggycggatcatgaggtcaggagattcagaccatcctggctaacacagtgaaaccctgtctctagtaaaaatacaaaaaattagccgggcgtggtggcaggtgcctgcagtcccagcaacttgggaggctgaggcaggagaatggcaagaaccctggaagtggagcttgcagtgagccaagatcgtgtcactgcactccagcctgggtgacagagcaagactccgtctaaaaaaaaaaaaagaaagaaagaaagaatatgatagaatatgatagaggcagaatcataataggttagttttgata

SEQ ID NO: 182876 - DNA, 601 bp, Human
aactaggatagttagtgggcaataaatcttattttactcttaatcccttttagaagaaacaaaggaaaaatatataaataaacaagataaaacaaagctttaattgatgatgacaaagagctatgagttactagctccaaagagtatgaagtctcactgcttaagagagggtattttaaataggcaacaggctcaaatactaagtttaaaaagaaaaaaaaggaaaggaaaaatcattagatgaggaaaatggctctaagggaaattttgacagagaataagtagtagtggtggggagtarctaagtaggacctaagttccaggcaatactccagttacctggactgtcaatgacattcatccttatgttctccagttcttagctatctaaattccacattttagctttccataataaatagctttgcaagacctggattctttcaaagggacatttgataaggtaatggcgtttattacaaaaacacatttacttagactattccagcccaagcaataagcggaaatattctctcccaaacatatgtgtttattggtgagtaagaattgggtccaagaataattatggatgaaagaacat

SEQ ID NO: 182877 - DNA, 601 bp, Human
tgcagttcagtcttttggggtttggttattcttaagttagtttcagtctttgatagtcatctctttgttccatgctggtgcatataaatacatgtatgtattaggcattttaaatataagttcatgcaagaatcacgtttatactaacattcatttatgtcttttcaccagaataatttgtaattttgccatgtcctttcagagtctctgctaacatttactcactaaaccaatatttattgaacatatgctatctgccacacactatggcagccactggggatacagtagtggacagcayaaaatccctgcattcacagaacttacatttgtgtagaataggcttacgttttatgtactaaatatagaaattgggttgaaataaaagtagtgcaatgtagatttctatagtcaatcttacattagtcatatggatcttcttttctctcaatatttttaccttgaaacagagaattttagttatctgatcatgcttagcaggtctttcttgggttcccaaaaatgctaagacaattatattttcccaaagatcttgtcacttcaaggtcatacaccagttgaaaaaactgctagcttctat

SEQ ID NO: 182878 - DNA, 601 bp, Human
aagaaatgaaactttgcccgagaaaataggaatgtaatcttaaactttgcattttaggaagctcaaatttatttgacagtcaggaacctaacactcaaatttttataattctgcagttcagtcttttggggtttggttattcttaagttagtttcagtctttgatagtcatctctttgttccatgctggtgcatataaatacatgtatgtattaggcattttaaatataagttcatgcaagaatcacgtttatactaacattcatttatgtcttttcaccagaataatttgtaattttgcmatgtcctttcagagtctctgctaacatttactcactaaaccaatatttattgaacatatgctatctgccacacactatggcagccactggggatacagtagtggacagcacaaaatccctgcattcacagaacttacatttgtgtagaataggcttacgttttatgtactaaatatagaaattgggttgaaataaaagtagtgcaatgtagatttctatagtcaatcttacattagtcatatggatcttcttttctctcaatatttttaccttgaaacagagaattttagttatctgatc

SEQ ID NO: 182879 - DNA, 601 bp, Human
cattttctgatactctttgctctttttctaagaaatgaaactttgcccgagaaaataggaatgtaatcttaaactttgcattttaggaagctcaaatttatttgacagtcaggaacctaacactcaaatttttataattctgcagttcagtcttttggggtttggttattcttaagttagtttcagtctttgatagtcatctctttgttccatgctggtgcatataaatacatgtatgtattaggcattttaaatataagttcatgcaagaatcacgtttatactaacattcatttatgtmttttcaccagaataatttgtaattttgccatgtcctttcagagtctctgctaacatttactcactaaaccaatatttattgaacatatgctatctgccacacactatggcagccactggggatacagtagtggacagcacaaaatccctgcattcacagaacttacatttgtgtagaataggcttacgttttatgtactaaatatagaaattgggttgaaataaaagtagtgcaatgtagatttctatagtcaatcttacattagtcatatggatcttcttttctctcaatatttttacc

SEQ ID NO: 182880 - DNA, 601 bp, Human
gaaagagctcaataagtttttaaatattattactgagtacaatacaaaattaattggttatttctcatccactgtcaattattaagctttggttgtagccttgcacgagaggactatcggttctgattcacctttttccaaacttataaaagacattttctgatactctttgctctttttctaagaaatgaaactttgcccgagaaaataggaatgtaatcttaaactttgcattttaggaagctcaaatttatttgacagtcaggaacctaacactcaaatttttataattctgcagttyagtcttttggggtttggttattcttaagttagtttcagtctttgatagtcatctctttgttccatgctggtgcatataaatacatgtatgtattaggcattttaaatataagttcatgcaagaatcacgtttatactaacattcatttatgtcttttcaccagaataatttgtaattttgccatgtcctttcagagtctctgctaacatttactcactaaaccaatatttattgaacatatgctatctgccacacactatggcagccactggggatacagtagtggacagcacaaaatcc

SEQ ID NO: 182881 - DNA, 601 bp, Human
cctctcttctccctcatacttcattttgcttttaaccatgtttaaatgaggaaatgcttgcaaaaagatgctgcaaacggtacaatagagctctgtcattctctttgaatgtcatcccttttaatggaggcagtagaaagagtagatagaacaaaggcctctggaggttgagtacctgcatttaaattctacttctgacaaaattctgtgacctatggcaaattatctaacttttctgtatctcagttcttgccaaaagtattattgtagtctgtatttccaagagtttttggaagcttcrtatatgttattaaatataaatcatttagaataatataaacgtatccattagaaagagctcaataagtttttaaatattattactgagtacaatacaaaattaattggttatttctcatccactgtcaattattaagctttggttgtagccttgcacgagaggactatcggttctgattcacctttttccaaacttataaaagacattttctgatactctttgctctttttctaagaaatgaaactttgcccgagaaaataggaatgtaatcttaaactttgcattttaggaagctcaaat

SEQ ID NO: 182882 - DNA, 601 bp, Human
tttgtttcttttttgtttgtttgtttgtttgtttgtttttgactgttctttctttctctctctctctctctctctttctttctttcctttctttcctttcttctttctttcttttcctttctcttctttttgttctaaagatgaaaagttgtttatcctggctaggaatatcaaattcacttaaaacttctaggtattcttttacctcctctcttctccctcatacttcattttgcttttaaccatgtttaaatgaggaaatgcttgcaaaaagatgctgcaaacggtacaatagagctcygtcattctctttgaatgtcatcccttttaatggaggcagtagaaagagtagatagaacaaaggcctctggaggttgagtacctgcatttaaattctacttctgacaaaattctgtgacctatggcaaattatctaacttttctgtatctcagttcttgccaaaagtattattgtagtctgtatttccaagagtttttggaagcttcatatatgttattaaatataaatcatttagaataatataaacgtatccattagaaagagctcaataagtttttaaatattattactgagtacaat

SEQ ID NO: 182883 - DNA, 601 bp, Human
aagatgttctatgaatatacagaagagtatgcctgagtttacagttcctctctgataagattctgaatagctgaattatatattctgtgcaatcctgggaaaacactgactttgtattttgtttatgcttgggaataacaaataagaaatatcctagagcaattcatttagggaaggcacttcaagcctgaaagaactcaatgatgcaagcaaaggattgaaaaaaaagttaccctctgctattgggacaactgataaaatgtctcaaatgtttttttgttttgttttgttctgttttttkttttgttttgttttgttttttttgagatggagtctcactctgtcacccaggctggagtgcagtggcacaatcttggctcaccgcaacctccgcctctcgggttcaagccattctcctgcctcagcctcctgagtagctaggactacaggcatccgctaccacgcctggctaatttttgtattttttttagtagaggtggggttttgccatgttggccaggctggtctcgaactcctgacctcaggtgatcgaatcacctcggcctcccaaagtgctgagattacaggcgtgagccaccgc

SEQ ID NO: 182884 - DNA, 601 bp, Human
aaaaataaacaggagggaaaacataaaggtttttattacacctttagacattttcttttgggcaatgggaagcctggagagcgccggagcagaagttagaagacccagacttttcatgcttacttcatcaataaataaccaagagatcctacacaatagtaccaatagtatttgatatttattgaatcgttcatatgaaggtatttatatgcattttctcattttatcccccaaacagccttaagtgatgtggcaagtaccataataaagatactaatgctcacagagtttaaggaactgyttaaggtcacattcataatacatagattctaagagctaaccaaccattttcacagcacagttataagaatcaaataagataatgcactattacagcctgtaaaatcctactaaagtgccagctgtaagttatctagaaaatggggcagaatgtttaggccagaaaaaaaagagacaagaccttgtggagcatcacagtaatttaataataaagacaaggtcatcagtgccaacatattttcttatttgcttagtggggtttattagagaaatatgaaaataattagacccaaataagtac

SEQ ID NO: 182885 - DNA, 601 bp, Human
agaaagtcacaggagtcccagaggagtgcggaaagacagacgtctgttgcaacaacagcctggcaataaagagcacaggctaaaggatacgctcattgggaaactttgggaaaacttaggaaagagacaagaaacagtaagagcctgtgagagagtcaggtaaattgatcttgtgtagctttttgaaggaataaagtggggtaatgtttgcaatgagtagaatggcattttggagacattgaaggaaggccagtatggctgggtcacaatcaacgagggggatagtcacctgaagctaagwgggtctgaagcaaatcacccagtgttttgttcatcatcctaaaaacaatggaaagccatggtttgtatattggcccatctcctgtacttagtaggacacctaacgaagtttgcttcccaaatgaccggcgggtcactgcaggcttgttaactgattgactctctgattggttctccttgtgaagtctttgttgtctgaagttgtttagcttactaaaatgctgtatttgatagataccccaaaatgtaacacctgtccttattgtattcatttttttctttatgtatccattcaatatat

SEQ ID NO: 182886 - DNA, 601 bp, Human; identical to SEQ ID NO: 20878

SEQ ID NO: 182887 - DNA, 601 bp, Human
aagattacaggcagtggattgagacaggttgtggctttttttttttttttttggtgggggggagataatgtggagggtggcaaaagtgaatgaggggagacccgctcaggggaacattgttgtaatccactgaaggatttgaagacaagataccttctctctccactgaggacttcagaatgtttaactgtattcacttttagagggttcaggacttggggaagggaaagaatgattcgattctatttgtacccttcacagggtagtcgtaactaccctcgaggcagtcctgaagtacatrgcagaggctcttttgcaaaaatttgttttggcttttcaaatttatccttttgtaaggtcatctatttcagaatatcttttattgaaatatagttacagggagggatcactttcatatttattttgttctcacagttctttgaaagacagtggatgaaaatgctattcattgtatagatgggaacctggagctagagaaacacgtaaagtgatttggctgagtccggagtaactgccacagttttctgactgctgatgtattcctgctgattacctacacagtactaaccacagtcacatc

SEQ ID NO: 182888 - DNA, 601 bp, Human
aatatagttacagggagggatcactttcatatttattttgttctcacagttctttgaaagacagtggatgaaaatgctattcattgtatagatgggaacctggagctagagaaacacgtaaagtgatttggctgagtccggagtaactgccacagttttctgactgctgatgtattcctgctgattacctacacagtactaaccacagtcacatctagagaaaagggcgagttttttgaagtgcacagtagtctttgattcagcatttttttttggggggggggaacttctccctgaagaktcagcacttttgatgaactttttctagtagaacagcttcaaaggaattggcagtggtgggctatgtcttatctataatcttggatagagctgttcaatttacagttcatctggaggaaataatgaacaataaggtgaactgaaagtgctcaggttgtcaatcacagttctttggcaaaaagtgagtctcaaattatgctgaagactgagcctcagggttctgtctcagaagtcctggatctttttctcttttggtataccttgtagggactagataaaatctaaagaaacagtactcagg

SEQ ID NO: 182889 - DNA, 601 bp, Human
atctaaaatgtggggtgtgtgtgtgtgtgtctgtgtgagtatgtgtgtgtatttgaaaataaaatgctaggtaagtgatgttttatagaaagggatcgatggatcttctaagatattttaaacagactatcaatgaataggaagttgtaaattaaggcgtgttaacaggtggtttaactttaccatgaaaggttttccttttgaatcagcccatagtttagtgtttctatgtgggtgctattggcagtttggaggtctgtttcgcccctacccactaaatgctgattagcgatctccacaytgggacaacccaaaatgctcccatacatttccagactcctcctggaggagagaggcaccatttggtgcaaaacatgcatgtggtgtcagtttatttgttggacaaatattaagatgttgaggatacagaggttaaaagtaatattttaataaactgcatataatggaattcaagtaatttaaaatctagtgtttgatgttttaatgtaactcctttagtgtaaaattactgaaactatatcctaatatttctttgaggcacttgtcttttgtaaaactgcatgaataactcaaatagagt

SEQ ID NO: 182890 - DNA, 601 bp, Human
agactatcaatgaataggaagttgtaaattaaggcgtgttaacaggtggtttaactttaccatgaaaggttttccttttgaatcagcccatagtttagtgtttctatgtgggtgctattggcagtttggaggtctgtttcgcccctacccactaaatgctgattagcgatctccacattgggacaacccaaaatgctcccatacatttccagactcctcctggaggagagaggcaccatttggtgcaaaacatgcatgtggtgtcagtttatttgttggacaaatattaagatgttgaggwtacagaggttaaaagtaatattttaataaactgcatataatggaattcaagtaatttaaaatctagtgtttgatgttttaatgtaactcctttagtgtaaaattactgaaactatatcctaatatttctttgaggcacttgtcttttgtaaaactgcatgaataactcaaatagagtccccttaatcccaataaaatgtagtcactaaatgtctttgggcaactaatttcaccagctgttccctcatttgcaagtgggggtggtgataacacatcttgtgagggaattaaatacaaaatt

SEQ ID NO: 182891 - DNA, 601 bp, Human
tcactgggcacaacatgtggtacatattcagtgatagttgttaccagtaaacagaatctcaagcttacttagggtcatgagttggagaaaactaatcttaaagtctttaagttggtgaatttcaggccaaaatacattgtattggagatatcagcaccttctagcagaatgtggtaccgtggtccagtcactattataaattgccagccatgaagaaaagggaagtcatgttttgggagccatgagtgtagattcagggaatcccctggcatggaaggaattatttgcccactgggtcacygctgagttgcctgtgcagaggaggagtctctagaagctgagaaggttttggtgattacttgcagtaatgggtgtacgacagggccctcctggccatgtctgccaattcagtagctttaccagaagttactagaaattttccaacattgtattatgtattacatccccagcccccactccacaatgtcacagtgtgtttccagtttttgtgataggtatctgtgtgaaagtaaggctttgcttttacagattgctttctaggcaaatgtggaataaaaaaattgtagttgataaaatgagt

SEQ ID NO: 182892 - DNA, 601 bp, Human
atagccttcaagagtattgccatttcttgtaacattaaatatactgtataatcatagaaatgcctgtcttgttacagtggttctgaaatttgggtgaattacctgagggacttaaaataggaaaaaagaatcctgggcctcacctagtataggttcaggtagtgagtataggagcagaagaggatcctggatattgtaatccaatcctctcattttacaagtgaagacatttatgcagacaattatatgcagaactgggattagattccaagtcttcatatcctcagcgcagtgctctggygattacattgtgcttcctgaaattgacatttgggttttctttgactatgattcccagtgaggtaaaagggccgtttaccaactttgatcacatcttcagaagtagctacaattaaccagctttgcccttctcttttgtatgaactccagggctctttgttatgatgccatttaatggtctctaaacttttcagtgttttcaaatatgaggatactgccctaataaggatgcggtgggacatttttttgtttgtgtttacatgtaataatttattatttaaaaattaggaaaaaaatatac

SEQ ID NO: 182893 - DNA, 601 bp, Human
tatgcagacaattatatgcagaactgggattagattccaagtcttcatatcctcagcgcagtgctctggcgattacattgtgcttcctgaaattgacatttgggttttctttgactatgattcccagtgaggtaaaagggccgtttaccaactttgatcacatcttcagaagtagctacaattaaccagctttgcccttctcttttgtatgaactccagggctctttgttatgatgccatttaatggtctctaaacttttcagtgttttcaaatatgaggatactgccctaataaggatgyggtgggacatttttttgtttgtgtttacatgtaataatttattatttaaaaattaggaaaaaaatatacagaaaggatgaaaacaaacattcataatcactcccaagagataattgttgacagtttttttttttataatttaatgtttatacctatgcatatccttattttctttcttaagatcggcatagctaggccaaaggatatgcacattttgtgggttttgataaatattgccaaattgtgttccagaaattgtctatcttttgttctttcttccttccttccttcttttctctc

SEQ ID NO: 182894 - DNA, 601 bp, Human
aaaagggccgtttaccaactttgatcacatcttcagaagtagctacaattaaccagctttgcccttctcttttgtatgaactccagggctctttgttatgatgccatttaatggtctctaaacttttcagtgttttcaaatatgaggatactgccctaataaggatgcggtgggacatttttttgtttgtgtttacatgtaataatttattatttaaaaattaggaaaaaaatatacagaaaggatgaaaacaaacattcataatcactcccaagagataattgttgacagtttttttttwtataatttaatgtttatacctatgcatatccttattttctttcttaagatcggcatagctaggccaaaggatatgcacattttgtgggttttgataaatattgccaaattgtgttccagaaattgtctatcttttgttctttcttccttccttccttcttttctctctctctctcttctttttttttttcaagaccctctgtcacccaggctggagtgagaggcgtgatcttggctcactgcaacctctgcctcctgggttcaagcgattctcttgcctcagcctcccaagtagctgaga

SEQ ID NO: 182895 - DNA, 601 bp, Human
acagacatccaaactatatcactatccaaagtaaaacacagtgagaaaaacaactgagaaaaatgaatgaaagctcagtgacctgtggagcagtatcaagtggtttaacatacatgtgatcttgtttcaaaagaaggaagtgaaggcaaaaaaaattgaggaaaaataatggctgaaaacatttcaaatttgatgaaaactatgaatggatccaagaaactcaacaaactcgaagcagagtaaatacttgtgaccttgggataggcaggtttttcacatgctacagaaagcatatattgtaaaaaaaaacaaaaaacaaaaaacaaaaaaaacccaaaaactgataaatcggacattggcagaattgcaaacttcttttcaaaagcatcattaagtcaagccacagaatgagagaaaatatgtaaatatgtatatatatttcacaaggaaattgtgtcaagatcatataaaaattttgtgcaactcaataagtgaatccagttttttaaaaactgggcaaaagacttgaatagaaaatatacaaatggcaaataacatgaagagctcctgaacttcattagtccgcatggaaatgcatcat

SEQ ID NO: 182896 - DNA, 601 bp, Human
ttatccaagagaaaaatatatcttcacaaaaagctttgtagaggaatgttcatagaatctctattcttagtggtcccaaaccagtagtaacaatccaaatgttcatcaactggtgaatgtatgaacagactatagtagatgtatgtggtagaatactaagtaataaaacagattgaactactaatacatacaacacggacagatatcaaagacttgctgagcaaaagccaggtacaaaagagtatctaatgcatgcttccatttacaaggaaattctagatcaggcaaaactaatctatartaacagaaagcagaccaacatttgcccagggctggcagtgagatagggattgactggactgagtgtgagggaaggtttggggatgatagaagtgtccttaatcttggttttgacagtgctcacacaggtgtatacatttgtcaaaaactcatcaaactcttacaatgggtgcatttaattctatataaattatattttaataaagttgattttatagaaaaaacgggaagtgagggaagctaaccaactataatccaggtgcttgatgttatctcatttaatcctcacagtaatttttat

SEQ ID NO: 182897 - DNA, 601 bp, Human
aacaatccaaatgttcatcaactggtgaatgtatgaacagactatagtagatgtatgtggtagaatactaagtaataaaacagattgaactactaatacatacaacacggacagatatcaaagacttgctgagcaaaagccaggtacaaaagagtatctaatgcatgcttccatttacaaggaaattctagatcaggcaaaactaatctatagtaacagaaagcagaccaacatttgcccagggctggcagtgagatagggattgactggactgagtgtgagggaaggtttggggatgatrgaagtgtccttaatcttggttttgacagtgctcacacaggtgtatacatttgtcaaaaactcatcaaactcttacaatgggtgcatttaattctatataaattatattttaataaagttgattttatagaaaaaacgggaagtgagggaagctaaccaactataatccaggtgcttgatgttatctcatttaatcctcacagtaatttttattgaagaatattcagcaaatatcttctgagattctaccatgctggtctctgtgccaggtactgaggataaagtggtgagcaaaaactat

SEQ ID NO: 182898 - DNA, 601 bp, Human
tagaaaaaacgggaagtgagggaagctaaccaactataatccaggtgcttgatgttatctcatttaatcctcacagtaatttttattgaagaatattcagcaaatatcttctgagattctaccatgctggtctctgtgccaggtactgaggataaagtggtgagcaaaaactatcatgatttccacttaccgtcctgggcagtttatttgaaagacagatactagtaaaaagtgctcccccacccccagagaaatactacaaagaaggttctatgagagcatataatacattcatccttarcatataatatatgctgtcatatgatatataatgagacacatactacataatataccttgtataatatataagatgctttatgtgccctggtttctttgtaactactacccctctaatggggtttctctaactactaagtgagttaatacacgtgaagtgttttgacttgtgctagtagataggaagtgcccagtaagtgttggctgctatgaacatttgacagttctaattgtctaatactgcaggggtacacctatactaactcagggaacagtggagtaggactacatattggggaag

SEQ ID NO: 182899 - DNA, 601 bp, Human
caagaaaggtgctatacacacacattcacacacacgcagaaagagaagaaggacatagacctggatctgagccttgagaaactacgatttaatcagggtgcctttttgatcatcatctcctctgtttagcatatgattttgctacatttaggcctgacttccttcgtattcaagataaaataaagggaaataattacgagtaaaaacaagcagtggagaaggtggtgtcaggttcttggcaagttgataacaaatggccactaattttgacaatttgtttccttgcagctgagagaaaaagggaaatatgtttagcaatatggattccattttccgatgaataaagacatacatattcatctgcaaagataaattttgtttgaaactaaacttaaattgttcttaaatttcaaggataatttttttttttttttttgagatgaagtcttggtctgtcacccaggctagggtgcagtggctccatcttggctcactgcaacctttgcctccagggttcaagtgattctcttgcctcagcctcccgagtagctgggattacaggcgcatgccaccatgcctggctaatttttttgtattttta

SEQ ID NO: 182900 - DNA, 601 bp, Human
tagacctggatctgagccttgagaaactacgatttaatcagggtgcctttttgatcatcatctcctctgtttagcatatgattttgctacatttaggcctgacttccttcgtattcaagataaaataaagggaaataattacgagtaaaaacaagcagtggagaaggtggtgtcaggttcttggcaagttgataacaaatggccactaattttgacaatttgtttccttgcagctgagagaaaaagggaaatatgtttagcaatatggattccattttccgatgaataaagacatacataytcatctgcaaagataaattttgtttgaaactaaacttaaattgttcttaaatttcaaggataatttttttttttttttttgagatgaagtcttggtctgtcacccaggctagggtgcagtggctccatcttggctcactgcaacctttgcctccagggttcaagtgattctcttgcctcagcctcccgagtagctgggattacaggcgcatgccaccatgcctggctaatttttttgtatttttagtaaagacatggttttgtcatgttgggcaggcaggtcttgaactcttgatctcag

SEQ ID NO: 182901 - DNA, 601 bp, Human
ctctgtttagcatatgattttgctacatttaggcctgacttccttcgtattcaagataaaataaagggaaataattacgagtaaaaacaagcagtggagaaggtggtgtcaggttcttggcaagttgataacaaatggccactaattttgacaatttgtttccttgcagctgagagaaaaagggaaatatgtttagcaatatggattccattttccgatgaataaagacatacatattcatctgcaaagataaattttgtttgaaactaaacttaaattgttcttaaatttcaaggataatttttttttttttttttgagatgaagtcttggtctgtcacccaggctagggtgcagtggctccatcttggctcactgcaacctttgcctccagggttcaagtgattctcttgcctcagcctcccgagtagctgggattacaggcgcatgccaccatgcctggctaatttttttgtatttttagtaaagacatggttttgtcatgttgggcaggcaggtcttgaactcttgatctcaggtgatctgcctgcctcagcctcccaaagtgctgggattacaggtgtgagccactgtgcctggcc

SEQ ID NO: 182902 - DNA, 601 bp, Human
ttaactgtcataggaagttgttacattcctccttaggtacttaagtagcttgtctttcctgttaggctctttacttagagttagtttgctttgacgaggggtagaagaactgaggccatggctttgcctgaagtacagataggttctttatcaaaccctcttttttatatttttgactttattcacccttgacataaaagacaaaggcttacttaggaacctgcaactctaccaatttttaatttttactgtaaaataagggttttctggaagactaaaaaacacttttaaaaaacatgattttttttgcgtttatctctaaatcagacgttttgattggttccatcattgttgtatttgaatttgaattttatttattaattcaacaggcatttattaagtccctgctattgccaggaatttagtgtattctggctctcagggtttcacagagaagaagatatgattctagctcttcaggatttctcagtaaggtggagaggaaaatatgttataaaaatgagggagaatacgatgagtgcgtagtaggggcatttataaagtataagtaagcaaaggatatttctcatctgggatacgg

SEQ ID NO: 182903 - DNA, 601 bp, Human
tctactgtaatagcttgtattattacaatctttgaggaagctgcagtttagataatttagcacaatcatcaggaagaatttaacagttgattttattacctgccattttggggggagaggaggtataaaaatgtatcctttgatatactaacagaaaaccacttgcataaaattattataataaaatctcaatttttccagaaaccacgatcgcttagatctggattacaaaaagaggtttaaagatgctattagattttctaataactgaaaatgttaaagttcgagacagtttgtgctaaaaaagctagattcgctaagtgcgagagtattaactggaagcaaccggcgataggtggtgatgtgatccaggtgttgtgaagaacagagacaggatgacaagaaggcaggatataggtccacgagatttcagcagggatttatttttaaaagcaacttcttgagataggttctggagttagtacaggtgtagcctgaactcccacacttgcaacattatgcagttagattgttggacatattgacccccgaaatacttttttaaatttattttttaaaaataaaaataattaaaaaaaaa

SEQ ID NO: 182904 - DNA, 601 bp, Human
tttggggggagaggaggtataaaaatgtatcctttgatatactaacagaaaaccacttgcataaaattattataataaaatctcaatttttccagaaaccacgatcgcttagatctggattacaaaaagaggtttaaagatgctattagattttctaataactgaaaatgttaaagttcgagacagtttgtgctaaaaaagctagattcgctaagtgcgagagtattaactggaagcaaccggcgataggtggtgatgtgatccaggtgttgtgaagaacagagacaggatgacaagaagrcaggatataggtccacgagatttcagcagggatttatttttaaaagcaacttcttgagataggttctggagttagtacaggtgtagcctgaactcccacacttgcaacattatgcagttagattgttggacatattgacccccgaaatacttttttaaatttattttttaaaaataaaaataattaaaaaaaaagagagacagggtctcgctatgttgaccaggctgatcttgaactccagagctcaagtgatcctcctgcctcaggatccaaaaatacttttaaaataaatcccaaact

SEQ ID NO: 182905 - DNA, 601 bp, Human
tagaaaagtccatatacagtacagtttcttttttaaaattttttttctagaatatagtttcttaacattcatttaataccactgtctgcatctgtaccaggtttaacctgcatttcttatctgtaaatgggaagcatgatatttacctcgtagaggtgttgggaagatgaattgagataataatgcatttaaagcagtaccttttatatggtagatcctctataaacagtagttagaaaaattaacaagtatataggatggcatctatgttaagttcactttcaatggtattgtagtgagwaggtagcattgattacctactcataggtactttaagtaggtactttaattaaattttaggactactgtaattatgaaagtccattattaactataatactttacattttaaaggaaatttacatttataaactcttttcacattaattatctgattttgttctcaggacaactttgtaagatagttatattcaatttagagacattgaatattagtttcaggagaggttaaataagcagtgttagcagaaagcttatgttggttctcatgaaggcagattaaaatggaaataatgatacc

SEQ ID NO: 182906 - DNA, 601 bp, Human
tgttctcaggacaactttgtaagatagttatattcaatttagagacattgaatattagtttcaggagaggttaaataagcagtgttagcagaaagcttatgttggttctcatgaaggcagattaaaatggaaataatgataccataatactttgatttttatcatttgtgtttatgtgctttacctacctagattctgaatagatttgtctctgtacttttttcccccttctgtgtgtgtgggaaggggaaggaggaggaggaggaaaagagattatagaagagggttaggtgaatcttartgggactctttggaaagggagaactgcagcctgcctctcagatccaaaaatgttatattaacgccaccctctcagctccctatattttaaaatagccaagcagattggcaagattttttttttttcagatttgtaaatgttcgatggcaactaagtctatgcatcaaagatttgaggagatttctctaggttgactatggattagaattaaccaccaaatttactagccatgtaggatttgctaagccaatgtgacaaatttatttggtgacttctgtttataaatgcattgattcaatt

SEQ ID NO: 182907 - DNA, 601 bp, Human
agtgtcattgaatagtacaagcacagacctgtctttgaggagtcttcaagtcttaagtggtgcttataaccatgaattaaaggattatcttgtacatataaatagctttgaaatgtctggcaaacatcttttaactgtacttacacattatgaaataaaatagggagaatttaagatttgtgagaactttaggtcaagatgaatcatcttgttttttttttttaaaaaagcatgccacctaaataacaatatattttccttttaggttggcacgttggatgtcttggttggcttgtcagaygaactggctaaactggatgcatttgtagaagggtaatgtacttatatgcatggagtagagcaaaatgggagacactattatcaggcttcatggacactgggtttattatcacatgtatactctgcttattggaatggttttagaaaacgacttttttcccttcgtatatcaattttatgaaggtacaatttacataaaatgcacctgtttgaaatatgaaaatgctgattctctttttactatctttaatgggatatagtttacatgccatgcatttcacctatttcaggtgtacaattc

SEQ ID NO: 182908 - DNA, 601 bp, Human
ccgcgcccggctgataatatctcatttttaaaaatttgtgtttccctgttggctgatgtgatgtgatgtgttgagtatcttttcatgtgtttttttgccatttgtttttcttccttggagaaatgtctattcagatcctttgcccatttttaattggctagcctttttattattgaattgtagaagttctttatacagaatatgcaagagataaatcccctatcagatataacttgcaaatattttctcctgttctgtgagttgtcttcattttctttttttcttcttgagacagagtctygctctgttgcccaggctggaatgcagtggccagatgttggctcactgcagcctccgcctcctgggttcaaatgattctcctgcctcagcctcccgagtagctgagattacaggtccctgccacaatgcgcagctagtttttgtatttttaatagagatggggtttcaccatgttggacaggctggtctcgaactcctgacatgatgcgcgtgcctcagcctcccaaagtgctgggattacaggcgtgagccaccgcgcctggccatgtcttcgttttcttgattgtatctgtgaagcaca

SEQ ID NO: 182909 - DNA, 601 bp, Human
cataaatatgagggtttatttctggactctcagttctgtttcactgatctatgtttctctcctatgccagtaccacattgtcttgattattgtaactttgtagtaagttttaaaatcagaaagtgtgaattctccaactttttttttttttttttcaagattggccattctgggttctttgtctttttgtatgaattttaggatcacagtgtcaaatttctgcaaataagtcagctggaattttgatgaggatagtgttgaatctatgtatcagttggggagtagtatcatcctaatattmttgtctttatccatgaacatcggatgttactccatttatttgaagatggttatgcttttgtcttcaaaattcagttggaagagtttttctaaattgcagtttttattacttttgaaattcaggtacatgtgtatttgagctgaaaatggttataggctctttgataactgcattttgattagttggcagaatcagtctacagttccttcaactctggggatacaaagattttattttagagtttagatacacaggtgtaatttgtaaagtacagaatttggagactctcagaaatgtaca

SEQ ID NO: 182910 - DNA, 590 bp, Human
agtaggttagttaagagatagtaaaagctcagttgggaccagacacttggctcttagaatggaaagagaagatgaaaggaaaagcaacttttaggattataattccatatattcatatagagcaaattattattatgaattattataaatatagtgaaaataattatgatgcactcaaagcactaactgatggaaagaatagtctcttggttccttgcttatacatttttaattaagaaaaaaatgggccgggcatggtggctcacgcctgtaatcccagcactttgggaggccaaggtgrgcggatcatgaggtcaggaaattgagaccatcctggctaacacgatgaaaccccgtctctactaaaaatacaaaaaattatccaggtgtggtggcgggcgcctgtagtcccagctactcgggaggctgaggcaggagaatggtgtgaactcgggaggcggagcttgcagtgagctgaggtagcgccactgcactccagcctgggtgacagagcgtgactccgtttcaaaaaaaaaagaaaagaaaaaaatgtaagggaacttttttttttagttgtcatcccctggagt

SEQ ID NO: 182911 - DNA, 601 bp, Human
actttggtagtattgacagatgatagcttaatgacttaaatgctccaagtgttaaaggccaaatattgtagaatatggtatatgtggtaaatcatagtttgtactttcttaaaaatgtaatcattagagcagatatttttgaggtgacattgtgtacattgacacagatcctcttgtaaataggcatacggagatcttgaagttctgggttatgcaacattacgtttataaatttgacaccaggtgattctacactctgaagtacttctatgggtaaacatgcaacattttagaatgttcrtagcaaatggttctgtttacaagatgcttgccaaattttatgagaatgatttgtcccttttgaaggaatgggtgaattttggagacataggcaagtatatgtataaacctcaagttaaacatgttgaagatttaggacttacatcattatttctgaaattgttctgatttttaggtttgagaccactcagcataggattgtcatttaaatttagctcttctgtcacctttcctggctcatattggctcttgtttaaactgttaacaagccaggcttgtggctcacacctgtaatccctcc

SEQ ID NO: 182912 - DNA, 601 bp, Human
taaacatgcaacattttagaatgttcgtagcaaatggttctgtttacaagatgcttgccaaattttatgagaatgatttgtcccttttgaaggaatgggtgaattttggagacataggcaagtatatgtataaacctcaagttaaacatgttgaagatttaggacttacatcattatttctgaaattgttctgatttttaggtttgagaccactcagcataggattgtcatttaaatttagctcttctgtcacctttcctggctcatattggctcttgtttaaactgttaacaagccaggyttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaatgcgcgcgcacacacacacacacacacacacacacacacacattttttttttaaggaaaaaaaaccattacaggaatttcttaatttgtcttccagtttcccctcctagctgttgagcatgtagtcatcagaatacttgtcctgagc

SEQ ID NO: 182913 - DNA, 601 bp, Human
agttaaacatgttgaagatttaggacttacatcattatttctgaaattgttctgatttttaggtttgagaccactcagcataggattgtcatttaaatttagctcttctgtcacctttcctggctcatattggctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaatgcgcgcgcacacacacacacacacacacacacacacacacattttttttttaaggaaaaaaaaccattacaggaatttcttaatttgtcttccagtttcccctcctagctgttgagcatgtagtcatcagaatacttgtcctgagccctgtttcgactgtgttatgtccctgtctagagtgtggcttcagaggctgtgtatctgcaatctggcatcccactttcctagcctaagctcccctacttctcggcctgctgcttccatcagtctggacttctcaccatt

SEQ ID NO: 182914 - DNA, 601 bp, Human
ggacttacatcattatttctgaaattgttctgatttttaggtttgagaccactcagcataggattgtcatttaaatttagctcttctgtcacctttcctggctcatattggctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaatgcgcgcrcacacacacacacacacacacacacacacacacattttttttttaaggaaaaaaaaccattacaggaatttcttaatttgtcttccagtttcccctcctagctgttgagcatgtagtcatcagaatacttgtcctgagccctgtttcgactgtgttatgtccctgtctagagtgtggcttcagaggctgtgtatctgcaatctggcatcccactttcctagcctaagctcccctacttctcggcctgctgcttccatcagtctggacttctcaccattctctggatgcctactgcttttc

SEQ ID NO: 182915 - DNA, 601 bp, Human
tttaggtttgagaccactcagcataggattgtcatttaaatttagctcttctgtcacctttcctggctcatattggctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaatgcgcgcgcacacacacacacacacacacacacacacacacattttttttttaaggaaaaaaaaccattacaggaatttcttaatttgtcttccagtttcccctcctagctgttgagcatgtagtcatcagaatacttgtcctgagccctgtttcgactgtgttatgtccctgtctagagtgtggcttcagaggctgtgtatctgcaatctggcatcccactttcctagcctaagctcccctacttctcggcctgctgcttccatcagtctggacttctcaccattctctggatgcctactgcttttccacctcttatcatgactcataatatgccccatggc

SEQ ID NO: 182916 - DNA, 601 bp, Human
aagagaacgctggactccaaagtcaggacaacatgtttctagtcacagctctgccgttaactggtcttgtgactttgaataagccacttattcttttatacctcagtgtcttataaatgaaagaactgacaaggtcatatgtaggtgacttggtttaggttggtgcaaaagtaatggagtttttgccatttttttcccccctaaagtaatggccagaaccacagttacttttgcaccaacctaatagttttggcattatggcttcctctatagcatagctccttgtaaatagtagatgctyaataaacagttaatgaattaataatgtaggacttagtttttcatcatgactattgcttacgttctcttgcctgtcaggtccctttcttcctaagggaaagcacagtgtcttgcatgtcataggaacatagtgaatgctagttctcagcctcctcctttgttctcagtccttaaattgtctagtttcttggcatataaatatatggctatttacagactctttctcactagcttcccatgacttactttctagactaggagacacattgcatgtagtctccttaaaaccctacagttactc

SEQ ID NO: 182917 - DNA, 601 bp, Human
tcagggagtacatggaccttgaagccgatgcatgaacccaccaagttaagagctccttttatattgagaaatccttgaacttgaaaggaaatcctagaacttgagaggaaaaaaaagtctttttccccccaagatctgtttgtggaataaaagtcttaacagtaactataatgagacaaatagacaaggacctgttaattgtttgccagcatttgacctggctggggcaagaagtgtagtttaaattattggacagactttccttggctcccagtaactttagttatgcggtgtgctgtayagttaaatgtaaataaatagactatcaaagattttaactaaagtcatcatgtaatttgatgactatagtttaagaaactattatttacattacttgataatataaagtggtgttcttactatgactgagcctttttttctgtatccttaaggatttgatcatctgcttcctgatgctgttgtagataggaaagcaggcttagagaggtgaagtgacttaccctcgtgctacacagctaataatgctagagctatgttaaagtcagttcttcgaatgttgtttacttcacattttctcccc

SEQ ID NO: 182918 - DNA, 601 bp, Human
taagagctccttttatattgagaaatccttgaacttgaaaggaaatcctagaacttgagaggaaaaaaaagtctttttccccccaagatctgtttgtggaataaaagtcttaacagtaactataatgagacaaatagacaaggacctgttaattgtttgccagcatttgacctggctggggcaagaagtgtagtttaaattattggacagactttccttggctcccagtaactttagttatgcggtgtgctgtatagttaaatgtaaataaatagactatcaaagattttaactaaagtcrtcatgtaatttgatgactatagtttaagaaactattatttacattacttgataatataaagtggtgttcttactatgactgagcctttttttctgtatccttaaggatttgatcatctgcttcctgatgctgttgtagataggaaagcaggcttagagaggtgaagtgacttaccctcgtgctacacagctaataatgctagagctatgttaaagtcagttcttcgaatgttgtttacttcacattttctccccatgtagttagtttagtattcttctgagaaaaacagcttttgtaaca

SEQ ID NO: 182919 - DNA, 601 bp, Human
ccacacccctggaagccagtggcctctagagaaggttgttgcacaatgttttgtggcaacatagtttactgtcacttcatttacttactacctcatggtactctgtgctttccataaatatagttttttttcagtccttcataatggccactgagcaggaatgatagtgattttagcatgaccatttttaaaaaatgaggcacaatacatatgaactatgcagcttgaaaacaatttagaatctatactgtgctttacttcctttccgaacatagttctaggatgtgcctcttttgcaatrgttactggaggtagggtggtgatctgtttttcctgcattactcagtgtatttgaaattcattctcagtaggaaacccgaattttttttgttaaatagagttgaagtatacttactatagccagatttcctatttgtctcataattttttctcttcctggatatggcaggaaataggacttgtttttcttttccaatgtgtattgtaccttttctgcaggttaaaccacaacgactggattaagcagtatgaaacactagccgaaatggtagttccaaggtctagcaagtaagtagaagtc

SEQ ID NO: 182920 - DNA, 601 bp, Human
aggttgttgcacaatgttttgtggcaacatagtttactgtcacttcatttacttactacctcatggtactctgtgctttccataaatatagttttttttcagtccttcataatggccactgagcaggaatgatagtgattttagcatgaccatttttaaaaaatgaggcacaatacatatgaactatgcagcttgaaaacaatttagaatctatactgtgctttacttcctttccgaacatagttctaggatgtgcctcttttgcaatggttactggaggtagggtggtgatctgtttttyctgcattactcagtgtatttgaaattcattctcagtaggaaacccgaattttttttgttaaatagagttgaagtatacttactatagccagatttcctatttgtctcataattttttctcttcctggatatggcaggaaataggacttgtttttcttttccaatgtgtattgtaccttttctgcaggttaaaccacaacgactggattaagcagtatgaaacactagccgaaatggtagttccaaggtctagcaagtaagtagaagtctttgtaaaaccatttgtttcctagaattcctt

SEQ ID NO: 182921 - DNA, 601 bp, Human
ctgtcaccagtagagtctgtcactggtagggtccgtcactggtagggttgtgacttcgagttgtccaggttcttggtgttttgaacaaaaaattggacaaaatgcccagcaaagcaaaataagaatgaagcaacaaaagaacgaaagcagggatttattaaaaatgaaagaaagtacactccacagtgtaggagcagacctgagcagtggctcaagggcctggatacagaatcttcttgggtccaaataactcctacaagtttcccattggccacttcatgctcacctcatgtaaatgacrtggtagcctgcagtgagcctcattggttgcagaaagcagccaaccagaggctgaagtgaagttacaaaggtcacactcctgtgcaaatatctgattggttgcagaaggcaactaatcagaggctagggtgaagttacaaagttatacttctatgcgaatgaagactcggcctcccaatcagtctgatttgttgcagacagccaatttcccatctgccatgcaggaaaggtcaaaaggagtagcctctggtccttttgttacttaggcgtggaaagttagggttttcctttcaatttagtt

SEQ ID NO: 182922 - DNA, 601 bp, Human
cagcaaagcaaaataagaatgaagcaacaaaagaacgaaagcagggatttattaaaaatgaaagaaagtacactccacagtgtaggagcagacctgagcagtggctcaagggcctggatacagaatcttcttgggtccaaataactcctacaagtttcccattggccacttcatgctcacctcatgtaaatgacgtggtagcctgcagtgagcctcattggttgcagaaagcagccaaccagaggctgaagtgaagttacaaaggtcacactcctgtgcaaatatctgattggttgcagarggcaactaatcagaggctagggtgaagttacaaagttatacttctatgcgaatgaagactcggcctcccaatcagtctgatttgttgcagacagccaatttcccatctgccatgcaggaaaggtcaaaaggagtagcctctggtccttttgttacttaggcgtggaaagttagggttttcctttcaatttagttctaggaaaccggggtgaaacaaccttaggttccctgcctccagaccctatttcctgcctcagttctgctaccaacttgctgtgtgacctggggtaagtcttttaac

SEQ ID NO: 182923 - DNA, 601 bp, Human
tgccatgcaggaaaggtcaaaaggagtagcctctggtccttttgttacttaggcgtggaaagttagggttttcctttcaatttagttctaggaaaccggggtgaaacaaccttaggttccctgcctccagaccctatttcctgcctcagttctgctaccaacttgctgtgtgacctggggtaagtcttttaacttctctgggcctcattttctttgtctgtaaatggagcatagcaccttccttgtatatattatgaagttattttaagacttaatggagtattcaaaatacaagataatrttactgtattttcacaaatgttgatcttttaggaacttaacaacaaacttgtgctcatcatgaatgttttttttttcatttggaggaatatctttccttcataccagctcttcacatggtaaactgaagactacagttgtgtcttgatattggtggctcacttaggctgttgatactgacagatctttagggcattagagccgtagaggttgactctgtgtctaggaggcaggtagaggaggagagtgaggacgtggtgcacacagaatgtcctccagagatggacatacgccaacccag

SEQ ID NO: 182924 - DNA, 601 bp, Human
gctaccaacttgctgtgtgacctggggtaagtcttttaacttctctgggcctcattttctttgtctgtaaatggagcatagcaccttccttgtatatattatgaagttattttaagacttaatggagtattcaaaatacaagataatgttactgtattttcacaaatgttgatcttttaggaacttaacaacaaacttgtgctcatcatgaatgttttttttttcatttggaggaatatctttccttcataccagctcttcacatggtaaactgaagactacagttgtgtcttgatattgrtggctcacttaggctgttgatactgacagatctttagggcattagagccgtagaggttgactctgtgtctaggaggcaggtagaggaggagagtgaggacgtggtgcacacagaatgtcctccagagatggacatacgccaacccagatgtccagggggatggtctgtaggctcattaagtaagctcagatttactctgatagaaagactttaaaaatattccatcagagatttagatctttggacagtcactttagtagtttaaagggcaaatttcaggaagggaacagtttaatgcag

SEQ ID NO: 182925 - DNA, 601 bp, Human
ccttccttgtatatattatgaagttattttaagacttaatggagtattcaaaatacaagataatgttactgtattttcacaaatgttgatcttttaggaacttaacaacaaacttgtgctcatcatgaatgttttttttttcatttggaggaatatctttccttcataccagctcttcacatggtaaactgaagactacagttgtgtcttgatattggtggctcacttaggctgttgatactgacagatctttagggcattagagccgtagaggttgactctgtgtctaggaggcaggtakaggaggagagtgaggacgtggtgcacacagaatgtcctccagagatggacatacgccaacccagatgtccagggggatggtctgtaggctcattaagtaagctcagatttactctgatagaaagactttaaaaatattccatcagagatttagatctttggacagtcactttagtagtttaaagggcaaatttcaggaagggaacagtttaatgcagtcaagacttgtttgcaagtgacttgtaagtgcacactaatcttccgagagcttccagcctttccttgctcagtgaaaacatct

SEQ ID NO: 182926 - DNA, 601 bp, Human
tttaagacttaatggagtattcaaaatacaagataatgttactgtattttcacaaatgttgatcttttaggaacttaacaacaaacttgtgctcatcatgaatgttttttttttcatttggaggaatatctttccttcataccagctcttcacatggtaaactgaagactacagttgtgtcttgatattggtggctcacttaggctgttgatactgacagatctttagggcattagagccgtagaggttgactctgtgtctaggaggcaggtagaggaggagagtgaggacgtggtgcacmcagaatgtcctccagagatggacatacgccaacccagatgtccagggggatggtctgtaggctcattaagtaagctcagatttactctgatagaaagactttaaaaatattccatcagagatttagatctttggacagtcactttagtagtttaaagggcaaatttcaggaagggaacagtttaatgcagtcaagacttgtttgcaagtgacttgtaagtgcacactaatcttccgagagcttccagcctttccttgctcagtgaaaacatcttttctacctatttctcagttcaaagta

SEQ ID NO: 182927 - DNA, 601 bp, Human
caccactttggtgaaactcctttgaatcccctcagataaagttactaattccccagtgtatcatgtatattttctattgcagcacttacaactctatattgcagttacttgtgtatgcctgtttcctttactaaacccatacctggagatcaggaaatgctgtcttagttttatactaatatctagcaagtgcttgcattacagagtctcagtacatgttaaatgactacaagtctgttatagtaaggactcgtggtttattttttaaacagttttaagaaatacctttccttaggggaargagggaaagcaagtggcttttatttgtttttcataataaggtggcatagtaggatttagttataagataagatggaggttttatcttggcttttttcaccatcaggattttgagtaagccataggaatttgctgtgtcccagatctctgcacaatagctaggaacctgcttaataggtaacctgttcattgacacagggccatgtcaagcaccaaatgcttttggaagggtcttcaaaacagcaaagtgttggataagtttaaaagattactatgataacagtaaaacattatttgtggc

SEQ ID NO: 182928 - DNA, 601 bp, Human; identical to SEQ ID NO: 26897

SEQ ID NO: 182929 - DNA, 601 bp, Human; identical to SEQ ID NO: 26898

SEQ ID NO: 182930 - DNA, 601 bp, Human; identical to SEQ ID NO: 26899

SEQ ID NO: 182931 - DNA, 601 bp, Human; identical to SEQ ID NO: 26900

SEQ ID NO: 182932 - DNA, 601 bp, Human; identical to SEQ ID NO: 26901

SEQ ID NO: 182933 - DNA, 601 bp, Human; identical to SEQ ID NO: 26902

SEQ ID NO: 182934 - DNA, 601 bp, Human; identical to SEQ ID NO: 26903

SEQ ID NO: 182935 - DNA, 601 bp, Human; identical to SEQ ID NO: 26904

SEQ ID NO: 182936 - DNA, 601 bp, Human
gcctgtagtcccagctactcaggaggctgaggcagaagagtggcgtgaacccaggaggcagagcttgcagtgagcccagatcgcaccactgcactccagcctgggtgacagagtgagactctggctcaaaaaaaaaaaaaaaaaagaaaacttctgtaagtcaagttcgacaaatatctatgactttccttaggcagacaagcatcacacattaatatactggaaaagttgtctatatttcaactcatattaaagcaccagctatttatattttgtcttctataataaaattatttggatkattaaaatctacttaaaattaactgtttaatcaatttattattttcagatatcaacatgtctaagttgaccagctaagtcactcaaagacaatagtggtagttacccaaatatttttacttaaatttttacaagcatgaatgcacacacatacacacacacacatacaccatgtcacaatagaaatccatccaagccagtatataaaatgcatttttcacaacacacctacctccctggccttgctggcaacccttcttgcttagaatatcttccacagagttttcaaacactaggtgga

SEQ ID NO: 182937 - DNA, 601 bp, Human
acggcatttaatgaacctgtcatagtgaccttcagaattaaatgctcaagaaaatattggaaagtgtgcttggaaatatgattcacaattgtaactaacagaaaagatgagatcatctgtcaatgatttaagtagcatagatttccatcatatgatggagtcaacaactatgaacagtataagaaaacttctaggccgggcgtggtggctcacacctgtaatcccagcactttgggaggccaaggtgggcagatcacgaggtcaggagatcgagaccatcttggctaacacgctgaaaccycatctctactaaaaatacaaaaaattagctgggtgtggtggcgggtgcctgtagtcccagctactcaggaggctgaggcagaagagtggcgtgaacccaggaggcagagcttgcagtgagcccagatcgcaccactgcactccagcctgggtgacagagtgagactctggctcaaaaaaaaaaaaaaaaaagaaaacttctgtaagtcaagttcgacaaatatctatgactttccttaggcagacaagcatcacacattaatatactggaaaagttgtctatatttcaactcatattaaa

SEQ ID NO: 182938 - DNA, 601 bp, Human
tttgcatatatgttttgtttataaaaacaatatttttctatattagtgaaaatacacacgcacgcacacacacacacacacgtatacatataaatatatcagactgaaaaaacattattgcaacaaaaagtacccaaaagccccacagccaactgcaccccaggaacccccagaagagcactgcctcatgaagctgaggccctggcacgcagagtgctggagccaagataactctgcctgtgctgcaaatcacccctcaggtaacaggcacagtgagggtcgtggtgggggtgacagttgkagctggaatgagggttggtcttagaacacccttctccctgcattgatgatcaaatgtctccttgttctccttcctcacaggacgtgcacaaggacccggacctgcaaagtgtaactgaagagtgggctacgcaccccggttctgaagtaggcggtgggatcacagagtcattgtgcaccaaagataccaaatctcacatattcctgatgtatagattcatgacataacagtttacgcttgtcataatttggaattgaaatggcctggccttcgtgtgcacacggccacaccgtgtggcag

SEQ ID NO: 182939 - DNA, 601 bp, Human
cttctgctctggctctgacaggaatgtagttttacctggtagtaaaaccttccagctaacttgcatttctccaggcttctgccagtattctcagttgtaaaataataatggctcagcctcttcacaaggttactctcacttttaacaaacagtggaaaaggggatgtcattaccaagaaccaattcatgaactagctgtttgtataagaccaattttccttaagtctgacataaccagtgaagaagaagtctttgttgtgttggcaaagatctccaaatgggacattggcatccacctggytttgagtagactaactcatgggtgattgccacatatggtccggtagatatatgtatatagatccatacttattctacacatctggagataacagatctagatttctctgtgttttttttttttttttttggaagatctaagagtttcccataagttttaaaggtttgcttttgatagttccagggattattgacttgtacctgtgagcctaggaaatacctgctgaaggaggctgcacctactagggtgtatgctggtaacacacacacacacacacacacacacacacacaaggtgttt

SEQ ID NO: 182940 - DNA, 601 bp, Human
tagagacaaagaaaccaccctgagtggattttacccagcacactaatctttaactaacctagggtatttgtttttcattcctctaaaagttaaacaaaagaccgcatatatctttgcttctgctctggctctgacaggaatgtagttttacctggtagtaaaaccttccagctaacttgcatttctccaggcttctgccagtattctcagttgtaaaataataatggctcagcctcttcacaaggttactctcacttttaacaaacagtggaaaaggggatgtcattaccaagaaccaatycatgaactagctgtttgtataagaccaattttccttaagtctgacataaccagtgaagaagaagtctttgttgtgttggcaaagatctccaaatgggacattggcatccacctggttttgagtagactaactcatgggtgattgccacatatggtccggtagatatatgtatatagatccatacttattctacacatctggagataacagatctagatttctctgtgttttttttttttttttttggaagatctaagagtttcccataagttttaaaggtttgcttttgatagttccagg

SEQ ID NO: 182941 - DNA, 601 bp, Human
atgttgcccataaccatgtacaatcaggtcaatatcaacacattaatagagacaaagaaaccaccctgagtggattttacccagcacactaatctttaactaacctagggtatttgtttttcattcctctaaaagttaaacaaaagaccgcatatatctttgcttctgctctggctctgacaggaatgtagttttacctggtagtaaaaccttccagctaacttgcatttctccaggcttctgccagtattctcagttgtaaaataataatggctcagcctcttcacaaggttactctcayttttaacaaacagtggaaaaggggatgtcattaccaagaaccaattcatgaactagctgtttgtataagaccaattttccttaagtctgacataaccagtgaagaagaagtctttgttgtgttggcaaagatctccaaatgggacattggcatccacctggttttgagtagactaactcatgggtgattgccacatatggtccggtagatatatgtatatagatccatacttattctacacatctggagataacagatctagatttctctgtgttttttttttttttttttggaagatct

SEQ ID NO: 182942 - DNA, 601 bp, Human
gacctgaggcgagtcagggacggaggcggggtccagtcctcaggtcagcggggcctgcgcagttgcagtcagggcccaggctctaggccggagctcacctcacccccatgtaggaccctgctccctctcaggggtgaagatcccatctttgaaatgcctgacttctctcggacagtccattattgaggaaagacttagacattttacagcgctgtcaggcattccgtgattgagtttttaatcacttggttataaactgtgctgcaattcatactaagctcagaagcttcccctcggattyatgttgcccataaccatgtacaatcaggtcaatatcaacacattaatagagacaaagaaaccaccctgagtggattttacccagcacactaatctttaactaacctagggtatttgtttttcattcctctaaaagttaaacaaaagaccgcatatatctttgcttctgctctggctctgacaggaatgtagttttacctggtagtaaaaccttccagctaacttgcatttctccaggcttctgccagtattctcagttgtaaaataataatggctcagcctcttcacaaggttactctca

SEQ ID NO: 182943 - DNA, 601 bp, Human
ctctcccaccttcccaccactcccacctttccacattcccaccactccctctgaagccctagatcatgggacctgggtgggtatggcatgtaatttacaaattgacctgaggcgagtcagggacggaggcggggtccagtcctcaggtcagcggggcctgcgcagttgcagtcagggcccaggctctaggccggagctcacctcacccccatgtaggaccctgctccctctcaggggtgaagatcccatctttgaaatgcctgacttctctcggacagtccattattgaggaaagacttaracattttacagcgctgtcaggcattccgtgattgagtttttaatcacttggttataaactgtgctgcaattcatactaagctcagaagcttcccctcggattcatgttgcccataaccatgtacaatcaggtcaatatcaacacattaatagagacaaagaaaccaccctgagtggattttacccagcacactaatctttaactaacctagggtatttgtttttcattcctctaaaagttaaacaaaagaccgcatatatctttgcttctgctctggctctgacaggaatgtagttttac

SEQ ID NO: 182944 - DNA, 589 bp, Human
accttcccaccactcctaccttcccaccttcccaccgctcccaccttcccaccttcccacattcccacctctcccaccttcccacctctcccaccttcccaccactcccacctttccacattcccaccactccctctgaagccctagatcatgggacctgggtgggtatggcatgtaatttacaaattgacctgaggcgagtcagggacggaggcggggtccagtcctcaggtcagcggggcctgcgcagttgcagtcagggcccaggctctaggccggagctcacctyacccccatgtaggaccctgctccctctcaggggtgaagatcccatctttgaaatgcctgacttctctcggacagtccattattgaggaaagacttagacattttacagcgctgtcaggcattccgtgattgagtttttaatcacttggttataaactgtgctgcaattcatactaagctcagaagcttcccctcggattcatgttgcccataaccatgtacaatcaggtcaatatcaacacattaatagagacaaagaaaccaccctgagtggattttacccagcacactaatctttaac

SEQ ID NO: 182945 - DNA, 451 bp, Human
accttcccaccactcctaccttcccaccttcccaccgctcccaccttcccaccttcccacattcccacctctcccaccttcccacctctcccaccttcccaccactcccacctttccacattcccaccactccctctgaagccctagatcrtgggacctgggtgggtatggcatgtaatttacaaattgacctgaggcgagtcagggacggaggcggggtccagtcctcaggtcagcggggcctgcgcagttgcagtcagggcccaggctctaggccggagctcacctcacccccatgtaggaccctgctccctctcaggggtgaagatcccatctttgaaatgcctgacttctctcggacagtccattattgaggaaagacttagacattttacagcgctgtcaggcattccgtgattgagtttttaatcacttggttataaactgtgct

SEQ ID NO: 182946 - DNA, 601 bp, Human; identical to SEQ ID NO: 26905

SEQ ID NO: 182947 - DNA, 601 bp, Human; identical to SEQ ID NO: 26906

SEQ ID NO: 182948 - DNA, 601 bp, Human; identical to SEQ ID NO: 26907

SEQ ID NO: 182949 - DNA, 601 bp, Human; identical to SEQ ID NO: 26908

SEQ ID NO: 182950 - DNA, 601 bp, Human; identical to SEQ ID NO: 26909

SEQ ID NO: 182951 - DNA, 601 bp, Human; identical to SEQ ID NO: 26910

SEQ ID NO: 182952 - DNA, 601 bp, Human; identical to SEQ ID NO: 26911

SEQ ID NO: 182953 - DNA, 601 bp, Human; identical to SEQ ID NO: 26912

SEQ ID NO: 182954 - DNA, 601 bp, Human; identical to SEQ ID NO: 26913

SEQ ID NO: 182955 - DNA, 601 bp, Human
ctcagggctgttgcagacccgggtgcgctcccggatcccaccggcacaggtgacagtgcaggccgaccacggggaccaggggctccagcggccatcgactgcggggaaagccaaccagggggagctcagagcaagacccggggtggagaacgtgagttggctgagtgagagggaagagcaggtgggacatggtgttccctacacagccccacaaactggtttctccccaggttggctgactacaggtcagagcgtgatcgcaccactacgcctgctgcaatggtggattccgggagtgackcagaagccagtgtttccaatggctttgctgcgatctcttggcctccagaagacaaatcataccacctcttctttttaataaaagaatttttttaatagagagggtctcgctatgttgcccaggctgctctcaaactcctggcctcaagcaatcctcctgccccagcctcccacagtgctgggattacaggcatgagccaccgtgcccggccccacaccaccatttacaccgagaagctcagagctcctcgccaagctgtccctctgccatggagggtggcctcaactcagaagcctggta

SEQ ID NO: 182956 - DNA, 601 bp, Human; identical to SEQ ID NO: 26914

SEQ ID NO: 182957 - DNA, 601 bp, Human; identical to SEQ ID NO: 26915

SEQ ID NO: 182958 - DNA, 601 bp, Human; identical to SEQ ID NO: 26916

SEQ ID NO: 182959 - DNA, 601 bp, Human; identical to SEQ ID NO: 26917

SEQ ID NO: 182960 - DNA, 601 bp, Human; identical to SEQ ID NO: 26918

SEQ ID NO: 182961 - DNA, 601 bp, Human; identical to SEQ ID NO: 26919

SEQ ID NO: 182962 - DNA, 601 bp, Human; identical to SEQ ID NO: 26920

SEQ ID NO: 182963 - DNA, 601 bp, Human; identical to SEQ ID NO: 26921

SEQ ID NO: 182964 - DNA, 601 bp, Human; identical to SEQ ID NO: 26922

SEQ ID NO: 182965 - DNA, 601 bp, Human; identical to SEQ ID NO: 26923

SEQ ID NO: 182966 - DNA, 601 bp, Human; identical to SEQ ID NO: 26924

SEQ ID NO: 182967 - DNA, 601 bp, Human; identical to SEQ ID NO: 26925

SEQ ID NO: 182968 - DNA, 601 bp, Human; identical to SEQ ID NO: 26926

SEQ ID NO: 182969 - DNA, 601 bp, Human; identical to SEQ ID NO: 26927

SEQ ID NO: 182970 - DNA, 601 bp, Human; identical to SEQ ID NO: 26928

SEQ ID NO: 182971 - DNA, 601 bp, Human; identical to SEQ ID NO: 26929

SEQ ID NO: 182972 - DNA, 601 bp, Human; identical to SEQ ID NO: 26930

SEQ ID NO: 182973 - DNA, 601 bp, Human; identical to SEQ ID NO: 26931

SEQ ID NO: 182974 - DNA, 601 bp, Human; identical to SEQ ID NO: 26932

SEQ ID NO: 182975 - DNA, 601 bp, Human; identical to SEQ ID NO: 26933

SEQ ID NO: 182976 - DNA, 601 bp, Human; identical to SEQ ID NO: 26934

SEQ ID NO: 182977 - DNA, 601 bp, Human; identical to SEQ ID NO: 26935

SEQ ID NO: 182978 - DNA, 601 bp, Human; identical to SEQ ID NO: 26936

SEQ ID NO: 182979 - DNA, 601 bp, Human; identical to SEQ ID NO: 26937

SEQ ID NO: 182980 - DNA, 601 bp, Human; identical to SEQ ID NO: 26938

SEQ ID NO: 182981 - DNA, 601 bp, Human; identical to SEQ ID NO: 26939

SEQ ID NO: 182982 - DNA, 601 bp, Human; identical to SEQ ID NO: 26940

SEQ ID NO: 182983 - DNA, 601 bp, Human; identical to SEQ ID NO: 26941

SEQ ID NO: 182984 - DNA, 601 bp, Human; identical to SEQ ID NO: 26942

SEQ ID NO: 182985 - DNA, 601 bp, Human; identical to SEQ ID NO: 26943

SEQ ID NO: 182986 - DNA, 601 bp, Human; identical to SEQ ID NO: 26944

SEQ ID NO: 182987 - DNA, 601 bp, Human; identical to SEQ ID NO: 26945

SEQ ID NO: 182988 - DNA, 601 bp, Human; identical to SEQ ID NO: 26946

SEQ ID NO: 182989 - DNA, 601 bp, Human; identical to SEQ ID NO: 26947

SEQ ID NO: 182990 - DNA, 601 bp, Human; identical to SEQ ID NO: 26948

SEQ ID NO: 182991 - DNA, 601 bp, Human; identical to SEQ ID NO: 26949

SEQ ID NO: 182992 - DNA, 601 bp, Human; identical to SEQ ID NO: 26950

SEQ ID NO: 182993 - DNA, 601 bp, Human; identical to SEQ ID NO: 26951

SEQ ID NO: 182994 - DNA, 601 bp, Human; identical to SEQ ID NO: 26952

SEQ ID NO: 182995 - DNA, 601 bp, Human; identical to SEQ ID NO: 26953

SEQ ID NO: 182996 - DNA, 601 bp, Human; identical to SEQ ID NO: 26954

SEQ ID NO: 182997 - DNA, 601 bp, Human; identical to SEQ ID NO: 26955

SEQ ID NO: 182998 - DNA, 601 bp, Human
gcctgccattgctaatgcaagggtaccaatctaaaatggcgtcaggagcctggaagtggaggaaatctaggaaactctaggctatggcacaatgaggatgggtgggacctgtaaataattggaaagtgttctaccagaggcatccaaatgcaattaaaaacaaaacaatccaagctgaccaaatgaaatggctgcttggaatgtgcagggggctcatgtgtggtattgtgcattaggtttattgccctgatgtacagcttttgtaagtggaagagcgcactgtgtacccctttccctttcygggtgccacatgccttccccactaacctgaagtgctcacactcacctctgcattcgtacttgaggtctgagaaatagaccatttcttgagagaagacaaatagacccagccgcccgccagcgtaggtttggtcatagataggtcctgagtctgccatgacctgttttccttcatgcactaagactctaaaaatggtgtttaaaaagaagaagaggaaagaaagacaacatgaactctgtgaagcattcaccagtgatggaaggttggctccggacacaagctgtggatactccgcccagg

SEQ ID NO: 182999 - DNA, 601 bp, Human
cttccaggtctataatattttgattcaaatatacctgtagcgagataactatagagaaactccttccttccttctttccttccttccttcctgcctgcctgccattgctaatgcaagggtaccaatctaaaatggcgtcaggagcctggaagtggaggaaatctaggaaactctaggctatggcacaatgaggatgggtgggacctgtaaataattggaaagtgttctaccagaggcatccaaatgcaattaaaaacaaaacaatccaagctgaccaaatgaaatggctgcttggaatgtrcagggggctcatgtgtggtattgtgcattaggtttattgccctgatgtacagcttttgtaagtggaagagcgcactgtgtacccctttccctttctgggtgccacatgccttccccactaacctgaagtgctcacactcacctctgcattcgtacttgaggtctgagaaatagaccatttcttgagagaagacaaatagacccagccgcccgccagcgtaggtttggtcatagataggtcctgagtctgccatgacctgttttccttcatgcactaagactctaaaaatggtgtttaaaa

SEQ ID NO: 183000 - DNA, 601 bp, Human
gggtgggtggatgaatgatatggatggatgggaggaaatgagatgccttgaaagacatcctaacataaggagaagaaaacctccacagaagcaagcagataaatcaaccccaacagggttttgccctgttggccaggctggtctcgaactcctgacctcaggggatccacccgccttggcctcccaaagggctaggattacaggcatgagccactgcccccagccaaacacatgattttcaatgtgtgattcttgagaagcatcctgagccttatttactgcatctgtggaagggtaatgygcatttgaaggcatggaattagagcagatggaattcaagttatcttccaggtctataatattttgattcaaatatacctgtagcgagataactatagagaaactccttccttccttctttccttccttccttcctgcctgcctgccattgctaatgcaagggtaccaatctaaaatggcgtcaggagcctggaagtggaggaaatctaggaaactctaggctatggcacaatgaggatgggtgggacctgtaaataattggaaagtgttctaccagaggcatccaaatgcaattaaaaac

SEQ ID NO: 183001 - DNA, 479 bp, Human
atatatgggtgggtggatgaatgatatggatggatgggaggaaatgagatgccttgaaagacatcctaacataaggagaagaaaacctccacagaagcaagcagataaatcaaccccaacagggttttgccctgttggccaggctggtctcgaactcctgacctcaggggatccacccrccttggcctcccaaagggctaggattacaggcatgagccactgcccccagccaaacacatgattttcaatgtgtgattcttgagaagcatcctgagccttatttactgcatctgtggaagggtaatgcgcatttgaaggcatggaattagagcagatggaattcaagttatcttccaggtctataatattttgattcaaatatacctgtagcgagataactatagagaaactccttccttccttctttccttccttccttcctgcctgcctgccattgctaatgcaagggtaccaatcta

SEQ ID NO: 183002 - DNA, 438 bp, Human; identical to SEQ ID NO: 26956

SEQ ID NO: 183003 - DNA, 601 bp, Human; identical to SEQ ID NO: 26957

SEQ ID NO: 183004 - DNA, 601 bp, Human; identical to SEQ ID NO: 26958

SEQ ID NO: 183005 - DNA, 601 bp, Human; identical to SEQ ID NO: 26959

SEQ ID NO: 183006 - DNA, 601 bp, Human; identical to SEQ ID NO: 26960

SEQ ID NO: 183007 - DNA, 601 bp, Human; identical to SEQ ID NO: 26961

SEQ ID NO: 183008 - DNA, 601 bp, Human; identical to SEQ ID NO: 26962

SEQ ID NO: 183009 - DNA, 601 bp, Human; identical to SEQ ID NO: 26963

SEQ ID NO: 183010 - DNA, 601 bp, Human; identical to SEQ ID NO: 112119

SEQ ID NO: 183011 - DNA, 601 bp, Human; identical to SEQ ID NO: 112120

SEQ ID NO: 183012 - DNA, 601 bp, Human
gatggtgtttcgatttttggaagggggtgtggtgttagttgtcctggcctgaggcctcttccaagaccagaggcagggcactgtttcctcctcttcccttcctctctcccccaggtgcctaacttcccgaaccactgagcatctgaaagcatctggtctctgccaggtgctccagtggagaggaccagagctgggtcaggtgggagattccctccccttaggtggttttgctcctgagaacccaacgctgcccaggctgagcagccatacctcctggaagacacgggaagacctccaggcwtgaacgtaatttcctctcccaagggcccttttagggaaaacatatttcaagaaagtctccagaatcactcacctttgcaataaagttccccatctttgtcagtgacatttgtggactccagactcttcccacagatggcacagcggaaacaggtcttgtgccaaggctgaggggcacagaaaagttgcatatttaatgaggtaggcaacacattctgtttccatttcaagtccctgaccagcagcatccagaggagtgacacgtcttaaccatttgcttacctaatgggccccataattt

SEQ ID NO: 183013 - DNA, 601 bp, Human
ctcctctcacttcattccaacatactcctttggagattcttgagacaccatcattaagtgatgaaactccactgagcaacagaataggcctaggctcaggggtggaggacgcattgccttggccctagtgcattccttcctttgatagtgtcaagaaggagctaagcctctactatttctccacaagaccaagggattatggaggcagcgagggtcagagctgcaaggaccaggaggaaaaccagatctgtccctgtgatcactaagtaacgtgcaacatcgacaacagaactgttagtgyggggtaggcaggagggagatagacatgtcatgataaactccagtgaggccaaactgagttcaccctcctccagtcaccccctctgccactcaggtgaacagatggtgtttcgatttttggaagggggtgtggtgttagttgtcctggcctgaggcctcttccaagaccagaggcagggcactgtttcctcctcttcccttcctctctcccccaggtgcctaacttcccgaaccactgagcatctgaaagcatctggtctctgccaggtgctccagtggagaggaccagagctgggtcagg

SEQ ID NO: 183014 - DNA, 601 bp, Human
cttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagytcttctaattaagtgatatttagaatttaaaagtcaatgttcattaattaaggtgattgaatggaaataatccatacttgattattttgctatcaaaacaatccataattcattattttagcaaaataatcaagtatgacagccgggtgcggtggatggctcacacctgtaatcccagcactttgggaggccgaggtgggtgaatcacctgaggtcggcagtttgaggccagcctggccaacctggtgaaaccctgtctctactaaaaatacaaaaaattagctgggcatggtggcacag

SEQ ID NO: 183015 - DNA, 601 bp, Human
tgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattattttagcaaaataatcaagtatgacagccgggtgcggtggatggctcacacctgtaatccmagcactttgggaggccgaggtgggtgaatcacctgaggtcggcagtttgaggccagcctggccaacctggtgaaaccctgtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcactctagcctgggcaacagagcaagactttgtctcaaaataaataaataaataataacaataaagtatgtgaatattatgttat

SEQ ID NO: 183016 - DNA, 601 bp, Human
tatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattattttagcaaaataatcaagtatgacagccgggtgcggtggatggctcacacctgtaatcccagcactttgggaggccgaggtgggtgaatcacctgaggtcggcagtttgaggccagcctggccaacctggtgaaacccygtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcactctagcctgggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacc

SEQ ID NO: 183017 - DNA, 601 bp, Human
aacaatccataattcattattttagcaaaataatcaagtatgacagccgggtgcggtggatggctcacacctgtaatcccagcactttgggaggccgaggtgggtgaatcacctgaggtcggcagtttgaggccagcctggccaacctggtgaaaccctgtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcactcyagcctgggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggttggtttgatggtgaatctttgaaatctatttccaggg

SEQ ID NO: 183018 - DNA, 601 bp, Human
tctctctcacattgctttgagtcccgatgtgtactgctaagactctcatgaccacattctctgtgaagtttgggttaatgtttccgtttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacraaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctgac

SEQ ID NO: 183019 - DNA, 601 bp, Human
ccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaastcttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtggctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacct

SEQ ID NO: 183020 - DNA, 601 bp, Human
ttcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtggctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacctgta

SEQ ID NO: 183021 - DNA, 601 bp, Human; identical to SEQ ID NO: 26772

SEQ ID NO: 183022 - DNA, 601 bp, Human; identical to SEQ ID NO: 26773

SEQ ID NO: 183023 - DNA, 601 bp, Human; identical to SEQ ID NO: 26774

SEQ ID NO: 183024 - DNA, 601 bp, Human; identical to SEQ ID NO: 26775

SEQ ID NO: 183025 - DNA, 601 bp, Human; identical to SEQ ID NO: 26776

SEQ ID NO: 183026 - DNA, 601 bp, Human; identical to SEQ ID NO: 26777

SEQ ID NO: 183027 - DNA, 601 bp, Human; identical to SEQ ID NO: 26778

SEQ ID NO: 183028 - DNA, 601 bp, Human; identical to SEQ ID NO: 26779

SEQ ID NO: 183029 - DNA, 601 bp, Human; identical to SEQ ID NO: 26780

SEQ ID NO: 183030 - DNA, 601 bp, Human; identical to SEQ ID NO: 26781

SEQ ID NO: 183031 - DNA, 601 bp, Human; identical to SEQ ID NO: 26782

SEQ ID NO: 183032 - DNA, 601 bp, Human; identical to SEQ ID NO: 26783

SEQ ID NO: 183033 - DNA, 601 bp, Human; identical to SEQ ID NO: 26784

SEQ ID NO: 183034 - DNA, 601 bp, Human
aggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggacyccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtcc

SEQ ID NO: 183035 - DNA, 601 bp, Human
agtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggtgagtgagaggctggtggagttgcctatggtggggcgatggggttcttgrgattggggaacatgccccctaccagggatgctgtgggctgtagttacctctctttgagtggcctgtttttttatttttttgttttgggcttcctctttcagctgctttttctgattcagaaacttgaaagcatcctggggcagaaagcggaccttgcagctggggttacccatgtgtgaagggtgcagcagggtgggattgctcatgactgctctcagaaaagagaaatgctgtgactttggatttcaagggttttgggtgtgactttagagcctcttgcagtgacaggctcatatagga

SEQ ID NO: 183036 - DNA, 601 bp, Human
atgctgtgggctgtagttacctctctttgagtggcctgtttttttatttttttgttttgggcttcctctttcagctgctttttctgattcagaaacttgaaagcatcctggggcagaaagcggaccttgcagctggggttacccatgtgtgaagggtgcagcagggtgggattgctcatgactgctctcagaaaagagaaatgctgtgactttggatttcaagggttttgggtgtgactttagagcctcttgcagtgacaggctcatataggacttcagtgggaccagctttctcaggggyagctacccctgagcgttcagtctgtagttggttgggcagatctggttgatctggctgtttgagggaccagtgattgaggcaggggctcttgactgccgtgtgtgtgtgtctgtgtgtgtgtctgtgtgtagatgggtacttatgtgcagttgaggcaggtcaaacactaccatgaaagacttgtagagcagtggatcttttttttttttttttgagatggagtctcgttctgtagcccaggctagagtgcagtggcacaatctcggctcactgcaacctccgcctcccgggttcaagcaa

SEQ ID NO: 183037 - DNA, 601 bp, Human
tgaaagcatcctggggcagaaagcggaccttgcagctggggttacccatgtgtgaagggtgcagcagggtgggattgctcatgactgctctcagaaaagagaaatgctgtgactttggatttcaagggttttgggtgtgactttagagcctcttgcagtgacaggctcatataggacttcagtgggaccagctttctcaggggcagctacccctgagcgttcagtctgtagttggttgggcagatctggttgatctggctgtttgagggaccagtgattgaggcaggggctcttgactgcygtgtgtgtgtgtctgtgtgtgtgtctgtgtgtagatgggtacttatgtgcagttgaggcaggtcaaacactaccatgaaagacttgtagagcagtggatcttttttttttttttttgagatggagtctcgttctgtagcccaggctagagtgcagtggcacaatctcggctcactgcaacctccgcctcccgggttcaagcaattctcctgcctcagcctcttgagtagctgggactacaggcacgtgccaccacacctggctaatttttttttttttaagtagagacagggtttcactg

SEQ ID NO: 183038 - DNA, 601 bp, Human
atgctgtgactttggatttcaagggttttgggtgtgactttagagcctcttgcagtgacaggctcatataggacttcagtgggaccagctttctcaggggcagctacccctgagcgttcagtctgtagttggttgggcagatctggttgatctggctgtttgagggaccagtgattgaggcaggggctcttgactgccgtgtgtgtgtgtctgtgtgtgtgtctgtgtgtagatgggtacttatgtgcagttgaggcaggtcaaacactaccatgaaagacttgtagagcagtggatcttttttttttttttttgagatggagtctcgttctgtagcccaggctagagtgcagtggcacaatctcggctcactgcaacctccgcctcccgggttcaagcaattctcctgcctcagcctcttgagtagctgggactacaggcacgtgccaccacacctggctaatttttttttttttaagtagagacagggtttcactgcgctagccaggatgttctcaatctcctgacctcgtgatccgcccgccttggcctcccaaagtgctgggattacaggcgtgagccaccgcgcctggccagagca

SEQ ID NO: 183039 - DNA, 601 bp, Human
tgttccccatagcctgagtcctgctggggtagcagctctgcctagtggagggcagggacagggaaggccctgggagaggaagacagctggcttactgctgtcagtctacgcttattctccgtgaacgagcaagtgtcccaaggtcctttgagggaccagggtctgaggcactgggctgctggatgtgtgcagcttatggtagcattgtgttttgcttctcatgagaaccttgtgggagccagttctcaccccatactcagcaggctgaggtcagggtagctgtttatggcttacttttttwaaatttatttttatttatttatttgtttatttatttatttattttgagacaaggtcttgccttgttgcccaggctggagtgcagtgcaccctagacctcccggactcaaggcatcttcctacctcagcctcctgagtagctaggactacttaagaggaagcaggggaggaaggggacgtggaggtggggggtcctctctaggttgcccaggctgttcttctgggctcaagtgatcttcctgcctcagcctcccaaagtgctgggattacaggtgtgagccactgtgcccggcctactggt

SEQ ID NO: 183040 - DNA, 601 bp, Human
tttaaattgggtgatcagggaatgtcccacctagaagatgcatttgagcaaaggcaggcaggagactggaccatgtgttttcccagggaaatggtgttcttggcagagcagacagcaagcacagagtccctgtaggcctggtctgtgctgggcactgtactgaacacttgatgctgactattgaattgactggtcacagcatccttggaagctggttctgccattatgcccattttactgatgagaaaacggaagctcagggagattaaattacttactggcggtgtcacaggtcatattsggtactgctgggacttgaacctgacagttcagttcagcctcagggcccatgtgtctaaccagcattgccaaacagtctcccaagcagagatttggaagcctattttatttatttatttttatggtttttttttaattgagatgaaattcacataatgtaaaattaaccattttgaagtgaacaattcagtggtgtttaatattaatacattcacaacgttgtacaatgaacacctccgtccagttccaaaatgttttcgtcaacccaaaaggaaaccccatacccataaagcaattgctc

SEQ ID NO: 183041 - DNA, 601 bp, Human
ggtagcctgaggaggctggacagctgaggggctccctcccacagatactttttcctcccctacatctggtattacttgaaagattttgtctacccaacacgctacatttgttaaataatggttagattctacttccaaacagaagaatgtttaatggtgcagggcgcttggcagtgagagtcagagtgacacaactccccatgagaggtgatgtcactcaggccaaaagcaaagcaaagtagatgtttgggttagcttgggccccttcctaggttgaactgaaggtgtccctttgggcatwtgactttgtgggaagagcttgtgaatccctgttgccacctttgtaagcccttagagtctcaagatgcccagtttccagttactgattaacttggcacgggaactctcctggcactttccatggctggtctttgtgggtttagtaaaataggatcctacagaggcgtgtctctttccctactctgctgggcctacttcctcctccagccatcctccccaccccctgtccccgttgcctctttgtgtctctctgtccatgttgttgggtttttggtcttctaggcgttgctcctggcctaca

SEQ ID NO: 183042 - DNA, 601 bp, Human
aaaaacaaaaacaaaaaaccccacaaataaaccacttgtcataggctgggtttcctgggaagctgactgagacagagttgaccatacaagggcttattaaaaggtgcttttggggtccccacctgtggaagatggagaaggaatcaggagtgggtagaggagagctgagctgctgggacctgaccccgcagggagcctgggagctggaaaagtcctttagggtcatcctagttggcctgacatggcctggccttcacactccctcatggatcagctgttggctgtgggctgcccaggaagatggtgactttgggcgaggcagctctgtgcagctgggatagtctcttcaggggctgacaggagggcaacctgcctgccgcaccccagcagctgtgccctcccctgtcctcgccttcatcgaagggcctttgcagcatccccacagtgcccccttcctgggggcaggtaggagcgggtgacttgggcattatggttctagtagtagctaccgtgtgtcaagtgccagtggtgtgccgggcactggagttcagtgctttgtgggccttgttggcatttaacctgcacacttagttttgatgta

SEQ ID NO: 183043 - DNA, 601 bp, Human
agtctcttcaggggctgacaggagggcaacctgcctgccgcaccccagcagctgtgccctcccctgtcctcgccttcatcgaagggcctttgcagcatccccacagtgcccccttcctgggggcaggtaggagcgggtgacttgggcattatggttctagtagtagctaccgtgtgtcaagtgccagtggtgtgccgggcactggagttcagtgctttgtgggccttgttggcatttaacctgcacacttagttttgatgtaggcaccattctctgtttacagttgagaaaccgaggccaragaggttaagtgacttgctcaagaccatatgggtacaagtagtggtgctcccataccagtcgggattttgcttctgctctgaccacttgcatggtgggactaggtggtctctcacgtctgagtggatgccttctattgcccctccagattcattctccacccacgtactgtagggagcttttgtgggctccttgcgttttccatgccttcttcccccatatttcaggctgtggacttttttattttttttttgagacagagtctcgctctgtcgcccaggatggagtgcagtggcgcgat

SEQ ID NO: 183044 - DNA, 601 bp, Human
acggatgttcttctggccagtgctgtgctgccaatgccaccaatcccttccaagcaggctgatctgctgggagctgtagccctggcgcgtcccgacatggattcccacagcgtctgcctgtcccgtcatgctttctctctggagtcctccctccttggtatggtatgtttctgctctgttcttttgtgaccaggaaagaatgtcttgtttcttccatccagccctcctgctctttccattaacagtccagaacatgaaacggttattttgacatgatcattcttgccaggggtcttaaaargttatgtttctttacatctgttgatttgtgactgtcacataggagacagaactgtgcaagaaagacacatatttgggagtcaggaaaccaggtcttctgggcctgataccaccagcagctcagggtgtgatgttgggcaagtccctctagctctattgagccaagatgacctctcagggtccttcccggcccaaagtcctgtgacagtggcattaggtataactagatgcctgggtttcagctaaccatgtaacagggactgggcagcattattgttggcagtggcagagagcctggaaa

SEQ ID NO: 183045 - DNA, 601 bp, Human
ccctccttggtatggtatgtttctgctctgttcttttgtgaccaggaaagaatgtcttgtttcttccatccagccctcctgctctttccattaacagtccagaacatgaaacggttattttgacatgatcattcttgccaggggtcttaaaaagttatgtttctttacatctgttgatttgtgactgtcacataggagacagaactgtgcaagaaagacacatatttgggagtcaggaaaccaggtcttctgggcctgataccaccagcagctcagggtgtgatgttgggcaagtccctcyagctctattgagccaagatgacctctcagggtccttcccggcccaaagtcctgtgacagtggcattaggtataactagatgcctgggtttcagctaaccatgtaacagggactgggcagcattattgttggcagtggcagagagcctggaaaggcagaggccaagcggcctggcatcccagcccctttccagacctttacggaattaaaaaacaatttttatttttagttatggttacatttgcaattgtaagtggtaatcacttttactttagatattctggaaaatacatacaattaa

SEQ ID NO: 183046 - DNA, 601 bp, Human
accagcagctcagggtgtgatgttgggcaagtccctctagctctattgagccaagatgacctctcagggtccttcccggcccaaagtcctgtgacagtggcattaggtataactagatgcctgggtttcagctaaccatgtaacagggactgggcagcattattgttggcagtggcagagagcctggaaaggcagaggccaagcggcctggcatcccagcccctttccagacctttacggaattaaaaaacaatttttatttttagttatggttacatttgcaattgtaagtggtaatcayttttactttagatattctggaaaatacatacaattaaagaagaaacatgaatcactcatgtaccttccattcttagaataatcagtgttaagactgtctgcagaaagtatccagtacaaagtagtggctgagcccactggtgatacagaatgtatcaggcactgtgattcttggatctctggccaaatgtagaatcatttactgagctaaaggccaatttgcttggaagagtgcatctaattaaagtgagattagaaaggacgaaaggtgtcctttaggaaataaccacacatggcaagc

SEQ ID NO: 183047 - DNA, 601 bp, Human
aacatgaatcactcatgtaccttccattcttagaataatcagtgttaagactgtctgcagaaagtatccagtacaaagtagtggctgagcccactggtgatacagaatgtatcaggcactgtgattcttggatctctggccaaatgtagaatcatttactgagctaaaggccaatttgcttggaagagtgcatctaattaaagtgagattagaaaggacgaaaggtgtcctttaggaaataaccacacatggcaagccactggtatgatgatgatcaccaaccctgcaggccttttgaggygctcattccaattaaacttgtcatccttagtgcagggggcagctgggagctctggtttgtggcgttcactgtccttgtttgtaccggcatgacccagtcctctccgtgggctcctgtggcgccctgggtgttgttgggtctcaggcctgatcatttgtcataggacagtgggctcaggcccagcagtgtctgggccagtctcccttctttgtcccagtgccccacatgctgtgggctccgtggatgcctgttgaaggagcggagggacttccattaggccgtgaaggtggaataagggat

SEQ ID NO: 183048 - DNA, 601 bp, Human
cgctcattccaattaaacttgtcatccttagtgcagggggcagctgggagctctggtttgtggcgttcactgtccttgtttgtaccggcatgacccagtcctctccgtgggctcctgtggcgccctgggtgttgttgggtctcaggcctgatcatttgtcataggacagtgggctcaggcccagcagtgtctgggccagtctcccttctttgtcccagtgccccacatgctgtgggctccgtggatgcctgttgaaggagcggagggacttccattaggccgtgaaggtggaataagggawttttagctggggttatggctctgagacagttttactaaaattggtctagcagtttctctgccagacacttttctaagcacttcttatgctttactcacctgtattacgttgttcaatcctcccaacaaccctactttattaaccccatttcacagatggagaaactgagctacacagaagttaagtggcccgcctagtacttttatgaagtatctttgctgagtctggctgctgagttggagattttgaccactgtgttgtgatgcctcttagctcttggaagtttctcctttctaacaa

SEQ ID NO: 183049 - DNA, 601 bp, Human
gcctagtacttttatgaagtatctttgctgagtctggctgctgagttggagattttgaccactgtgttgtgatgcctcttagctcttggaagtttctcctttctaacaaagaagaaacttcaggggctactgtggctagggtaggtcaaggctgaggtctttttgtactctggtggagccagggccattccaggagcagcaaagaaggcagagtgtggaggcatgcctgagctgactggaggagttgggtcccactcttgcaacgagaggctgtctccagctttctcttctgtccaggagygtgtgcctgcacaagtgcctccctgcagggcagtggacagagccccagaggctcggaggcacatgggctgccttgtgttcctctgaagaggtgtgggttagggcaagtggaccatgtcctcaggggtgctcgtgtgatatccccaagtgctgcaggcataggtaggggtgtgccagcccatacttcccttgggcgtgagcaagatgccttgtctgggggtcaggagcaaccccaggctgtgtgcagaggtgcttgaaccaaattttgttttgttttgtcttttgtttttgaggcagagtc

SEQ ID NO: 183050 - DNA, 601 bp, Human
cctagtacttttatgaagtatctttgctgagtctggctgctgagttggagattttgaccactgtgttgtgatgcctcttagctcttggaagtttctcctttctaacaaagaagaaacttcaggggctactgtggctagggtaggtcaaggctgaggtctttttgtactctggtggagccagggccattccaggagcagcaaagaaggcagagtgtggaggcatgcctgagctgactggaggagttgggtcccactcttgcaacgagaggctgtctccagctttctcttctgtccaggagcstgtgcctgcacaagtgcctccctgcagggcagtggacagagccccagaggctcggaggcacatgggctgccttgtgttcctctgaagaggtgtgggttagggcaagtggaccatgtcctcaggggtgctcgtgtgatatccccaagtgctgcaggcataggtaggggtgtgccagcccatacttcccttgggcgtgagcaagatgccttgtctgggggtcaggagcaaccccaggctgtgtgcagaggtgcttgaaccaaattttgttttgttttgtcttttgtttttgaggcagagtct

SEQ ID NO: 183051 - DNA, 601 bp, Human
gggtaggtcaaggctgaggtctttttgtactctggtggagccagggccattccaggagcagcaaagaaggcagagtgtggaggcatgcctgagctgactggaggagttgggtcccactcttgcaacgagaggctgtctccagctttctcttctgtccaggagcgtgtgcctgcacaagtgcctccctgcagggcagtggacagagccccagaggctcggaggcacatgggctgccttgtgttcctctgaagaggtgtgggttagggcaagtggaccatgtcctcaggggtgctcgtgtgayatccccaagtgctgcaggcataggtaggggtgtgccagcccatacttcccttgggcgtgagcaagatgccttgtctgggggtcaggagcaaccccaggctgtgtgcagaggtgcttgaaccaaattttgttttgttttgtcttttgtttttgaggcagagtctcgctctgttgcccaggctggagtgcagtggcaatatctcagctcactgcaaccttgcttcccagtttcaagcaattctcgtgcctcagcttcccaagtacctgggattacaggcacactccaccttggccggctaat

SEQ ID NO: 183052 - DNA, 601 bp, Human
gcaggtctcgaactcctgacctcaagtgatccacccgccttggcctctcaaagtgctgggattacaggtgtgagccaccatgcctggcctataaccaaattttggatgacactgtccttagagtccatccagcaaactgaacagaaaccttgtcctaaaacaaaacaggtcaccgaaatttccaaggcgtggcaacgcagggtagcacttgccagcgaatatttatatccactccagtttttgttttccatttttccccttacagggaaaccagctggacacagggtctcggggtcacackggaaggcaggagactttctgcttgagtgtttcaaagggagttcttgggatccacagccaggttatttttaagttttgagagccatgagtttaaacttggccaagttccttcctcatctttcttgttgtctgactgtcgctgtgtccccggggagtgaggatgggttactcccggttactgaaagctggtggggagcatctcaggggtctctacctccctccccacaaacatgttttgtagcacacaaaaagttctggaagcctgccatgatgctgtcattccagggagggagtttgcatt

SEQ ID NO: 183053 - DNA, 601 bp, Human
cagcaaactgaacagaaaccttgtcctaaaacaaaacaggtcaccgaaatttccaaggcgtggcaacgcagggtagcacttgccagcgaatatttatatccactccagtttttgttttccatttttccccttacagggaaaccagctggacacagggtctcggggtcacactggaaggcaggagactttctgcttgagtgtttcaaagggagttcttgggatccacagccaggttatttttaagttttgagagccatgagtttaaacttggccaagttccttcctcatctttcttgttgtstgactgtcgctgtgtccccggggagtgaggatgggttactcccggttactgaaagctggtggggagcatctcaggggtctctacctccctccccacaaacatgttttgtagcacacaaaaagttctggaagcctgccatgatgctgtcattccagggagggagtttgcatttagcatgagtcctccctgcagctagttctggaaggatagtgactgaggtacttagaggacctagtggataaggcacccctctttagcaggcaggctccaagtcagggggtgagcacatattccagcagg

SEQ ID NO: 183054 - DNA, 601 bp, Human
ggctaggttccagggcatttgctgacagttatctttacattaaatgtgggcagcaaggattgcattgcaggcctgattgtgctgctttctggctgtaagcttgacttttctgcttcacttttctgtcctcagtttcttcatattatggagactggaggtcctgtgctgcttataatcctgtgtcctttcccttgctttgagcctcagagccagttttagattcagggttgttggctgggagaagactcttggctctgagggtgacagtggtttagggagaacttgcttcggacaccttgtrtgtatgggcgggggcatcgcaggcatgtacattggttgaacttggaagctttccctcatttgcttgcagagaagcccactgacggagtgaagaagcctgagttggggagggtgtgaaaaacgtgtacaatgacaaagtttgtttagaagcaagagaggccctgtctctaagaagtaaggagaatgacgctgggcacgtggctcacacctataatcccaacacttttggaggccgaggcgggcggatcacttgaggtcaagagtttgagaccagcctggctaacacagtaaaaccctgtct

SEQ ID NO: 183055 - DNA, 601 bp, Human
acggagtgaagaagcctgagttggggagggtgtgaaaaacgtgtacaatgacaaagtttgtttagaagcaagagaggccctgtctctaagaagtaaggagaatgacgctgggcacgtggctcacacctataatcccaacacttttggaggccgaggcgggcggatcacttgaggtcaagagtttgagaccagcctggctaacacagtaaaaccctgtctgtactaaaaatacaaaaattagctgggtgtggtggcgcatgcctgtagtcccagctactcgggaggctgaggcaggagaatygcttgaacctgggaggcggaggttgcagtgagccaagattgtgtcattgcactccagcctgggcaacagagcgagactcggtatcaaaaaaaaaaaaaaaaaaaagaaggagaatgaagaaataaaaccaaacactgaattagtgataaggttcaaaatagaaaccgaaagacctggtctgtagaagttactcatgagatatttgttgaatgaatgaatcatggtatgtatttataatattacccaatcagaataaaaaagggaaatattttggtgacagtgctactgtttgctcagcag

SEQ ID NO: 183056 - DNA, 601 bp, Human
acgctgggcacgtggctcacacctataatcccaacacttttggaggccgaggcgggcggatcacttgaggtcaagagtttgagaccagcctggctaacacagtaaaaccctgtctgtactaaaaatacaaaaattagctgggtgtggtggcgcatgcctgtagtcccagctactcgggaggctgaggcaggagaatcgcttgaacctgggaggcggaggttgcagtgagccaagattgtgtcattgcactccagcctgggcaacagagcgagactcggtatcaaaaaaaaaaaaaaaaaaaagaaggagaatgaagaaataaaaccaaacactgaattagtgataaggttcaaaatagaaaccgaaagacctggtctgtagaagttactcatgagatatttgttgaatgaatgaatcatggtatgtatttataatattacccaatcagaataaaaaagggaaatattttggtgacagtgctactgtttgctcagcagtagtggctaagaaacagtggatgctacataggtattttctccataacttgtgcctggtagtagctgtgccaattttcaccagaccttgattacctgttagagtt

SEQ ID NO: 183057 - DNA, 601 bp, Human
caacacttttggaggccgaggcgggcggatcacttgaggtcaagagtttgagaccagcctggctaacacagtaaaaccctgtctgtactaaaaatacaaaaattagctgggtgtggtggcgcatgcctgtagtcccagctactcgggaggctgaggcaggagaatcgcttgaacctgggaggcggaggttgcagtgagccaagattgtgtcattgcactccagcctgggcaacagagcgagactcggtatcaaaaaaaaaaaaaaaaaaaagaaggagaatgaagaaataaaaccaaacastgaattagtgataaggttcaaaatagaaaccgaaagacctggtctgtagaagttactcatgagatatttgttgaatgaatgaatcatggtatgtatttataatattacccaatcagaataaaaaagggaaatattttggtgacagtgctactgtttgctcagcagtagtggctaagaaacagtggatgctacataggtattttctccataacttgtgcctggtagtagctgtgccaattttcaccagaccttgattacctgttagagttttgaagggagagcttatctggtgaggacttg

SEQ ID NO: 183058 - DNA, 601 bp, Human
aatcacttgaacccgggaggcgagtgagccgagattgtgccactgcattccagcctgggcaacagagcaaggctctgtctcaagaaaaaaaagacttctcgaatgaatatgtgtacactctggccagatgtggggagcagatactccctgacttcctcctgagtgtcagtgcctttagctgggacacacattctggcatcaatccataccctacactgacgtggtagggaggcaggggcactgggctgctgtccacatccctcaccctgaccagagttactcagatgagcgctctcatgtkggtaggagatgcctttggtagctgaggactagaggggccagaaagggttgggatacatgctttatctggatagaaacttatagagttccagggactagctcaccaaaggcctgcgcaggtttggcagggagcagggagacatgctggcaggcatgcatggtggctttgatttgaggagctgttggtgggaatgaaaagcctaataagcacgtgggctttggatctgccaccccccagctctgccaacagctgtgagaccttgggcgggttgttcagcagccctgtacctcagtttcccca

SEQ ID NO: 183059 - DNA, 601 bp, Human
gagtgtcagtgcctttagctgggacacacattctggcatcaatccataccctacactgacgtggtagggaggcaggggcactgggctgctgtccacatccctcaccctgaccagagttactcagatgagcgctctcatgtgggtaggagatgcctttggtagctgaggactagaggggccagaaagggttgggatacatgctttatctggatagaaacttatagagttccagggactagctcaccaaaggcctgcgcaggtttggcagggagcagggagacatgctggcaggcatgcatgktggctttgatttgaggagctgttggtgggaatgaaaagcctaataagcacgtgggctttggatctgccaccccccagctctgccaacagctgtgagaccttgggcgggttgttcagcagccctgtacctcagtttccccatcagtaaaatgtgcatatggttgtgaggactgaattagctagtatctgatctaagttgtccagtacgggagactggccacgtgcaactgtgaagtacttcaaaaggtggcttttctgaactgagatgtgcttttgaagcacatctggattttgaagactt

SEQ ID NO: 183060 - DNA, 601 bp, Human
ctgaccagagttactcagatgagcgctctcatgtgggtaggagatgcctttggtagctgaggactagaggggccagaaagggttgggatacatgctttatctggatagaaacttatagagttccagggactagctcaccaaaggcctgcgcaggtttggcagggagcagggagacatgctggcaggcatgcatggtggctttgatttgaggagctgttggtgggaatgaaaagcctaataagcacgtgggctttggatctgccaccccccagctctgccaacagctgtgagaccttgggcrggttgttcagcagccctgtacctcagtttccccatcagtaaaatgtgcatatggttgtgaggactgaattagctagtatctgatctaagttgtccagtacgggagactggccacgtgcaactgtgaagtacttcaaaaggtggcttttctgaactgagatgtgcttttgaagcacatctggattttgaagacttggtatggagaaaagagtggcttattaatatttttcatattgattctatgttgaaatgagacttttggatatattggcctaagtaaaacattaaaattagtttcacc

SEQ ID NO: 183061 - DNA, 601 bp, Human
atagagttccagggactagctcaccaaaggcctgcgcaggtttggcagggagcagggagacatgctggcaggcatgcatggtggctttgatttgaggagctgttggtgggaatgaaaagcctaataagcacgtgggctttggatctgccaccccccagctctgccaacagctgtgagaccttgggcgggttgttcagcagccctgtacctcagtttccccatcagtaaaatgtgcatatggttgtgaggactgaattagctagtatctgatctaagttgtccagtacgggagactggccaygtgcaactgtgaagtacttcaaaaggtggcttttctgaactgagatgtgcttttgaagcacatctggattttgaagacttggtatggagaaaagagtggcttattaatatttttcatattgattctatgttgaaatgagacttttggatatattggcctaagtaaaacattaaaattagtttcacctatttttacttcctaagtatggatacttgaaaatgtaaaatcgcacgtggcttgcatatttttctgctgggcagggctgtgccttacaaagcacttagaacaggctgtaacaca

SEQ ID NO: 183062 - DNA, 601 bp, Human
gcctaataagcacgtgggctttggatctgccaccccccagctctgccaacagctgtgagaccttgggcgggttgttcagcagccctgtacctcagtttccccatcagtaaaatgtgcatatggttgtgaggactgaattagctagtatctgatctaagttgtccagtacgggagactggccacgtgcaactgtgaagtacttcaaaaggtggcttttctgaactgagatgtgcttttgaagcacatctggattttgaagacttggtatggagaaaagagtggcttattaatatttttcatrttgattctatgttgaaatgagacttttggatatattggcctaagtaaaacattaaaattagtttcacctatttttacttcctaagtatggatacttgaaaatgtaaaatcgcacgtggcttgcatatttttctgctgggcagggctgtgccttacaaagcacttagaacaggctgtaacacatggtcgtttgctgtatacattctcttgctttgtcattttctcaaaagcatggaagcgtctttaccttgtcccatctgaaagccaagcccaatcgatttgttcagaaccacaaatgctt

SEQ ID NO: 183063 - DNA, 601 bp, Human
taagtaaaacattaaaattagtttcacctatttttacttcctaagtatggatacttgaaaatgtaaaatcgcacgtggcttgcatatttttctgctgggcagggctgtgccttacaaagcacttagaacaggctgtaacacatggtcgtttgctgtatacattctcttgctttgtcattttctcaaaagcatggaagcgtctttaccttgtcccatctgaaagccaagcccaatcgatttgttcagaaccacaaatgcttaaacaaaaagatcatcatttgttcaagggaggctgatttcrtgattgccaaccaccaagtgagcccactgaggccaaatgcctgatgcaagggatggcaggctgctcccacgcagccttagaacgaatccgttcccacttgaagcaggggggctctggggtccgaagctgctgtgtgcacagggcttgatggagcaggtggtcattgcagctgagccaactttccagcgccttaaaaaatacactcagtttagcaagtacaggcagaaagcccaaagagatggcccatccccttgagggaggtagagaagtgaacgatggtgtttcctgtcccaagaggtg

SEQ ID NO: 183064 - DNA, 601 bp, Human
cccttgagggaggtagagaagtgaacgatggtgtttcctgtcccaagaggtgggaggaaggctgtttgggatttggctcatcaggggccacaggctactgggatgcctatgtcctatccctctgtgtaggctatggagccctttcctgggtatgggcctcccaataagcctgtggccaatgcaggggcaggctgggaggtggctttccaggcagcttgcaaaggcctgtttgtctgaggcttgtcctgacatcactgaggctttgcttgcaggtggcagggacttacacagaggctctttrttggccagccacagaggtcagttagaagccatgaatggactggagctggcagcccctcctctacccatagcacacagctgccacctctctgggttgcccatgcctgacggtgggtgtgtgaggtgtggggagaggcatctctgcccaaatttgtagccagagagcagaggaagtgaagttggtgggaggcggtgaggaaggcagggagaaagaaaggaggtggtgttgaggaagctagcatggcttctgcccagctctgtcatggtttgcaggtgcgcgctctctctctctctctctctc

SEQ ID NO: 183065 - DNA, 601 bp, Human
gatgcctatgtcctatccctctgtgtaggctatggagccctttcctgggtatgggcctcccaataagcctgtggccaatgcaggggcaggctgggaggtggctttccaggcagcttgcaaaggcctgtttgtctgaggcttgtcctgacatcactgaggctttgcttgcaggtggcagggacttacacagaggctctttgttggccagccacagaggtcagttagaagccatgaatggactggagctggcagcccctcctctacccatagcacacagctgccacctctctgggttgcccaygcctgacggtgggtgtgtgaggtgtggggagaggcatctctgcccaaatttgtagccagagagcagaggaagtgaagttggtgggaggcggtgaggaaggcagggagaaagaaaggaggtggtgttgaggaagctagcatggcttctgcccagctctgtcatggtttgcaggtgcgcgctctctctctctctctctctctctctctctttaaagacaaattctcactctgtacccaggttagagttcagtggcaccatcttagctcactgtagccttggcttcctgggctcaagcaatcc

SEQ ID NO: 183066 - DNA, 601 bp, Human
gggcctcccaataagcctgtggccaatgcaggggcaggctgggaggtggctttccaggcagcttgcaaaggcctgtttgtctgaggcttgtcctgacatcactgaggctttgcttgcaggtggcagggacttacacagaggctctttgttggccagccacagaggtcagttagaagccatgaatggactggagctggcagcccctcctctacccatagcacacagctgccacctctctgggttgcccatgcctgacggtgggtgtgtgaggtgtggggagaggcatctctgcccaaatttrtagccagagagcagaggaagtgaagttggtgggaggcggtgaggaaggcagggagaaagaaaggaggtggtgttgaggaagctagcatggcttctgcccagctctgtcatggtttgcaggtgcgcgctctctctctctctctctctctctctctctttaaagacaaattctcactctgtacccaggttagagttcagtggcaccatcttagctcactgtagccttggcttcctgggctcaagcaatcctcccatcccagccccccgaataactggaaacacaggtatgcacaaccatgcc

SEQ ID NO: 183067 - DNA, 601 bp, Human
acttacacagaggctctttgttggccagccacagaggtcagttagaagccatgaatggactggagctggcagcccctcctctacccatagcacacagctgccacctctctgggttgcccatgcctgacggtgggtgtgtgaggtgtggggagaggcatctctgcccaaatttgtagccagagagcagaggaagtgaagttggtgggaggcggtgaggaaggcagggagaaagaaaggaggtggtgttgaggaagctagcatggcttctgcccagctctgtcatggtttgcaggtgcgcgckctctctctctctctctctctctctctctttaaagacaaattctcactctgtacccaggttagagttcagtggcaccatcttagctcactgtagccttggcttcctgggctcaagcaatcctcccatcccagccccccgaataactggaaacacaggtatgcacaaccatgcctggctaatttgttaatttttgtagaggcagggtctcgctgtcttgcccaggctggtcttgaactcctgggctcaagtgatcctcccacctcggcctcccaaagtgctaggataacaggtgtgagccac

SEQ ID NO: 183068 - DNA, 601 bp, Human
aaatgtgtagttcagtgagttttgacagatgcatgcacctgtgtgacccacattcctatcaagatatagaatagttccatccccagaaagttccctcatgcttctttccagttagtgctcacctccaggcaactacaattctgattttttaaaatcatttattagttttgcccattctaagatgtaatataaatggattcatatagtatttatatacagttgatcttcattatccacagattctgtatttgtgaatcagcttacttgctaaaatttatttgtaaccccaaaattaatactyacagttcttttgtgatcattcacagatataacagagtgctgaaaagtttgagtcccctgacgcctatcttcccagctgaagtcgaacaaggcaacgctccgccttcttgtttcaggtcatgcagtaaacaggtgtccttttcatggtctatttagtgccatggtttttgcatttttgtggtttttgttgatgattttgctgtttcaaatggcccccaggcacagtgctggagtgctttctagtgttcctaagagcaagagggctgtgatgtgctttacaacgagaatatgtatgagagaa

SEQ ID NO: 183069 - DNA, 601 bp, Human
tgaaagtgttgtggtcagaagttttcagaaacctaaccctgtatttctgccagaagcagtggttcagtattgactgattcagtattcttgccaaataatgagaatcaactatagtactcctttgtccagcttatttcactcagataatatctgtgaaattcagctatgctgttgcattatcaactgggctttttgcattatcaattgtgcttttgttttactgctgagtaatattacattgtatggatacaccacaagatttgtttttccatttccctgttgaggttttttttttttttttcatttttggctattatgaataagtctgttaggattgtttttgtgtaagactttgggttttttttttgtttgtttttttcttttgtaaatatgggatctcgctatgttgtccaggttggttttgaactcctggcttcaagtgattctcctgccttggcctcctaaagtgctggaattataggcatgagccactgcaccttatatgtacaagtctttgtatagacacaggctttcgtttctcttgggtaaatacctaggagtagaattgctggatcatggagtaggtgtatgtataactttt

SEQ ID NO: 183070 - DNA, 601 bp, Human
taaaaaattagccgggcgtggtggcgggcacctgtagttaaaaaaaaaaaaaaaaaaggaaatcctctgcccgggtgctgtggttcacgcactttgtaatcccagcactttgggagctgaggcagggggattgcttgagcttagagattcaagaccagcctgggcaacatggtgaaactttgtctctacgaaaaatacaaaaattagctgggcgtggtggtgcgtgcctatagttccaggtaccggggaggctgaggtgggaggatcatatgagcccaggaggtcaaagctgcagtgagcyatgatcacaccactgcattccagcctgggcaacagaatgaggccctgtctcaaaaaaagtgataataataataaaataaaaaataaattcctgggtgttttttttttttttttgccattttttaaaccttaaacacagctaactgtagaaaagtcagaaagtatagaaaaaaattggaaaggtcacccatcatcctactctagggataatcactgttaggatagacttttttttcttttacacatagatatttaattttaaagaatttgagtgaactaaaattaactttgttgtagattt

SEQ ID NO: 183071 - DNA, 601 bp, Human
tgaggcagggggattgcttgagcttagagattcaagaccagcctgggcaacatggtgaaactttgtctctacgaaaaatacaaaaattagctgggcgtggtggtgcgtgcctatagttccaggtaccggggaggctgaggtgggaggatcatatgagcccaggaggtcaaagctgcagtgagccatgatcacaccactgcattccagcctgggcaacagaatgaggccctgtctcaaaaaaagtgataataataataaaataaaaaataaattcctgggtgttttttttttttttttgccrttttttaaaccttaaacacagctaactgtagaaaagtcagaaagtatagaaaaaaattggaaaggtcacccatcatcctactctagggataatcactgttaggatagacttttttttcttttacacatagatatttaattttaaagaatttgagtgaactaaaattaactttgttgtagatttggggactttagtgaaagttgggccaatagaggatgtcggggagcagaacttcccctcttctctcttggggtcctggtggggtctgaaaactaaattgacataggtaaatagaagagc

SEQ ID NO: 183072 - DNA, 601 bp, Human
ttttttttttttttgccattttttaaaccttaaacacagctaactgtagaaaagtcagaaagtatagaaaaaaattggaaaggtcacccatcatcctactctagggataatcactgttaggatagacttttttttcttttacacatagatatttaattttaaagaatttgagtgaactaaaattaactttgttgtagatttggggactttagtgaaagttgggccaatagaggatgtcggggagcagaacttcccctcttctctcttggggtcctggtggggtctgaaaactaaattgacrtaggtaaatagaagagcatacacatttaataaaagttctatgtgacacgggagccctcataaacaaatgaagacccaaagcagtggcaaaacatacatgtgtttatatgaggttgaacaaagagaggcatttgtgggaaagtaaccaaattatgtggggaggctaaaggaaagtaagccttattttaacaaggtctgtttgtacagaattttctctgctgttactctccattgaagagtgtttgttttctcatggtacagggagggcaccttttattttattttgtattttatttgtatg

SEQ ID NO: 183073 - DNA, 601 bp, Human
gctacttgttggcaatgctgcttccctctggtttaagaaactttctgggagacttgtgtcaccccagtttctgcctttatttttcgcaggaatggctgggttctattttgatatgagtaattttggaatcagaattgagaactgggcccccttcctcctgaccccaacagggatctcttgccagctgcccccaacagggatctcttgccagcatcttcctgacaaacctctgttccttgctgtctcactctctcgagggacagctggacaagtgtcaatgagttgagattgttagaaggtktttcttctccagccagcagccttcccaaagacctgacctacttagcaggcagatggatcctgtaaaaacaaaaccgggtcacatccctcctgggcttggaaagaatccttcagtgcccccgaccccttcttcctcacccacagaattggagccaaagtcctgaaagtagccttggaggtcctgccttccccaccctgagtccctgctgtgtgctgcacccgggtcccctcctggctgtgagcccatcactattccagtttctttccactgcacaaggtagttgttcaggcccctccctga

SEQ ID NO: 183074 - DNA, 601 bp, Human
gctgggttctattttgatatgagtaattttggaatcagaattgagaactgggcccccttcctcctgaccccaacagggatctcttgccagctgcccccaacagggatctcttgccagcatcttcctgacaaacctctgttccttgctgtctcactctctcgagggacagctggacaagtgtcaatgagttgagattgttagaaggtttttcttctccagccagcagccttcccaaagacctgacctacttagcaggcagatggatcctgtaaaaacaaaaccgggtcacatccctcctggkcttggaaagaatccttcagtgcccccgaccccttcttcctcacccacagaattggagccaaagtcctgaaagtagccttggaggtcctgccttccccaccctgagtccctgctgtgtgctgcacccgggtcccctcctggctgtgagcccatcactattccagtttctttccactgcacaaggtagttgttcaggcccctccctgaaagatgtgttggttcttcaagattcacaagcaaatcatgcctgtgtgtgcattgcagatagctcacttacattagatttgatatgagaaagtct

SEQ ID NO: 183075 - DNA, 601 bp, Human
tggaggtcctgccttccccaccctgagtccctgctgtgtgctgcacccgggtcccctcctggctgtgagcccatcactattccagtttctttccactgcacaaggtagttgttcaggcccctccctgaaagatgtgttggttcttcaagattcacaagcaaatcatgcctgtgtgtgcattgcagatagctcacttacattagatttgatatgagaaagtctttttttttttttttgagacggaatcttgctttgtctcccaggctggagtgtggtggcgcaatcttggctcactgcagcytctgtctcccgggctcaagtgattcaagctgaggttacaggtgtgcgccaccatgcccagctaatttttgtatttttagtagagacggggtttcaccatgttggctaggctggtctcgaactcctgacctcgtgatccacccgccttggcctcccaaagtgctgggattacaggtgtgagccaccgtgcctggcctatttttttttttttttttgagacagagtctagctctgtcgcccaggctggagtgcagtggcaccatctcagctcactgcagcctctgcctctcaggttcaagca

SEQ ID NO: 183076 - DNA, 601 bp, Human
gaaagtctttttttttttttttgagacggaatcttgctttgtctcccaggctggagtgtggtggcgcaatcttggctcactgcagcctctgtctcccgggctcaagtgattcaagctgaggttacaggtgtgcgccaccatgcccagctaatttttgtatttttagtagagacggggtttcaccatgttggctaggctggtctcgaactcctgacctcgtgatccacccgccttggcctcccaaagtgctgggattacaggtgtgagccaccgtgcctggcctatttttttttttttttttgagacagagtctagctctgtcgcccaggctggagtgcagtggcaccatctcagctcactgcagcctctgcctctcaggttcaagcagttctcctgcctcggcctccctagtagctgggactacaggtgtgtgccaccccacctggctaatttattttattattatttgtatttttagtagagatggggtttcaccatgttggccaggctggtctcaaactcctgacctcaggtgatctactcacctcggcctcccaaagtgctgggattacaggtgtgagccactgcaccagtccaagat

SEQ ID NO: 183077 - DNA, 601 bp, Human
tcccagcagccctgcaaagtgcccgccaattttctctcctgttttgaagatgggaaaactaaagcagagagccacaaggtcactcacctggtaagctgcagaactgaacaaagtgtgcttgtgaaactttctgtttgttctaaggagacaactgtgggtgggtggactctgctggaggctgtcccttgcctggctggcagcaaccaagccttctgcttctgacttgctggggagcgggaggacgggaagggctgtcggtggggaaattggagagaatacaaaacctcccctcagctttaayaggctctaccaacagttttcactttgcctcttttccttctctggtatagccttcctcctctttggtgaatgcagattcagagcatctctaaaatctactctgtgttacttctgaggagaattcgggattttattttttctggaaaaatgaaaggattttcattctggttcccttctggttccgtgtggtggggcacctcactgcctgaggtcactgacctctgagcccttcttgccactccagtcatctctgccccacatggacacactcagccgcctgctggagtttgtgttttccgtg

SEQ ID NO: 183078 - DNA, 601 bp, Human
actcagcctgcatgatggggtcaagacactttctgctggaggttgacatttgttttagtagtttatgttgatgcaaagatcctgggaaacatgcatgattttgagccttttcacaaggaagggtgatgttaaaagtgagctaacttgagaaactggcttcaaaatctgggccaatttgagcaacaaaataaataatggtagaagggtattgtaacccagagaataaaataaatatccacaagtccttaatgatgatataaatacataagtggggagaagggaaaacttttgtacagaggaytccattagtaaaatgtagaaagaatgatgaaaatgaagaggtcagcatttggaaagaccactgtaatagttgttgctgtcaagaatcatcaatggggctgggcatggtggctcatgcttgtaatcctagcacttggggagtccaaggtgtgtggatcacttgaagtcaggtgtttgagaccagcctggccaacatgatgaaaccctgtctctactaaaaattagctagaaatcgcttgaacctggggggcagaagttgcagtgagccaagattgcaccattgcactccaacctgggcaac

SEQ ID NO: 183079 - DNA, 601 bp, Human
cccagagaataaaataaatatccacaagtccttaatgatgatataaatacataagtggggagaagggaaaacttttgtacagaggattccattagtaaaatgtagaaagaatgatgaaaatgaagaggtcagcatttggaaagaccactgtaatagttgttgctgtcaagaatcatcaatggggctgggcatggtggctcatgcttgtaatcctagcacttggggagtccaaggtgtgtggatcacttgaagtcaggtgtttgagaccagcctggccaacatgatgaaaccctgtctctaytaaaaattagctagaaatcgcttgaacctggggggcagaagttgcagtgagccaagattgcaccattgcactccaacctgggcaacagagcaagactctgtctcaaaaaacaaacaaaaagaatcatcaatggatgctgcatagtgggcaaaaatatgataaggaatctcaaatatttcttcataaagctcttgcgctaattccaaagagaaaaagagtaattttacagtggagaaatctggccaataccaccttaactaagtgatcaagttaacaccagcagtaaaatgttctattctg

SEQ ID NO: 183080 - DNA, 601 bp, Human
gggacattcctgccaaaaatgcatatcctcagtctgatcatgaagaaacattaggcaaaccccagttcgggacagcatgcaagataattggcctatactcttccaaagtaccaaggtcaagaaagacaaagactgaggagctgtcccaggttaaaggagaccaagagagacaaccactaaatgcagtggatttagttccaggattgaattcctcccttcccctcccctcccctctcttttttcctttccttttcccttttctttccttacagggtcttgctctgttgccagactggactgyagtggtgtgaccatggctcactgcagccatgaactcccaggctcgaacaatcctcccacttcagcctcccaagtggctgggtctacaggcatgtaccaccacacctggctaattttttaaatcttttttattttatgtagagacaggggtcttactctgttgccaggctggtcttgaactcctaggctcaagagatcctcccaccttgacttcccaaagtgttgggattataggtgtgagccactgtgcctggccaacattttcattattatagaaacgtttctattaggcagtgctact

SEQ ID NO: 183081 - DNA, 601 bp, Human
agcactttgggaggctgaagtgggtggatcaaaaagtcaggagatcgagaccatcctggccaaaatgctgaaaccccgtgtgtactaaaaatacaaaagttagccaggcatggtggtgcgtgcctataatcccagctactcgggaggctgaggcaggagaatcacttgaaccagggagttggaggctgcagtgagccgagatcacaccactgtactccagtctggcgacagagcgagactccatctcaaaaaaaaaaaaaaagaaattgtgtaattcactggtttttagtgtatttgcagrgttgtgcaaccatcaccactatctaattttagaagatttttattatcccagaaaataaactctactcccactagctgtcactccctgctccgctgtcctccagccctgggtaaacaggaatctactagctgtctctgtgcacatctattttggggagaattttaaattattttccttaggaaaaattctgttaaattacagtagtctgccctcatgcgtgagggatatagtccaagacccccagtggatgcctgaaactgtgggtagtactgaaccctatacacactgtgacttttcctg

SEQ ID NO: 183082 - DNA, 601 bp, Human
cctgtagagtggaggccaggaatcatttaggccagggaatagtagtgtccttgggcaaaagtatacctacgggcagtctggcagggcaagctcaagctcacagtgattgggaaattgcattagaaacttcctttcccactgtgatgaagtaaggccatcgttggttttgaggccatgtgtgttttaatggcaagttcagaatgaaaaaaagtaggctggcacaatgaccctatggcccatagtggtcttaagtacttcctttgtggcttggtgatggctttacccattgacgtgagagctrcagagtgtgtgagggagagggcagaggcaggggatgtccaggatgccaggtaggatgcagggtgttgcgttatctacatctgtggttctcgtccctggctgtgcactagagtcagctggagagctttggccttacccccaaaacgggaccctgtctctggaggtagtgttgggcattcgcacatcgattctgtacagccagacttgagaagtgggaatttgatatgcgtgttagtcaggagcccagcagcagccacccctggagatcttttgtgagcttttagagtggctgggggaagac

SEQ ID NO: 183083 - DNA, 601 bp, Human
ctgaacatattcttgttgtataatccagcagtcaccgtccttggtatttacccaaatgagttgaaaacttatgtccacacaaaaacctgcacacgaatgtttatagaagcttattcataatgacaaaatttggcaagatgtccttcagtagatgactgcatcaataaatggttgtatatccagacaatggcatattatttagcactaagaaaaaatgagctattgagccatgaaaagacatggagaaaccataaatgcatgttagtaagtgagagaagccgatctaaaaggctgcagagtrtatgattccaaagatacaacattctggaaaaggcaaaactttggagaaaataaaaggatcaatggttgccaggggtttttggggaggaacagatgaataagtggagcataggggatttttagggcagtgaaattagtctgtttgctactgtaatagtagatacatgccatacacttgtccacacccatagaatgtacagcacccagagtgaacccacacatgaactgtggacttcgggtgataatgatgtgtccatgtaggttcctcatttgtgacaagtgtaccactctggtgggggct

SEQ ID NO: 183084 - DNA, 601 bp, Human
taggggatttttagggcagtgaaattagtctgtttgctactgtaatagtagatacatgccatacacttgtccacacccatagaatgtacagcacccagagtgaacccacacatgaactgtggacttcgggtgataatgatgtgtccatgtaggttcctcatttgtgacaagtgtaccactctggtgggggctgttgatagggaggggggctgtgcatgtgtgaggaaggggatatatggaaattctctgtagcttttgctcagttttgctgtgaacctaaaactgctcaaaaaaaaaaaaagtaaattcattgaaaaaatactggaaggaaataggccaaaatgataaatatcattttttaaaaataattcccactgaagtctgttggcctattgactattaatgatctttcaaaaatccactgtgctcccccacctcctttggtgtccccgaaggagaggccctgggcacacaaacaccttcttctggggccactccatgcccagggttccaagggccacatttctctgtgcgtaggggtgggcttggccttcatctcctagctgcagccaagaaggagctatgctgccatcactgagct

SEQ ID NO: 183085 - DNA, 601 bp, Human
cactctggtgggggctgttgatagggaggggggctgtgcatgtgtgaggaaggggatatatggaaattctctgtagcttttgctcagttttgctgtgaacctaaaactgctcaaaaaaaaaaaaagtaaattcattgaaaaaatactggaaggaaataggccaaaatgataaatatcattttttaaaaataattcccactgaagtctgttggcctattgactattaatgatctttcaaaaatccactgtgctcccccacctcctttggtgtccccgaaggagaggccctgggcacacaaayaccttcttctggggccactccatgcccagggttccaagggccacatttctctgtgcgtaggggtgggcttggccttcatctcctagctgcagccaagaaggagctatgctgccatcactgagctgggatttggggattcgctggtgccccaaaaccatgaagatactaagttttagggataagtagaacccctggaccttttcttccccggtactcccttagcccctcttataagtgcagtaggatggactggaaaggatatagataagtcagcctgattttgcgcattagatttaatct

SEQ ID NO: 183086 - DNA, 601 bp, Human
cctcgagagaatttccaggccttggcacagggagggagaagagaggcagaacctggtggactccctgagttgaaaaggagctgagagtctatggggaccaaggcagctagtttgtaggactctagcaaaacctttgtgaagcaatatctgataaagaacttgtatctagaatgtataagaagttctcataacagtaagaaaaaaaacaggcaaaagatttgggcgtctcactaaagaagaaaaggatgacaaataagcaggtgaaaagatgctcacacacaacatcagttactagagagakgcagattaaaactacaatgagatgctactgtataacctattacaatagaatggataacatttaaaagactattcatgccaagtgttggcaaggatgtggagaatttggaactctaatgagctgctggtaggaatgtaaaatgatataacttcttcagaaagcggtttgtcaatttcttaaacagttaatcatccacctaccataagacccagccatttcactcctaggcctttactcaagagaagtgcaaatgtatgtccattacaaacgcttgtacacaaatcttgatggcatctttat

SEQ ID NO: 183087 - DNA, 601 bp, Human
acatactccagattccatttatataaactagaaaagacaagctaatctgtgatgacagaaagcagatcagtggttgcctggggagaggaagaggaagcggggagggattgcaaaaggcatgaggacatggggaatctctggggcagtggatttgatcattgtcttgattgtggtgatttcacaggtgtatagaaatgtcacaacacggggctgggcacggtggttcacgcctgtattcccagcactttgggaggccgaggcgggcagatcatgaggtcaggagttcaagaccagcctgacyaacatggtgaaactcttgtctctactaaaaatacaaaaattagccaggcctggtggcacgtgcctgtaatcccagctactcaggagactgaggcaggagaatcgcttgaacccaggaggcagaggttgtagtgagctgagatcacgccactgcactccagcctgggtgacaaagaagactcttgtctcaaaaaaaaaaaaaaaaaagaaaagaaaagaaatgtcacaacatactgatacagaagcagggaagagaagtgctgggtagaggagggcatggtccctggctagggctctatac

SEQ ID NO: 183088 - DNA, 601 bp, Human
agagaagtgctgggtagaggagggcatggtccctggctagggctctataccagggacctaggtgaggacaggcacttctgcctttgcacccaaatattgcattttccaaaaccaccccagcctgccttgctcccatcctgggcctataaaaacctgagaccctagcaaggcagagacagaagctgctggacggcgagaggaacacatcagcggaagaagatacaagcagctggatggcgagaggatgccaggagcacaccgacagacgccaccacactggcaggccatcagccggcagaaygaggcagagtttggctggggcagtcggaggagagcctgtatgctcccctagaggtttgagcaggggggcactgaagaagcgagccacactcccattgcacaccctgtgagagggacaagggaacttttcccatcataataccaaattgcactctttaaataggtacagcttattatatgctacttatatctcattaaagctgttttataagaagattgcttgggctacaatttggagaatgggctaaaggggcagtaagtctaattgcagaggaaaaatgcccatcccttcctctcttct

SEQ ID NO: 183089 - DNA, 601 bp, Human
atcctgggcctataaaaacctgagaccctagcaaggcagagacagaagctgctggacggcgagaggaacacatcagcggaagaagatacaagcagctggatggcgagaggatgccaggagcacaccgacagacgccaccacactggcaggccatcagccggcagaacgaggcagagtttggctggggcagtcggaggagagcctgtatgctcccctagaggtttgagcaggggggcactgaagaagcgagccacactcccattgcacaccctgtgagagggacaagggaacttttcccatyataataccaaattgcactctttaaataggtacagcttattatatgctacttatatctcattaaagctgttttataagaagattgcttgggctacaatttggagaatgggctaaaggggcagtaagtctaattgcagaggaaaaatgcccatcccttcctctcttctcctaaaagtgtatcccttattcctctcacttcccttctggtttttgagcttggttgttacagtaacatgtgatgatattttttctttcctctgttgggcatttctttaaaatcctgtggcatggggggccctgg

SEQ ID NO: 183090 - DNA, 601 bp, Human
ctcccattgcacaccctgtgagagggacaagggaacttttcccatcataataccaaattgcactctttaaataggtacagcttattatatgctacttatatctcattaaagctgttttataagaagattgcttgggctacaatttggagaatgggctaaaggggcagtaagtctaattgcagaggaaaaatgcccatcccttcctctcttctcctaaaagtgtatcccttattcctctcacttcccttctggtttttgagcttggttgttacagtaacatgtgatgatattttttctttcctctgttgggcatttctttaaaatcctgtggcatggggggccctggcaaagccaagggaggctaagagcctactctttttcttcttgttgagcctgagcctctcctcagcccagaccacttagtgaatgtacaggtgagattgggcagctcaccaccagtggtggcagggtctggtttctacaagggcatggccacagtgcagtcaccctgctccctatcccatagccagcgtctggagaggggctggctccaaatgagtgagagggaagtgtttgtggggggaacgattggtttcctgaa

SEQ ID NO: 183091 - DNA, 601 bp, Human
agtgtttgtggggggaacgattggtttcctgaagggcaatcagaaggcacgcacctgcagggcccctcacagaagggcaggaggagctgcgggttgccccccagggagaggccttgtgattgaggtcccagtcagaaagatggtcgtgtgtgcaagggacaaggtagaatgggaggtgggccagggtgggtagtaggagactgggggcagggctggtctggggtctgaatccctgatgaggtgatatgttatggggtgaggaaggagctcccctcatgatggggggggttggggggcatgwgtggcaggaatagccacagctgccaaccagatagtcataatgagacctttgagttggaactggggctcagattccctctttcaaacctacccactgtgcagacttcagtaagtgacaggacctttctggaacttgggttttagacaggagatggcagcagctccttcactggttgaaatccccaagtctggctaggtgcggtggctcacgcctgtaatcccagcactttgggaggccgaggcgggcggatcacctgaggtcaggagttccagaccagcctggccagcatggagaaacccc

SEQ ID NO: 183092 - DNA, 601 bp, Human
ctgtaatcccagctactcgggaggctgaggcaggagaatagcttgaaaccaggaggcagaggttacaggtagccgagatcgcatgctgcactccagcctggatgacagagtgagactctgtctcaaataataataataataataaaaatccaaagaaaaaaatatctgtgagtccatactgatatactgcactccagcctggcgacagagtgagactctctcaaaaaaaaaacaaagaaagaaatctccaagtccagggtctggcccatagtagacacatgatttcctagaatgtgaaatkcagtttttttccctaccttttctgtgtaggaagtacttttagatccatttagccacaaggatgaaatcttttcctacctacttggcttcttatggggtcttcctcactctgtgacccatggtttcaaacacaggtggcttccttgttttgtatctgtgctaggtggtcactggtcacggtggagagaaaggatgtcagcagcccgaaggactcagctgcaggaacagaaagtgagggacagctgaaggcagagggtcacaggcctcagagagaggaagccagaagagagtgtagctgagc

SEQ ID NO: 183093 - DNA, 601 bp, Human
catgctgcactccagcctggatgacagagtgagactctgtctcaaataataataataataataaaaatccaaagaaaaaaatatctgtgagtccatactgatatactgcactccagcctggcgacagagtgagactctctcaaaaaaaaaacaaagaaagaaatctccaagtccagggtctggcccatagtagacacatgatttcctagaatgtgaaatgcagtttttttccctaccttttctgtgtaggaagtacttttagatccatttagccacaaggatgaaatcttttcctacctayttggcttcttatggggtcttcctcactctgtgacccatggtttcaaacacaggtggcttccttgttttgtatctgtgctaggtggtcactggtcacggtggagagaaaggatgtcagcagcccgaaggactcagctgcaggaacagaaagtgagggacagctgaaggcagagggtcacaggcctcagagagaggaagccagaagagagtgtagctgagcagggtgtggagagaggggaggaagccctgccgttgagagataaagtggcaggaagtccagtggggcactggctgttgtcag

SEQ ID NO: 183094 - DNA, 601 bp, Human
atccaaagaaaaaaatatctgtgagtccatactgatatactgcactccagcctggcgacagagtgagactctctcaaaaaaaaaacaaagaaagaaatctccaagtccagggtctggcccatagtagacacatgatttcctagaatgtgaaatgcagtttttttccctaccttttctgtgtaggaagtacttttagatccatttagccacaaggatgaaatcttttcctacctacttggcttcttatggggtcttcctcactctgtgacccatggtttcaaacacaggtggcttccttgtkttgtatctgtgctaggtggtcactggtcacggtggagagaaaggatgtcagcagcccgaaggactcagctgcaggaacagaaagtgagggacagctgaaggcagagggtcacaggcctcagagagaggaagccagaagagagtgtagctgagcagggtgtggagagaggggaggaagccctgccgttgagagataaagtggcaggaagtccagtggggcactggctgttgtcagagcatccacgtgaagacgctggccaccctgccagcatcttatgaacaggggtaggagagggtgctg

SEQ ID NO: 183095 - DNA, 601 bp, Human
gtggaatgtgattcaactcacacttgtttccttgagcacttgcggaggccacagttaagacatggcccttattctgaaggcacttgcaattcactaggagaggcaaatgcccaggtaactagcaactcaccacagcatggtaggtgctgtgcccagtggcagatgcaccaccaccatcacttccacatttgccccgtcccaaatactagaggccccacttggctcggcctggtccagtggtcactgtgcatgggcccctagcagcagccgcgacaccactgctttccagggtgacgagacygcttaaaggagccttaaagatgagtggtgatgcctcaaccctgttgggtttatgctttgctgctaggtgggccccacagctccatgtgtgccagcaaaagaaatgcagtttgcccggaactgtattttctaccttgagagcataaggtacctaagttgtatataaaaatcattagacagaaagaaatgctgatgcctctgaattacttgatgctttcagtttcatactggtgggggctccctgttgactttgctgcttgcaaggaacagaaatgccagctgtccagtaatctcatccgcc

SEQ ID NO: 183096 - DNA, 601 bp, Human
atgctttgctgctaggtgggccccacagctccatgtgtgccagcaaaagaaatgcagtttgcccggaactgtattttctaccttgagagcataaggtacctaagttgtatataaaaatcattagacagaaagaaatgctgatgcctctgaattacttgatgctttcagtttcatactggtgggggctccctgttgactttgctgcttgcaaggaacagaaatgccagctgtccagtaatctcatccgcccgccaccctcccctccacaggcacatatacatgcacacacatgcatttcatrgccattaaagagaagatggaagggagaaggcaggcaggaactttttgggggtgttggaaatattctatatcttgatttgggtttgctttacatagatcatttgtcaaaactcattgaatggtagacttacactttttgtgtctgtttgtgaattttacccggaaaaaaataagcctaagcaaataaatgatgaactctagttaatgatggggaggctgaagtgtttggggtgaagttgctgcctgcaactttgaaatgcatcaagaatgggatggattgttggattgattgaggaatggt

SEQ ID NO: 183097 - DNA, 601 bp, Human
ttcatactggtgggggctccctgttgactttgctgcttgcaaggaacagaaatgccagctgtccagtaatctcatccgcccgccaccctcccctccacaggcacatatacatgcacacacatgcatttcatggccattaaagagaagatggaagggagaaggcaggcaggaactttttgggggtgttggaaatattctatatcttgatttgggtttgctttacatagatcatttgtcaaaactcattgaatggtagacttacactttttgtgtctgtttgtgaattttacccggaaaaaartaagcctaagcaaataaatgatgaactctagttaatgatggggaggctgaagtgtttggggtgaagttgctgcctgcaactttgaaatgcatcaagaatgggatggattgttggattgattgaggaatggttagcaaaacattaattatagaattgggatggtgagtatgtgggtaccctctgtataattccttcaacttttctgcgtgtttgaaaatgttgaaacagaagaagaactgcagataaccaatacttgtgccctcttgagctttctataaatgaatttctccaatggtcaat

SEQ ID NO: 183098 - DNA, 601 bp, Human
gggagagggagagaaagacacttcaaatgagtcatccactggatttggtggtgggctggccatggggagggatggtattatgctttgttcattggcttttttatgactcagtttacactggttccctcctgactcactgatgtttctcttgtccttgcaggagcctgtgtgaaatgcagcaaaggggtgtttggggctggccaggcctgtcaggccatggggaacctctaccatgacacatgcttcacctgtgcagcttgcagtaagtgtgggtgtgggtgtcgggtgtgtgggggatgcrtaaggaacatgggaaccgagaaagggaggagagagaagatcatctttctggagacggttggtccatggccctcctcagccccacagaaaagccagacagtgtcttttacagcagggtttcttaccaccaacagaagcccatcagggcacggtgacttaacacaataccaaagattgcctgtgattctggtgataagttgaatgagttcagagtgatccctaatcacatcaggtttgaaatatgtaagaagaggtttcagaagatttgggaggaagtgctgggattcaccatgtctaccct

SEQ ID NO: 183099 - DNA, 601 bp, Human
ggggtgtttggggctggccaggcctgtcaggccatggggaacctctaccatgacacatgcttcacctgtgcagcttgcagtaagtgtgggtgtgggtgtcgggtgtgtgggggatgcataaggaacatgggaaccgagaaagggaggagagagaagatcatctttctggagacggttggtccatggccctcctcagccccacagaaaagccagacagtgtcttttacagcagggtttcttaccaccaacagaagcccatcagggcacggtgacttaacacaataccaaagattgcctgtgrttctggtgataagttgaatgagttcagagtgatccctaatcacatcaggtttgaaatatgtaagaagaggtttcagaagatttgggaggaagtgctgggattcaccatgtctaccctgtttgtcagttctctcccccactgtggggaccagccaaccaaaagtgattagtcagtcagctaccccagtgtgaggtggaggtgggggtcctttattactctgtaaccacctccctaacctaatctttgatttggaggctgctgtatgagcatgaggtgtgtgtgcatgccacccatgtgctg

SEQ ID NO: 183100 - DNA, 601 bp, Human
tctatagccttgccaacatctactttttgactttttaataatggccattttgtggttttgatttgcatttctttgatgataatgatgtggaggtttgttttgttttgagatggggtctcactgtgtcatccaggctggagtgccatgatgtaattgtagctcactgcagccttgaactcaagcaacccttctgccttagcttctgagtagctgggactgcgggcatgtgccaccatgcccagctaatggtttaaaatttttgtagagacagaggtctcgctgtgttgcctaggctggtctygagctcctgacttctggtgaccctcccacctcagcctcccacagggctgggattactggcataagccaccacacctgacccttgagcatttttttcatgtttgttggctgcttgtatcagatctttgtttacaatttatctttgacctttgactcctacaacagtttctcaatacttgctctatttttcaggaaaaagaaaataaatattaaggagaggctgttttccacctcaagcagttaccatttgaattagggaagctgttggtgagggaaaaccaattgatgagcgtcttagtct

SEQ ID NO: 183101 - DNA, 601 bp, Human
tctgtgaatgtcccacttcctctccagttccaaagagcagttggaatgttggagactgggcttgtgtctcagcggcttctcttagacactggaggtgacttgtcttttttcagttaccagattgctgccctttacctcagttttcagcagaaggaggcacccgggagctctgtgtctcagctctgcaggtcctgagtgtgtctctgtgagcctcaacaccatggagacggcacagctgggggtctgggtgcatctagggcatcccctccttcttagaagagaaaatgggggcagacagggraagaatttctcaaggtcaaaaacctggctatggagctggcatggaatccagacctcttgaatctatgctcacctgtacttccttgtttttctggttctccctcctctgatttatttccacctagtcaagcaaaaataagtgtgttttctctgttctttatcttatcttggttattgatagagtctggtgagtgtgtgtatttctgaacatatttgtatatgtatcttttctattttcccatttcatttatgaaaatctagtttaaaacactatatatagtatgtaaagccagattttata

SEQ ID NO: 183102 - DNA, 601 bp, Human
tcaacaccatggagacggcacagctgggggtctgggtgcatctagggcatcccctccttcttagaagagaaaatgggggcagacaggggaagaatttctcaaggtcaaaaacctggctatggagctggcatggaatccagacctcttgaatctatgctcacctgtacttccttgtttttctggttctccctcctctgatttatttccacctagtcaagcaaaaataagtgtgttttctctgttctttatcttatcttggttattgatagagtctggtgagtgtgtgtatttctgaacatayttgtatatgtatcttttctattttcccatttcatttatgaaaatctagtttaaaacactatatatagtatgtaaagccagattttatatatatttatatatattttattttatttatattttttatatatatatagcatatggcatatggaggtatctgttggtatatacacatacttcctgaggtccattgatactgcattaaaccatagtatttggatactgttaagctcacacacatttacagggcaagtccagggcctgactagtttggtaaagatacaacaagccactgttactt

SEQ ID NO: 183103 - DNA, 601 bp, Human
accttggggatggaagctgggaagcagccagtcccacagttgacagaaattacgcctagtgcaggtccgagctcagtggaaggctgcagagggccagacggggtccacttgggatggtgctgggatgtgtaagtcaaggccagaatgaattgcagtggtgtaacctactgtttatattgctcggtgtaagatgcactgtgacctgccagccatgccttagtggggagaaaaagcaaaactaagattatataccattgctcatttcaccttccaaaaaccgaatgtccatggctgttgaagmttgcgaatgggatttatagtaaaatctcacttgttgagacccagttggaagaaagcctttcttagtaataaaaagcctgcatctagaacactcacaaaatgccattttgttacttgagataaataaaacaattaggaccaagcctagtgttgtggaacagaggttcttagcgaatgaataagtccttggtgattgactcaccagttagttcgcctctgaaggactggagggttcttgccagctattttgtttttcttacaaagtctaaatactgcatctgaaatcctttcccttttttgt

SEQ ID NO: 183104 - DNA, 601 bp, Human
aaaactaagattatataccattgctcatttcaccttccaaaaaccgaatgtccatggctgttgaagattgcgaatgggatttatagtaaaatctcacttgttgagacccagttggaagaaagcctttcttagtaataaaaagcctgcatctagaacactcacaaaatgccattttgttacttgagataaataaaacaattaggaccaagcctagtgttgtggaacagaggttcttagcgaatgaataagtccttggtgattgactcaccagttagttcgcctctgaaggactggagggttmttgccagctattttgtttttcttacaaagtctaaatactgcatctgaaatcctttcccttttttgttgactttgtaaatgacctcgtcaacccagcccctgaaaatgcttacacattttgaatgagttaagcctgaactagggaggtcttcctttaattcatgcaggtctgcttctgtaaaacagtcactgcgatatttatagataattttgggtaagctttctagcttaccgtgggcctgacaccgcataaccctcctccacccatggcggcgcactaaatcctgtaacaattcaggga

SEQ ID NO: 183105 - DNA, 601 bp, Human
gagagtggcctggggctgggaataggggaggtagaattcaatcatgggatgcacccatagtagagaaatggactaagggctttaatccctgagtttctgagctgtcgaattgtccgaatatttctcatcatattcagcagttctgtatgagctgaatgagtcagcaggacctaaggaaaaagctgaagatcaagaatgtgagaaaggaagagtgggcagatgctaaaggaaatcagtgggcacaggaaagatcaggaagcaaccaaaataggctggagctggccagagggctgcagggatyggaagagagtggaggggccacttactttggttatcaaagggtctcttgtgtccgtctcctgcaagcctagttctgctagtgcactggagttggggccaaacctggtttcccaggtcagactctgctggttcagtcagaggccaggaagtccctgacagggaagaccatcagattcctttgttcctatcgtctgaacacagtctgagaggtttcgcagtatattgtagaggctaactttggtgtaacctataccttatgtggccatgtctgcatcctaagctcctgatattgcacatgtct

SEQ ID NO: 183106 - DNA, 601 bp, Human
gccaaacctggtttcccaggtcagactctgctggttcagtcagaggccaggaagtccctgacagggaagaccatcagattcctttgttcctatcgtctgaacacagtctgagaggtttcgcagtatattgtagaggctaactttggtgtaacctataccttatgtggccatgtctgcatcctaagctcctgatattgcacatgtctggtttttgttggaagtctgtacctttcctccgtggtagtcccagaccaagggtgatacttggcggtgcccagggtgtcacctgtcttctcaagtygaagaggagaatgaagagcactccagtacgccaggagcatcacaccgtaattagcaggaagatgttgcaccgcagtgcctcatctcagagccagagtcctgggttagggagtaaactcttttacctaggcctgactgtattctggcattgtaggcactcctcaggtttctgtggccctctcatctcactgagggtatcccttcttcatgtgtctctcagctcttctcttagatttctgcccctggctctggccccttcagattccttctccttctctttcccttccctcctctctcctcc

SEQ ID NO: 183107 - DNA, 601 bp, Human
ggagtaaactcttttacctaggcctgactgtattctggcattgtaggcactcctcaggtttctgtggccctctcatctcactgagggtatcccttcttcatgtgtctctcagctcttctcttagatttctgcccctggctctggccccttcagattccttctccttctctttcccttccctcctctctcctcctttcaccaacagttttgtttgcacccatagttgcccatcagtggatccatgcctgtaagccagtgtaatacaagctgctgtctgtggagcatttattgcatttattgyagtgagccgtgatcgtgccactgcactccagcctgagtgacagagcgagactctgtctcaaaaaaaaaaaaaacaagatttaggaaccagaggctttatatgcagtccaatacagtagccacaagctgcacgtggctgtcttcttatgtcccttgcttgccttccagccacactcatcttacacaagaggtcatggggtctcagagcggttgcccagctggtgagtggggaagtgtgttcgtgcccaggggcaggtggccactgtgtatacacttgccaccatatccatggccttcaccc

SEQ ID NO: 183108 - DNA, 601 bp, Human
atctcactgagggtatcccttcttcatgtgtctctcagctcttctcttagatttctgcccctggctctggccccttcagattccttctccttctctttcccttccctcctctctcctcctttcaccaacagttttgtttgcacccatagttgcccatcagtggatccatgcctgtaagccagtgtaatacaagctgctgtctgtggagcatttattgcatttattgcagtgagccgtgatcgtgccactgcactccagcctgagtgacagagcgagactctgtctcaaaaaaaaaaaaaamaagatttaggaaccagaggctttatatgcagtccaatacagtagccacaagctgcacgtggctgtcttcttatgtcccttgcttgccttccagccacactcatcttacacaagaggtcatggggtctcagagcggttgcccagctggtgagtggggaagtgtgttcgtgcccaggggcaggtggccactgtgtatacacttgccaccatatccatggccttcacccctcactgtgcgtcagtcgccatcacaaggggcctgttgcagtgccgacctctgcctctgcctgcagagatcctg

SEQ ID NO: 183109 - DNA, 601 bp, Human
ccacctggggctcttgagcacttgaaatgtggctagtgtgactatggaactgcattttccattttatttcattttaattaattaaagtttaaatttattttagtagccatgtacagcttgtggctactgtattggactgcatgtaaagcctcttgttcctaaatcttttttttttttttttgagacagtctcactctgccattcaggctggagtgcagtgctgcattatggctcactgcaacctctgcctcatgggctaaagtgatcctcccacctcagtccctttagtcccctggctaawttttttgaaattaatttttgtagagttggagtcccactatgttgcccagattggtctcaaactcctgggttcaagtgatcctcccgccttggcctcccaaagtgctggaattacaagtgcaagccacaatgcccggcctctaaatcttagccagagttcacttattagtaggaaattattcatgaagtttcttgtttttgatattttatacatcaccaagtcaatgtagtcacattgtcaaaaaatgtatatgggagaagaaaatcacctataattcaataccaaaaagaacccccaaaa

SEQ ID NO: 183110 - DNA, 601 bp, Human
aggaggccactccacagctcagagaccttcagctactttttgccttaacattgtagtccagttcttttgcctggtgtttaagacatttccttaaattagttctaacttccttcctgtcttctttctttctaactatccccctcctccgctgccccacagcctcccgaagtgctgaagtccctggccacactgcacatcacctgtccttttctacccctgtaccttgtcacccttagcctccatcaccacccaggtgaatatcactctcccttcagtgtcttccattgccatctccattgckactctcctgatcttgggtcccatgtgcacccttcatttgcctgtcctatggtgttttcaattatgattagattgaaactgtttgcaggaatctctatctccccctaggtgatcagttttgggagaatagggacagggtttaactgatcatgattttactccttataacccttcagcacctttagtataattctgaacacagaataaatgttggaataaataaaggtgacacttccccattacctggtactcatcacttcacctccttactcaccttccctcatccctaagcaaccactga

SEQ ID NO: 183111 - DNA, 601 bp, Human
ttatggctgaatagtattcccttgtatagatgtaccatattttgtttatccattcagcagttgatagacacttgtttttatttttggctattataaataatgttgctatgaacattcctaggcaggtgtttatgtgaatgtatcatttctgttctcttgggtaaatattaggagtgaaattgctgggtcatatggtaactgtgtttaaccttttgaggacctgttttttaaagaagctctaccatgttacattcccaccagccatgtatgagagttccagtatttccacatccttgccaaygcttaggcttatctagtttttttattctaactatcctatttggtgtgaagttggatctcattgtggttttgatttgcattttcctgatgattaatgatgttgagcatcttttcatacatttattggccattggtatgtcttatttggaaaaatgtcttctcaattccctgctcatttttacttggattgtctttttattattgagtcttaatcgttctttgtataggatttgggaatattttctttcattctgtggactgtcatttcatttcttgatggtattgtttacagcacaaaggc

SEQ ID NO: 183112 - DNA, 601 bp, Human
atgagagttccagtatttccacatccttgccaacgcttaggcttatctagtttttttattctaactatcctatttggtgtgaagttggatctcattgtggttttgatttgcattttcctgatgattaatgatgttgagcatcttttcatacatttattggccattggtatgtcttatttggaaaaatgtcttctcaattccctgctcatttttacttggattgtctttttattattgagtcttaatcgttctttgtataggatttgggaatattttctttcattctgtggactgtcatttyatttcttgatggtattgtttacagcacaaaggctttaaattttgatgcagtagaatttatctactttttttctttttttgccagtgttttggtgctttttgtaggaaaacattggctgacccaaggtcacaaagattcatgtccatgttttcttctaaatgttttaaagagatttaactaataagaaaaaagtctcacttgtcctcgcatttgccatttctgctccttctcatccctttgtttagattcaggttttcatctggtaccatttttccttctgcttgaaggacttctcttaac

SEQ ID NO: 183113 - DNA, 601 bp, Human
aatgttttaaagagatttaactaataagaaaaaagtctcacttgtcctcgcatttgccatttctgctccttctcatccctttgtttagattcaggttttcatctggtaccatttttccttctgcttgaaggacttctcttaacattttttctttttcgtatgctgatttggtgatgaattctttaaacttttgtattctgaatttatctttctttcatttttttattttaaaatatatttttttggctgggcgcggtggctcacgcctgtaatcccagcactttgggaggccgaggcgggmcaatcatgaggtcagaagatcgagaccatcctgactaacatggtgaaaccccgtctctactaaaaatacaaaaaattagccgggcatggtggcgggtgcctgtagtcccagctactggcgaggctgaggcagcagaatggcgtgaacgcaggaggcagagcttgcagtgagccgagattgcaccactgcactccagcctgggcaacagagtgagactctgtctcaaaaaaaaaaaaattatatatatatacacatatatatatatataaaattatatagatatatttatatataattata

SEQ ID NO: 183114 - DNA, 601 bp, Human
gcgcggtggctcacgcctgtaatcccagcactttgggaggccgaggcgggccaatcatgaggtcagaagatcgagaccatcctgactaacatggtgaaaccccgtctctactaaaaatacaaaaaattagccgggcatggtggcgggtgcctgtagtcccagctactggcgaggctgaggcagcagaatggcgtgaacgcaggaggcagagcttgcagtgagccgagattgcaccactgcactccagcctgggcaacagagtgagactctgtctcaaaaaaaaaaaaattatatatatatmcacatatatatatatataaaattatatagatatatttatatataattatatattttatatatataattatatatataaaatatatatattgctggatatagaattctagcttgatacttttttgagttccttgaagtttttttgttttttttttttttactattttctccctttttttttttaatgagaaatctgatatctctattctctgtatgtgacatgtttttcccccattctggctgcttttaagatttcatcattgattttgagaaatttgattatgatatccttggtgtgctt

SEQ ID NO: 183115 - DNA, 601 bp, Human
gcggtggctcacgcctgtaatcccagcactttgggaggccgaggcgggccaatcatgaggtcagaagatcgagaccatcctgactaacatggtgaaaccccgtctctactaaaaatacaaaaaattagccgggcatggtggcgggtgcctgtagtcccagctactggcgaggctgaggcagcagaatggcgtgaacgcaggaggcagagcttgcagtgagccgagattgcaccactgcactccagcctgggcaacagagtgagactctgtctcaaaaaaaaaaaaattatatatatatacmcatatatatatatataaaattatatagatatatttatatataattatatattttatatatataattatatatataaaatatatatattgctggatatagaattctagcttgatacttttttgagttccttgaagtttttttgttttttttttttttactattttctccctttttttttttaatgagaaatctgatatctctattctctgtatgtgacatgtttttcccccattctggctgcttttaagatttcatcattgattttgagaaatttgattatgatatccttggtgtgctttt

SEQ ID NO: 183116 - DNA, 601 bp, Human
ccagctactggcgaggctgaggcagcagaatggcgtgaacgcaggaggcagagcttgcagtgagccgagattgcaccactgcactccagcctgggcaacagagtgagactctgtctcaaaaaaaaaaaaattatatatatatacacatatatatatatataaaattatatagatatatttatatataattatatattttatatatataattatatatataaaatatatatattgctggatatagaattctagcttgatacttttttgagttccttgaagtttttttgttttttttttttttactattttctccctttttttttttaatgagaaatctgatatctctattctctgtatgtgacatgtttttcccccattctggctgcttttaagatttcatcattgattttgagaaatttgattatgatatccttggtgtgcttttcatgtttcttgtgcttaggggtttgttgagcttcttggatctgtgtgtttgtagtcagtcttcatcaaatctatttcttcacattcctccccatccactagggactccaattactccaatcttaggcatcttgaagttgtcccagagctcacttat

SEQ ID NO: 183117 - DNA, 601 bp, Human
tttctattgctgtacctttaaattcactaatgttttctcttgcatggtgtaatctgctattaatcccatccagtgtattctcttttctaaaatttttaaaaagctttttgttatttatttatgtatctttttttaaattatactttaagttctggggtacatgtgcacaatgtgcagttttgttacataggtatacatgtgccatgttggcttactgtacccataaactcatcatttacattaggtatttctcctaatgctatccctcccccagccccccaccccccccaacaggccccartgtgtgatgtcccctccctgtgtccacgtgttctgattgttcaactcccacttatgagtgagaacatgcggtatttggttttctgtccttgtgatagtttgctgagaatgatggtttccagcttcatccatgtccccaaaaaggacatgaactcatcctttttatggctgcatagtattccgtggtgtatatgttccacattttctttatccagcctattattgatggatatttgggttggttccaagtctttgctattttgaatagtgccgcaataaacataacgtgtgcgtgtgtctt

SEQ ID NO: 183118 - DNA, 601 bp, Human
ggaaaactaactataagacaaagactttggagtggcacgtgagaagagaattggagcgtgaggcagcagtgctcagaacatggtccttggccagcaccagcaaaggccgagaaagagatgagaacgtttagagaccttcctaagagtttgacagagtggctttgtgtcagttgaattggataataactacagttggggcttggattttatgtttcatttttctatattattgtattttacaagataataagtctgacagatggaaattaaaaacaaaagcctcccatacctagccctttgycacagataaactgagaaggaaggagtgatgtaggggatttggatgaggagggagagagggtggtggttatgattcttagctctggtgggtgtcatttgaggaaacggaaggtcaggtagggatgctggcaacagtcacaccagatgcctggtatgaggtgcactgggctgcgttccctactgtgatcccacttttatccttaccagggaacctgaagggtttgggtgacagccagggtctcatttcagggaaggggcaaaggcaaggttggaccccaagcctgagtgcttttccactttg

SEQ ID NO: 183119 - DNA, 601 bp, Human
ttgtcagattaaatggctgacctctctttgtgatgtccttaactcttgtttcctttgttaaactacaccggctttatcagatgcatttttctcttttaaactgaggatggcttgaaggcaaatataaaatactcattcacggcctgcaggtggctcacacctgtaatcccagcactgtgggaggctgaggcaggtggatagcttgagcccgggagtttgagaccagcctgggcaacatggtgaaaccccgtctctactaaaaatacacacaaaaaattagccagtcatggtggcatccacktgtgttcccagctactcaaggctgaggtgggaggattgctctagcccaggaggagattgcaccactgcactccagcctgggtgacagagtaagaccctgtctcaaaaaaaaaaaaaaaaaaaaaagaaaaaagaaaaaattcattcactacatctacaggaagtgtctttttggagtggattctctgtgagtctgcacatttatcagtcaatttttttttttttttttaagacatagtctcactctgtcacccaggctggagtacaatggtgcaatctcagctcactgcaacctctgcca

SEQ ID NO: 183120 - DNA, 601 bp, Human
caccactgcactccagcctgggtgacagagtaagaccctgtctcaaaaaaaaaaaaaaaaaaaaaagaaaaaagaaaaaattcattcactacatctacaggaagtgtctttttggagtggattctctgtgagtctgcacatttatcagtcaatttttttttttttttttaagacatagtctcactctgtcacccaggctggagtacaatggtgcaatctcagctcactgcaacctctgccacccgggttcaagtgattctcctgcctcagcctcctgagtagctgggattacaggctcacrccaccaggcctggctaatttttgtatttttagtagagatggggtttcaccctgttggccaagctggtgtcgaactcctgacctcaagtgatctgcctacctcagcctcccaaagtgctgggattataggcatgagacaccacactcggcctatcagtcaatattttataaacggctgatgtaaataaagaaaataaagagcattttgactactgtcttctaaactgtaaaaatggtctattgagtatatatttagtgtgacgatcatcagctatttcctagtggagggaattcctttact

SEQ ID NO: 183121 - DNA, 601 bp, Human
acagagtaagaccctgtctcaaaaaaaaaaaaaaaaaaaaaagaaaaaagaaaaaattcattcactacatctacaggaagtgtctttttggagtggattctctgtgagtctgcacatttatcagtcaatttttttttttttttttaagacatagtctcactctgtcacccaggctggagtacaatggtgcaatctcagctcactgcaacctctgccacccgggttcaagtgattctcctgcctcagcctcctgagtagctgggattacaggctcacgccaccaggcctggctaatttttgkatttttagtagagatggggtttcaccctgttggccaagctggtgtcgaactcctgacctcaagtgatctgcctacctcagcctcccaaagtgctgggattataggcatgagacaccacactcggcctatcagtcaatattttataaacggctgatgtaaataaagaaaataaagagcattttgactactgtcttctaaactgtaaaaatggtctattgagtatatatttagtgtgacgatcatcagctatttcctagtggagggaattcctttactggaagcaggacgattctgaaacta

SEQ ID NO: 183122 - DNA, 601 bp, Human
acatttatcagtcaatttttttttttttttttaagacatagtctcactctgtcacccaggctggagtacaatggtgcaatctcagctcactgcaacctctgccacccgggttcaagtgattctcctgcctcagcctcctgagtagctgggattacaggctcacgccaccaggcctggctaatttttgtatttttagtagagatggggtttcaccctgttggccaagctggtgtcgaactcctgacctcaagtgatctgcctacctcagcctcccaaagtgctgggattataggcatgagayaccacactcggcctatcagtcaatattttataaacggctgatgtaaataaagaaaataaagagcattttgactactgtcttctaaactgtaaaaatggtctattgagtatatatttagtgtgacgatcatcagctatttcctagtggagggaattcctttactggaagcaggacgattctgaaactagaattataaagatgtaacactgacactcccacccccagtttatgtttgatgctgattattcagggatggtttaggtcttagcatttttgaccaagatgaacagcatcaaatgg

SEQ ID NO: 183123 - DNA, 601 bp, Human
ggttacctatcaagttacatctaaatgcctgtcatcacaaggagtttttacggagctgttcatgacacttaagtgagacatgaggcaagtaaaaggcccagtacctagaaagtgtttgaatgaaaattcccttttccggccagatatggtaactcacacctgtaatctcaacgctttgggaggccaaggcgggaggattgctgagaccaggagttcgaggctgcagtgagctatgattgtaccactgcactccagcctgggcaacagagcaagacgctgtctcaaaaaaaaaaaaaaaaaaggaaaaagaaagaaaggcctgtcccatttcctggcagaagagagaaactggattctgcatataggtgtgcatccaacaagcattaaatactgctgcatggcctcatggtgcagtggaacaagcacagtcttcacagtcagacaaatctgggttcccatcctgcccacttactacctgggtaagcctcaatttccttacttatgaaatgaaaacgataatgtgtaattcataagtatcatatttttactccagaaagttaggagtaatccttgggtgtgatttcaagtgattcccaaaaat

SEQ ID NO: 183124 - DNA, 601 bp, Human
acctatcaagttacatctaaatgcctgtcatcacaaggagtttttacggagctgttcatgacacttaagtgagacatgaggcaagtaaaaggcccagtacctagaaagtgtttgaatgaaaattcccttttccggccagatatggtaactcacacctgtaatctcaacgctttgggaggccaaggcgggaggattgctgagaccaggagttcgaggctgcagtgagctatgattgtaccactgcactccagcctgggcaacagagcaagacgctgtctcaaaaaaaaaaaaaaaaaaggamaaagaaagaaaggcctgtcccatttcctggcagaagagagaaactggattctgcatataggtgtgcatccaacaagcattaaatactgctgcatggcctcatggtgcagtggaacaagcacagtcttcacagtcagacaaatctgggttcccatcctgcccacttactacctgggtaagcctcaatttccttacttatgaaatgaaaacgataatgtgtaattcataagtatcatatttttactccagaaagttaggagtaatccttgggtgtgatttcaagtgattcccaaaaataatc

SEQ ID NO: 183125 - DNA, 601 bp, Human
ccccctgtactggcctcctgtgtccggacatgggaattctcagctgtgggaactggcagcaagaggacttatctagccagctgggcaattttttaaatgatcagagcaatacctgctcattggtaaatctttgggaaagtgtaggaaagtatatagaagcaaccaactaggaaataaaccatcccctccaccatgcagattctttttttttttttttttttttttttttttttttgagactgagttttgctcatgttgctcattgcaggctggagtgcaatggtgtgatctcagctcaccrcaatctccactccttgggttcaagtgattctcctgcctcagcctcctgagtagctgggactacaggcatgcaccaccatgcctggctaattttgtatttttagtagagagggggcttttccatgttggtcagactggtcttgaactcccgacttcaggcgatctgcccgccttggcctctcaaagtgctaggattacaggcatgagccaccgtgcctggcctcaccatgcagattctaaatatgtccactcagaggcgttgccactcatgggcagatttcctttccagtctttttttctt

SEQ ID NO: 183126 - DNA, 601 bp, Human
ccatgcagattctttttttttttttttttttttttttttttttttgagactgagttttgctcatgttgctcattgcaggctggagtgcaatggtgtgatctcagctcaccacaatctccactccttgggttcaagtgattctcctgcctcagcctcctgagtagctgggactacaggcatgcaccaccatgcctggctaattttgtatttttagtagagagggggcttttccatgttggtcagactggtcttgaactcccgacttcaggcgatctgcccgccttggcctctcaaagtgctrggattacaggcatgagccaccgtgcctggcctcaccatgcagattctaaatatgtccactcagaggcgttgccactcatgggcagatttcctttccagtctttttttctttgaatttctttatatagttgagatgcacaatttttaaatcttgctttttacttttcacattataacataagggttttcttttaagattaaaagtattttttcatattatacatatttctagaaaaatttaatatagaaatatgtgaagtaaagtgaaatttctctctaataccatctgtcactgtaccta

SEQ ID NO: 183127 - DNA, 601 bp, Human
tatttaaatgacattttaaatagctatgtaacatttcatcatttatatgtactctggtttatataaccattcctctaaggctgccagtttggatctaagtaaatatttattcactttttaaaattctttcccaaagctaagtctcagataacctcactgagtcagagataaacattttaaagtttcccttccagggagagtttatcatcttacactctcagcagtagcttatgaaaatatacagtgacaacaatcacaaacacttaaaaaatctttgttgatctcctggatgaaaaagctytcgtttaatttgtttcttaacactagagggttcagtgcttctgcatgttcaatgatcttcctctgtgatttttggaatagaggtgatcttcgccctattacacaaaacgttgatttccagctcagattccttagaacttgctaaccccattcctggaaccaaagtgctgtttgctgtgttctccatacattggatcagaagcctaagctctggaagtcctgcgccgtttcctggtggcctcctagctccctctaggggccccatccgcaactgcagccccaccttctttcctctcttgag

SEQ ID NO: 183128 - DNA, 601 bp, Human
cttcctctgtgatttttggaatagaggtgatcttcgccctattacacaaaacgttgatttccagctcagattccttagaacttgctaaccccattcctggaaccaaagtgctgtttgctgtgttctccatacattggatcagaagcctaagctctggaagtcctgcgccgtttcctggtggcctcctagctccctctaggggccccatccgcaactgcagccccaccttctttcctctcttgaggaatgagtttaccctgcgggaattccgagaaggaagaggcgaaagtggggagctccmcaagtaaagatttggactttgtgatcagacagtgtgtgaatagttttgcttactggttgagcaagcttctcttaggtgggctgtctttttttttttttttttttttttttcccgagacggagtctctctctgtcataaaggctagagtgcaatggcgcgatcttagcttcctgcagcctccgcctcccaggttcaagcgattctcctaccgcggcctcccaagtagctaggattataggcgcgtgccaccatgccaagctaatttttgtatttttagtggagatgaggtttcgccatgtt

SEQ ID NO: 183129 - DNA, 601 bp, Human
taactcaacatgtactgcactctgttagagtattgccaaagcttcccctccaagtatgaagctgacttagctatatcttcaaggaatgtagcatatactcagagtattaaaaagtcctacaggaacctacaggagggctgggggaaacattcagacaacactagatctggtagcaacgaccaccacagcaaagaagatggatttgtagttaaagttacttccttttttatgccttttccgctgcgttgatgctttcagggtcctctctgaggtctgaggaatgttctttgacagtcttgtygctatctgccttgcgctgctttgcctcctgtgggcgtcaccaggcgagggcagccagtgttcgtctggcgggtttctctgtatctcgggcactgtttgtgacaatgatgattttactttcattttgtgggctggccccaaagggcttggtttaactttttgcagagagttcattcagtttctgaaacccccacattgcctgttgagtatgtgttgagcctagcactggaaatgccctcagatctgtgaatactgccaagtaggggatcccgggacaccctctgctgaccttgagctcaca

SEQ ID NO: 183130 - DNA, 601 bp, Human
cgggacaccctctgctgaccttgagctcacagccccattgtgttttccataagagatgagagggactgataaaggatgtttacctgtgttagccttatggaagcaagagttccatccaaggaatcagggtgctttgaacttttcccactcccgcctactcgttttaggtcaagagaaacaaaaatatccttccaacaatgtgtgttttctacagtttaggtgagaaaaagataggaaaataatagttaaccaatgtataggactctcctgataggcggtcacaatggtcctggagcatatrtccaaggtgactgtcataaatgcctgtgggaaactgcatcttcacaagagactgttgcttggatgcccccttgtgttgcctctgctgtcctgccaccaaatgctttgctggcatctttccaagcagataggaggtgctggaaggtgagcgtaggatgacttccaagtcagcccttgagtctttttgccaaatagcacctgccagggcacccttcctcccggcctcagcctgcctgcctctcgccgagggccacggcatcttttaggaactggaaagtgtcattgacagttggcggttttt

SEQ ID NO: 183131 - DNA, 601 bp, Human
gccaggcgttgaactctgtgctgccatgtcttccacaattctgcctccgttcatacctccggcatggctcagccaggctagcttaacggcctccgcacacccgcatcaagaggccttatagggcataaacctggcctgcttggtcccagcatgtgcagggtacaaagcacactcagaagctctccgaggtctggaatccccagctgcccacacctatgcaacctcatgccttcgtgcctttgcttgggccatttcccctgcttgcaatgtcttgcccctttattttcccagatccccccarcagccttcctgtccctcctgcacccacaatggaggagctcttctgtgctgccaccatgcccagggcctgccctggcagggctgtgggctgttagccctgagcagtatgtctgcttacaagtctctcctccattgactgaaagcttccaggatagaaagaacatgcgtcttcaccttcacacctgcagattctaacaagatgccatgcagactgggtgcttggtagttggtggttgaaatgactctgtcatctcagggatgaggaatgtgagatgcagagatgggctcagggccagcttct

SEQ ID NO: 183132 - DNA, 601 bp, Human
tgttagcttcagtctcaggtcctatgtgatggccagatgttgggaggaccccagagtttacattctctcagtttcacatccgatgggcaagagtgccagtccctccttcggaatcctccacagacgtctgatggagtctcattggctcttactgggccacatgcccacgcctggaaaaagtaacagtgctggaggaatgcaaggctctgatgggccagatctgtcaatgccctgcctgggccctggcatggagccagcccacatggtgatgggagccacgtggtgtggagctgggggctgkatctcaaatgaaaatagagagctattacccccagaatggggcgtaggtgccagacaacagaaacctccaccacatggtgtagagttgcagaaagtttcccttttttgtttttcccagcttcctttcataaggtttcccccagttaagttgtgtttgtaatacccaaacttctagtctagcgtgtagcatctagtatgttttttgaagagagcacctcatgtctttcaagactgtgtgtgtgtatgtgtttaggtaagataaggtaaggtaaagtagatatttattaagtttctttgaagc

SEQ ID NO: 183133 - DNA, 601 bp, Human
cagcctggccaatatggtgaaaccttgtctctactaaaaatacaaaaattttccgggcgtggtggtgcatgcctgtagtcccagctacttgagaggccaaggcaggagaattgtttgaaccctggaggcggagtttgcagtgagccaagatcacgccactgcactccagcctgggcaacagagtgagactccacctcaaaaaaaaaaaaaagtccctgtaaagtacagcttgcttgttctaatagaacccacattgttggcttttattggaattaacatctttaaccatctagagcacacrctatcatgtttccgataatgctttctcctcctctgggctgtttgaatcgcactggcctccctctggcttctctgtgatccttgtggcatcccaggtgagatgctaaatacagtctgtttttactgcagaaatctcagctaccttggagtcaaatgcagaaagccagaggagcaaagttgtttttctccctgtgttatgcccagctcacaccattacgaagatgagtttttagggcctgtcatttagttctgagacagcagagcaaggaccaggttttatacattccattctttgctcagt

SEQ ID NO: 183134 - DNA, 601 bp, Human
cccactcaagaccccactcccacaaaggcaaccattattccaacttctattgccagaaattcattttgctggttttggaacttcatataaatagaaacatatagtatagactctttcaggtcttattacatatgtttttgagcttcatccatgctgttacctgtattggtagtttattgatttgtattgctaagtggaattccattgtatggatatagcacaatttatttctccatctcatgttgatggggatttggtggtttctagttttttgctatttatgcatgaagctgctgtgaayactcttgaacatgtctttgatggacataaacactcatttctgctggttatatgctaatatttataaaacatcagtgacccacagccctccccattcgtgatgaatatctgctatctcccaggctttgacagacctcagcagaggtcttagccctattagagccatgtcctcattagtagccaagacctccctgggaaacgtggcccttcccccatgctcgcagtgggaggtaggcagaagctacatatgcttacctctccttcccaggtatcttctagactctgtagggctctatttctt

SEQ ID NO: 183135 - DNA, 601 bp, Human
tatagtatagactctttcaggtcttattacatatgtttttgagcttcatccatgctgttacctgtattggtagtttattgatttgtattgctaagtggaattccattgtatggatatagcacaatttatttctccatctcatgttgatggggatttggtggtttctagttttttgctatttatgcatgaagctgctgtgaatactcttgaacatgtctttgatggacataaacactcatttctgctggttatatgctaatatttataaaacatcagtgacccacagccctccccattcgtratgaatatctgctatctcccaggctttgacagacctcagcagaggtcttagccctattagagccatgtcctcattagtagccaagacctccctgggaaacgtggcccttcccccatgctcgcagtgggaggtaggcagaagctacatatgcttacctctccttcccaggtatcttctagactctgtagggctctatttctttagcagaatttgcctttgtttttagtgtccttctgacaaacctacttcatatgaagtcaacatgctccgaatttatgagtatgattataccctattctt

SEQ ID NO: 183136 - DNA, 601 bp, Human
acatcagtgacccacagccctccccattcgtgatgaatatctgctatctcccaggctttgacagacctcagcagaggtcttagccctattagagccatgtcctcattagtagccaagacctccctgggaaacgtggcccttcccccatgctcgcagtgggaggtaggcagaagctacatatgcttacctctccttcccaggtatcttctagactctgtagggctctatttctttagcagaatttgcctttgtttttagtgtccttctgacaaacctacttcatatgaagtcaacatgctcygaatttatgagtatgattataccctattcttagttctagtaatcctaagacttctttggataacctcagggtatgtcatttatctattgctgcatgacaaaccaccctaaaactttgtagtttaaaacaatagtgatttcttatttatcatcatgcttcatgctgtgggtcaggatttaggtcagggtttagcaggccaattcttctgctctgtgtggcattggctggggtctcctacttaactttgttcagctggtagcacagttgaactggaacatccaagatgacctctcaccctcc

SEQ ID NO: 183137 - DNA, 601 bp, Human
gaggtaggcagaagctacatatgcttacctctccttcccaggtatcttctagactctgtagggctctatttctttagcagaatttgcctttgtttttagtgtccttctgacaaacctacttcatatgaagtcaacatgctccgaatttatgagtatgattataccctattcttagttctagtaatcctaagacttctttggataacctcagggtatgtcatttatctattgctgcatgacaaaccaccctaaaactttgtagtttaaaacaatagtgatttcttatttatcatcatgctttatgctgtgggtcaggatttaggtcagggtttagcaggccaattcttctgctctgtgtggcattggctggggtctcctacttaactttgttcagctggtagcacagttgaactggaacatccaagatgacctctcaccctccaggcccctctccctgtagcctctaatcattcagtagtctagttcagacttccttacagcaagagataggaagtggaagctaccagtcttcttaagcctttgactcagaaatctcagaacattgtttcttctgctttctgttaattaaagaaagtcacaa

SEQ ID NO: 183138 - DNA, 601 bp, Human
ttgttcagctggtagcacagttgaactggaacatccaagatgacctctcaccctccaggcccctctccctgtagcctctaatcattcagtagtctagttcagacttccttacagcaagagataggaagtggaagctaccagtcttcttaagcctttgactcagaaatctcagaacattgtttcttctgctttctgttaattaaagaaagtcacaaagccagttctgattcaaggggagggggaaatagtccccatctcttgatgtgagatctctaccatatgggatagtatgaagttgaascttcagtctttcaggtcttccctaggacttgaaaacttttagtgaatgtctagacagaaccccagctgtctaactctttgtgtaaattgtctctctatatacccttttgttaatagaggggtacattctgggcttgcaggttagaaccaggcatagtctcacataaaaaaagtattacagctagtcacaatgcagcaaaatggcatctttttctaatcttactttaggcacaatgtggattaaattaatttaaggatctctttctgccaagacagcattcatcttggggaaaatgcattc

SEQ ID NO: 183139 - DNA, 601 bp, Human
tgaactggaacatccaagatgacctctcaccctccaggcccctctccctgtagcctctaatcattcagtagtctagttcagacttccttacagcaagagataggaagtggaagctaccagtcttcttaagcctttgactcagaaatctcagaacattgtttcttctgctttctgttaattaaagaaagtcacaaagccagttctgattcaaggggagggggaaatagtccccatctcttgatgtgagatctctaccatatgggatagtatgaagttgaagcttcagtctttcaggtcttcyctaggacttgaaaacttttagtgaatgtctagacagaaccccagctgtctaactctttgtgtaaattgtctctctatatacccttttgttaatagaggggtacattctgggcttgcaggttagaaccaggcatagtctcacataaaaaaagtattacagctagtcacaatgcagcaaaatggcatctttttctaatcttactttaggcacaatgtggattaaattaatttaaggatctctttctgccaagacagcattcatcttggggaaaatgcattccaaggtccaaattgccaaatg

SEQ ID NO: 183140 - DNA, 601 bp, Human
tccatgtggattccaagtgcaagtctgactctggaatttgctcccagaagcaacatttattgctgctttgtttctccccacagggtgctggcccccaagtgtgcagcctgtgggcttcccatccttccacctgaggtaagatgcccttccagacatgctcccaggggcttctaagacatgaatatctccctgggctcatttacaagatccatgtcctgtccttacagcttttaaggtatccttttaaaaatctcaactctggcctggtgcagtggctcacgcctgtaatcccaccccttttaggaggcccaggcaggaaaattgcttgaggcctggagtttaagaacagcctgggcaacatagcaagacctcatctctacaaaaaattgttaaaaattggccaagtgtggtggcatgtgcctgtagtcctagctgcttgagcccaagagtttgaggctgcagcgagctatgatggtgctactgcattccagcaggtgacagcaagaccttgtctccaaaaaaaaaaaaccaaaaaaaaccccacttcacctttgagataagtcgtgtcttcacccttccttgttgactggcttccccaacc

SEQ ID NO: 183141 - DNA, 601 bp, Human
cccctccccacccagcccccaaagcccattgtagacatccaagagaaaagcatcctgcgttgactggggcaagaggcagtcaacaagattctggcaagggtcagccctctagagcttctgtaggaaatggaatgaaggctggttcttgggggaggtaggagaagatggaaatgctcaaggtataaaggtctttcttctgcatattcagaactatcaagtcctgcaactgttggagctgctctccctgaagctgcagagctaggagggtcgtggagagcatgggtttcaggtcctatctgcrggccacattgtcaggcaggtgtgcgatttggggaagggactccctcccctccagcttgcaggctgttctatctgcctgaagctcctttctcagctgagccctggaaatcatgaagcccctcttggaaacaggcatgtcagctggtggtgtgaaggcgggtggggtccgcctgccccttcctgccctttgtcccaacccaagatgaaggagcactagtacctgatgactgtcaggaaagctagaggttgcccctcaccaacccttgtgaagggtgaccatggaatttcagccacaattaag

SEQ ID NO: 183142 - DNA, 601 bp, Human
aatttcagccacaattaagtgaattcacccatggaaggagattagattcatttggtgaccctgtgggtagagaatgggggtgtccctcatatagacttgtcccactgccaacactgaagaaatgggtgggaatcattgctgctgggaccccaggtgccccaggtcactgcaggagaaaaaggtgaggacatttgctcaacaggcctctccacattttctagaccagtgctatccaaaagaaatataaggggccgggcgcgatagctcacgcctgtaatctcagcactttgggaggccaagrccggcagattacttgaggtcaggagttcgagaccagcctggccaacatggcaaaaacccatctctactaaaaatacaaagattagtgggcgtggtggcacacgcctgtagtcccagctactcgggaagctgagacaggagaattgcttgaacctgggaagtggaggttgcagtgacctgagatcatgctactgcactccagcctgggcaacagagcaagactccgtctcaaaaaaagaaagaactatgagagccacaaattaaagtcatgtatcattttaagttttctggtagtcacaat

SEQ ID NO: 183143 - DNA, 601 bp, Human
tgagtgagaacatgtggtgtttagttttctgttcctttgttagtttgctgagaatgatggcttccagcttcatccatgtccctgcaaaggacatgatctcattcctttttcccatgagatatttttacatcctctttttgtcctaagtcttcggaatctgcatttacactgacagcacattttaagtggttcacagcaagtgccttgtggcagtgtctcctgtgttggacaggcctccacggggcaggagctgtgtttctgcactggcatttcctgcctatacagaaacacacagcaccckctgctgattttggggactgtggccttcaggtcagtcttgcagtctgttttgttttgcttcccctggacatgtctgcctccccacaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctgggg

SEQ ID NO: 183144 - DNA, 601 bp, Human
tcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccrggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctc

SEQ ID NO: 183145 - DNA, 601 bp, Human
tcgtgggagggacccggtgggaggtaactgaatcatgggagcaagtttatcccatactgttcttgtggtagtgaataagtctcacgagatctgacggttttataaagggcagttcccctgcacacgctctcttgcctgccaccatgtaagatgtggctttgctcctcctttgccttctgcagaggcctcccagacatgtggaattgtgagtccattagacctcattttccttataaattacctagtctctggtatgcctttatcagcagcatgagaacagaccaatacaacccacttctaytgactgcaggacccaggtttctgcgtgagtggcaggaaaggaaacttacattgtcgacggtggcaatgaacagcaaggctgcagaggtgatgtggaaggcgatgatgaaagcaagaagcaccaacattttcacagggcagggcgagtcgaggcgaggggtcacgtttaaagcccagagcgggatgtgctgaagagggtaagaaagagaaattcaaaatctgtcaatgacaaaacaaaattacaataaaaaataaacaccttttagctgggcgtggtggctcatgcctataatcctggaac

SEQ ID NO: 183146 - DNA, 601 bp, Human
tgggaggacaaacgtccctgcctgccaggacctgccaccaaaacctgaacatgggacggcctgaaccttcacatttaggccaagagtcctcagcccttgggtcagaagatgtgtgtgccttcgcagggaggacaaccccgaatcgtggttgaaccttggcaggttcaacattgagaactttggcagggttctcaacctgtgatatggttcggctgtgtccccacccaaatctcgtattgtattcccataattcccacatgtcgtgggagggacccggtgggaggtaactgaatcatgggascaagtttatcccatactgttcttgtggtagtgaataagtctcacgagatctgacggttttataaagggcagttcccctgcacacgctctcttgcctgccaccatgtaagatgtggctttgctcctcctttgccttctgcagaggcctcccagacatgtggaattgtgagtccattagacctcattttccttataaattacctagtctctggtatgcctttatcagcagcatgagaacagaccaatacaacccacttctattgactgcaggacccaggtttctgcgtgagtggcaggaaag

SEQ ID NO: 183147 - DNA, 601 bp, Human
tacaatgcacagggaggcccctacaacaaaggattatccagcccaaaatgacaatagtggcaaggttgagaactctgatctagaggaaagctgaagtcacacaacatcctcaaagggcttcctagagccaggctctatgaaagaatcacagatgggaggacaaacgtccctgcctgccaggacctgccaccaaaacctgaacatgggacggcctgaaccttcacatttaggccaagagtcctcagcccttgggtcagaagatgtgtgtgccttcgcagggaggacaaccccgaatcgtggytgaaccttggcaggttcaacattgagaactttggcagggttctcaacctgtgatatggttcggctgtgtccccacccaaatctcgtattgtattcccataattcccacatgtcgtgggagggacccggtgggaggtaactgaatcatgggagcaagtttatcccatactgttcttgtggtagtgaataagtctcacgagatctgacggttttataaagggcagttcccctgcacacgctctcttgcctgccaccatgtaagatgtggctttgctcctcctttgccttctgcagaggcctc

SEQ ID NO: 183148 - DNA, 601 bp, Human
atctagcagataaggccagacacgttgctgaacttcctacaatgcacagggaggcccctacaacaaaggattatccagcccaaaatgacaatagtggcaaggttgagaactctgatctagaggaaagctgaagtcacacaacatcctcaaagggcttcctagagccaggctctatgaaagaatcacagatgggaggacaaacgtccctgcctgccaggacctgccaccaaaacctgaacatgggacggcctgaaccttcacatttaggccaagagtcctcagcccttgggtcagaagatgkgtgtgccttcgcagggaggacaaccccgaatcgtggttgaaccttggcaggttcaacattgagaactttggcagggttctcaacctgtgatatggttcggctgtgtccccacccaaatctcgtattgtattcccataattcccacatgtcgtgggagggacccggtgggaggtaactgaatcatgggagcaagtttatcccatactgttcttgtggtagtgaataagtctcacgagatctgacggttttataaagggcagttcccctgcacacgctctcttgcctgccaccatgtaagat

SEQ ID NO: 183149 - DNA, 601 bp, Human
attcctgccatatggctgcaagctggatactaaagggaaacattaaatttttcataggggcataggtagagtctggaaagttccatgcatgagctctgctggggaggacatggccgggtgggctagcaacaagggaccctggttgataaggaggtgtcaggggttgggggcagaggtcacctgggatgggtcacctggaagatctagggcagcggtcctcaacagagggtgattttgttctccatgggacatttaacaatgtctgaagatattttggattgtcataaccaggggtgggggwgctactgcatctagcagataaggccagacacgttgctgaacttcctacaatgcacagggaggcccctacaacaaaggattatccagcccaaaatgacaatagtggcaaggttgagaactctgatctagaggaaagctgaagtcacacaacatcctcaaagggcttcctagagccaggctctatgaaagaatcacagatgggaggacaaacgtccctgcctgccaggacctgccaccaaaacctgaacatgggacggcctgaaccttcacatttaggccaagagtcctcagcccttgggtc

SEQ ID NO: 183150 - DNA, 601 bp, Human
tcattctgaaaccatccccctgcaatgccccctccccagtctgtagaaaaattgtcttccatgaaaccggttcctggtgccaaaaacgttggggaccactgctataatccatagcagcaatgtggtccctgcccaggccactcacagcagctcagcaagaagctccagaacccaaatgcgattattgtgctcatctcccctgacaggctctaggaccaggagcctctggaatggctcaaatcctggctctgctgcttactgcactgtaaactctgccaagtgcccgaatggccctgaggckcagttccttcacctgtaacccggtgcaaggagatgtcggtgccctacctggtacagctggggtggggatcacatgagatgacatgcataaaagggccacagtgatcgctaagtgacaggcattatagtttatgttactattgtcatgatgatccatcaacgggagccgtatatgtaggcagagttggtggccactcgtatggtgtactttttggctttctgagcaatgtttctgccctttaattatctctgcagtctaaaatgagcaggatggaagccaggtctttggaacagtgtatag

SEQ ID NO: 183151 - DNA, 601 bp, Human
ccagggatctaggctgcacgctccttatgagactctaatgcctgatgatctgtcactgtctcccatcacccccagatgggaccgtctagtccagaacaacaagctcagggctcccactgattccacattatgacgagttatataattatttcattatatattaaaatgtaataataataaagtgcacaataaatgtaatgcacttgaatcattctgaaaccatccccctgcaatgccccctccccagtctgtagaaaaattgtcttccatgaaaccggttcctggtgccaaaaacgttggkgaccactgctataatccatagcagcaatgtggtccctgcccaggccactcacagcagctcagcaagaagctccagaacccaaatgcgattattgtgctcatctcccctgacaggctctaggaccaggagcctctggaatggctcaaatcctggctctgctgcttactgcactgtaaactctgccaagtgcccgaatggccctgaggcgcagttccttcacctgtaacccggtgcaaggagatgtcggtgccctacctggtacagctggggtggggatcacatgagatgacatgcataaaa

SEQ ID NO: 183152 - DNA, 601 bp, Human
ggtgcacatcaccacgcctactttttgtattttttgtagagtcagtgtttactatgttgtcaggctagtcttgaactcctgacctcaggtgatccgcccacctcagcctcccacagtgctgggattacaagcatgagccactgcgctcagccgggattctacatttctttttttttttcctttttttgttttttttgagacagagtttcactcttgttgcccaggctggagtgcgatgcatgatcttggctcactgcaaccctcccatactgggttcaagcaattctcctgcctcagtctmacgagtagctgggatttagaggcatgcaccagcacacctggctcatttttgtatttttagtagagacagggtttcgccatgttggtcagactagtctcaaacttctgacctcaggtgatccacctgccttggcctcccaaagtgctgggattacaggcgtgagccaccacgcctggccaggattctgcatttctaaccggctccaggtgatgccctgctactttctcccaaaggataagaggtggtccaggccctcagagagtatgggagaaaagatgaggctgagttgctggaagtaat

SEQ ID NO: 183153 - DNA, 601 bp, Human
gctcctggctatgcggccttgggtaacttaactgctctctgcctcagtttccccatcttaaaatggggcctatggtccctgcctgatggggctatgagatcacctatgtaaaggacttagacccatgcctcacagtaaactttaagtaaatggtgccttctactggtatttttgctgcttttatgatgaatatggatattgttactgagtgtggtgagaatctgggacccagggagtaggctcctttgctccctaataggattgtcagatttggcaaacaaaccaaaacaaacacaaagayaggatgcccagtacatgaatatccgatggacaacaaataaattttaggagaggcatggtggctcctcctcctcctttaggctgaggtgggcagatctctggagcccaggagttcgagaccagcctgggcaacatggtgaaactacatctctacaaaaattacgaaaattagctgggcatggtggtgagtgcctgtagtcccagctacttgagaggctgagatgggaggatcacttgagcccgggaggtcaaggctgcagtgagtcgtgactgcaccactgcactccagcctgggtgacag

SEQ ID NO: 183154 - DNA, 601 bp, Human
tggccagcggttcgccaacccctgttttaaagaaaaataagtgaataatcccatgtggaggattcagaaaaacagccacagagcacagcaagccctcccagctggccttgcacactggcgacagctggggcttgcagagctcagggaaggagggctgttcccagggccagaggttagcatgacagaataacagacgagatggaagggagcaccgatggtgttccgtggttaagggtactggctttagagctggtcacacctagactggaatcctgccgccatcattcgctcctggctatgyggccttgggtaacttaactgctctctgcctcagtttccccatcttaaaatggggcctatggtccctgcctgatggggctatgagatcacctatgtaaaggacttagacccatgcctcacagtaaactttaagtaaatggtgccttctactggtatttttgctgcttttatgatgaatatggatattgttactgagtgtggtgagaatctgggacccagggagtaggctcctttgctccctaataggattgtcagatttggcaaacaaaccaaaacaaacacaaagacaggatgcccagta

SEQ ID NO: 183155 - DNA, 601 bp, Human
aaaactgttcttagctccccggccaaacaaaaacaggccttggactgaatttggccagcggttcgccaacccctgttttaaagaaaaataagtgaataatcccatgtggaggattcagaaaaacagccacagagcacagcaagccctcccagctggccttgcacactggcgacagctggggcttgcagagctcagggaaggagggctgttcccagggccagaggttagcatgacagaataacagacgagatggaagggagcaccgatggtgttccgtggttaagggtactggctttagagstggtcacacctagactggaatcctgccgccatcattcgctcctggctatgcggccttgggtaacttaactgctctctgcctcagtttccccatcttaaaatggggcctatggtccctgcctgatggggctatgagatcacctatgtaaaggacttagacccatgcctcacagtaaactttaagtaaatggtgccttctactggtatttttgctgcttttatgatgaatatggatattgttactgagtgtggtgagaatctgggacccagggagtaggctcctttgctccctaataggatt

SEQ ID NO: 183156 - DNA, 601 bp, Human
cttttaaaaatgtaaaaactgttcttagctccccggccaaacaaaaacaggccttggactgaatttggccagcggttcgccaacccctgttttaaagaaaaataagtgaataatcccatgtggaggattcagaaaaacagccacagagcacagcaagccctcccagctggccttgcacactggcgacagctggggcttgcagagctcagggaaggagggctgttcccagggccagaggttagcatgacagaataacagacgagatggaagggagcaccgatggtgttccgtggttaagggyactggctttagagctggtcacacctagactggaatcctgccgccatcattcgctcctggctatgcggccttgggtaacttaactgctctctgcctcagtttccccatcttaaaatggggcctatggtccctgcctgatggggctatgagatcacctatgtaaaggacttagacccatgcctcacagtaaactttaagtaaatggtgccttctactggtatttttgctgcttttatgatgaatatggatattgttactgagtgtggtgagaatctgggacccagggagtaggctcctttgc

SEQ ID NO: 183157 - DNA, 601 bp, Human
gtgtgtgtgtgtgtaaacaacttttaaaaatgtaaaaactgttcttagctccccggccaaacaaaaacaggccttggactgaatttggccagcggttcgccaacccctgttttaaagaaaaataagtgaataatcccatgtggaggattcagaaaaacagccacagagcacagcaagccctcccagctggccttgcacactggcgacagctggggcttgcagagctcagggaaggagggctgttcccagggccagaggttagcatgacagaataacagacgagatggaagggagcaccgakggtgttccgtggttaagggtactggctttagagctggtcacacctagactggaatcctgccgccatcattcgctcctggctatgcggccttgggtaacttaactgctctctgcctcagtttccccatcttaaaatggggcctatggtccctgcctgatggggctatgagatcacctatgtaaaggacttagacccatgcctcacagtaaactttaagtaaatggtgccttctactggtatttttgctgcttttatgatgaatatggatattgttactgagtgtggtgagaatctgggacc

SEQ ID NO: 183158 - DNA, 601 bp, Human
ctctacagaaaatacaaaaattagccaggtgtggtggcacacacccataatcccagctactggggaggctgaggtgggaggatcactcgaacctggggggcagaggttacagtgagctgtgattgcaccactgcactccagccagagtgacaaagcgagaccctgattcaaacggaaaaaaaaaaagaaaatagatttatgggtgagtgcagaggctcatgcctataaaccccagcactttgggaggccaaggtgggaggatcacttgaagccaggcgtgaaaaaccagccttggcaacayagcaagaccctgtctccactaaataaatacagtagatttatgtacagaaaagtgggctattttaaaagtaaactttttaaagtaaaaaaagttggcaaactttttcagtagagggacagacagtgaatattttaggttttgtgaaccatatggtctcttgtcgaatgttctttttgttttgtttttaggggtgtgtgtgtgtgtgtaaacaacttttaaaaatgtaaaaactgttcttagctccccggccaaacaaaaacaggccttggactgaatttggccagcggttcgccaacccct

SEQ ID NO: 183159 - DNA, 601 bp, Human
aaccctgtctctacagaaaatacaaaaattagccaggtgtggtggcacacacccataatcccagctactggggaggctgaggtgggaggatcactcgaacctggggggcagaggttacagtgagctgtgattgcaccactgcactccagccagagtgacaaagcgagaccctgattcaaacggaaaaaaaaaaagaaaatagatttatgggtgagtgcagaggctcatgcctataaaccccagcactttgggaggccaaggtgggaggatcacttgaagccaggcgtgaaaaaccagcctkggcaacatagcaagaccctgtctccactaaataaatacagtagatttatgtacagaaaagtgggctattttaaaagtaaactttttaaagtaaaaaaagttggcaaactttttcagtagagggacagacagtgaatattttaggttttgtgaaccatatggtctcttgtcgaatgttctttttgttttgtttttaggggtgtgtgtgtgtgtgtaaacaacttttaaaaatgtaaaaactgttcttagctccccggccaaacaaaaacaggccttggactgaatttggccagcggttcgc

SEQ ID NO: 183160 - DNA, 601 bp, Human
cacagtgggtgaagtgggagaatcgcttgagctcaggagttcaagaccagcatgggcaacatggtaaaaccctgtctctacagaaaatacaaaaattagccaggtgtggtggcacacacccataatcccagctactggggaggctgaggtgggaggatcactcgaacctggggggcagaggttacagtgagctgtgattgcaccactgcactccagccagagtgacaaagcgagaccctgattcaaacggaaaaaaaaaaagaaaatagatttatgggtgagtgcagaggctcatgcctawaaaccccagcactttgggaggccaaggtgggaggatcacttgaagccaggcgtgaaaaaccagccttggcaacatagcaagaccctgtctccactaaataaatacagtagatttatgtacagaaaagtgggctattttaaaagtaaactttttaaagtaaaaaaagttggcaaactttttcagtagagggacagacagtgaatattttaggttttgtgaaccatatggtctcttgtcgaatgttctttttgttttgtttttaggggtgtgtgtgtgtgtgtaaacaacttttaaaaatgt

SEQ ID NO: 183161 - DNA, 601 bp, Human
atgggagggatgtgacattctctttaacatagacttatggtttgggaggccacagtgggtgaagtgggagaatcgcttgagctcaggagttcaagaccagcatgggcaacatggtaaaaccctgtctctacagaaaatacaaaaattagccaggtgtggtggcacacacccataatcccagctactggggaggctgaggtgggaggatcactcgaacctggggggcagaggttacagtgagctgtgattgcaccactgcactccagccagagtgacaaagcgagaccctgattcaaacggaaaaaaaaaaagaaaatagatttatgggtgagtgcagaggctcatgcctataaaccccagcactttgggaggccaaggtgggaggatcacttgaagccaggcgtgaaaaaccagccttggcaacatagcaagaccctgtctccactaaataaatacagtagatttatgtacagaaaagtgggctattttaaaagtaaactttttaaagtaaaaaaagttggcaaactttttcagtagagggacagacagtgaatattttaggttttgtgaaccatatggtctcttgtcgaatgttcttttt

SEQ ID NO: 183162 - DNA, 601 bp, Human
tctctgtcttcttttggatgctggttacgtgggtgtttatacaattgtcaaaacccaccaaattgagcccttaagaagcctgcgtttccgtgtttgtaaattataactccattaaaaaaagaaaaagaaaaagaaaacccagcaggctctactgagatgaaataaatcagaacgtcgggcattgagagcgggcacgagggcttcgtaaagccaccgagggaattccaatatggagcccaagtggtgaccctctggcttacagcagtacttcccaaatctgcccaatcccagggatcacctgggattgcttattaaaaatacagattcttaggcctctccccctggagattctgctaccattgtcctggagtgggcaccaggaatctgtattttcagcaacaagtgacccatgatggggcaaatggggaaaacatggctttgggggaaaggatgaatagatgttcctagaacagggtttctcaaagctgggagggggtgcaggatgtgcctgccaggcagcccctgagatgggtgtatgtggaacccagtgaggacgggaaactacacaaattcacggaatgagagggatgctcactttgct

SEQ ID NO: 183163 - DNA, 601 bp, Human
gccctcggggcagaaagcggtagcaactgtgtggaagggggcccgaggaactttctggagagttggcaatgttctctgtcttcttttggatgctggttacgtgggtgtttatacaattgtcaaaacccaccaaattgagcccttaagaagcctgcgtttccgtgtttgtaaattataactccattaaaaaaagaaaaagaaaaagaaaacccagcaggctctactgagatgaaataaatcagaacgtcgggcattgagagcgggcacgagggcttcgtaaagccaccgagggaattccaayatggagcccaagtggtgaccctctggcttacagcagtacttcccaaatctgcccaatcccagggatcacctgggattgcttattaaaaatacagattcttaggcctctccccctggagattctgctaccattgtcctggagtgggcaccaggaatctgtattttcagcaacaagtgacccatgatggggcaaatggggaaaacatggctttgggggaaaggatgaatagatgttcctagaacagggtttctcaaagctgggagggggtgcaggatgtgcctgccaggcagcccctgagat

SEQ ID NO: 183164 - DNA, 601 bp, Human
agcctttcccccaattccttatggggagcgaaaggagtcagaccggctcccccactatgacacacaccacatgaccccattcccatgaggcccaggaacaggtggaagtgagttatagtgacagaagtcagaagtggttgccctcggggcagaaagcggtagcaactgtgtggaagggggcccgaggaactttctggagagttggcaatgttctctgtcttcttttggatgctggttacgtgggtgtttatacaattgtcaaaacccaccaaattgagcccttaagaagcctgcgtttccktgtttgtaaattataactccattaaaaaaagaaaaagaaaaagaaaacccagcaggctctactgagatgaaataaatcagaacgtcgggcattgagagcgggcacgagggcttcgtaaagccaccgagggaattccaatatggagcccaagtggtgaccctctggcttacagcagtacttcccaaatctgcccaatcccagggatcacctgggattgcttattaaaaatacagattcttaggcctctccccctggagattctgctaccattgtcctggagtgggcaccaggaatctgtat

SEQ ID NO: 183165 - DNA, 601 bp, Human
cagattacggttgcttggagagcatctagcctttcccccaattccttatggggagcgaaaggagtcagaccggctcccccactatgacacacaccacatgaccccattcccatgaggcccaggaacaggtggaagtgagttatagtgacagaagtcagaagtggttgccctcggggcagaaagcggtagcaactgtgtggaagggggcccgaggaactttctggagagttggcaatgttctctgtcttcttttggatgctggttacgtgggtgtttatacaattgtcaaaacccaccaaaytgagcccttaagaagcctgcgtttccgtgtttgtaaattataactccattaaaaaaagaaaaagaaaaagaaaacccagcaggctctactgagatgaaataaatcagaacgtcgggcattgagagcgggcacgagggcttcgtaaagccaccgagggaattccaatatggagcccaagtggtgaccctctggcttacagcagtacttcccaaatctgcccaatcccagggatcacctgggattgcttattaaaaatacagattcttaggcctctccccctggagattctgctaccattgt

SEQ ID NO: 183166 - DNA, 601 bp, Human
aatccattctggctacagattacggttgcttggagagcatctagcctttcccccaattccttatggggagcgaaaggagtcagaccggctcccccactatgacacacaccacatgaccccattcccatgaggcccaggaacaggtggaagtgagttatagtgacagaagtcagaagtggttgccctcggggcagaaagcggtagcaactgtgtggaagggggcccgaggaactttctggagagttggcaatgttctctgtcttcttttggatgctggttacgtgggtgtttatacaattgycaaaacccaccaaattgagcccttaagaagcctgcgtttccgtgtttgtaaattataactccattaaaaaaagaaaaagaaaaagaaaacccagcaggctctactgagatgaaataaatcagaacgtcgggcattgagagcgggcacgagggcttcgtaaagccaccgagggaattccaatatggagcccaagtggtgaccctctggcttacagcagtacttcccaaatctgcccaatcccagggatcacctgggattgcttattaaaaatacagattcttaggcctctccccctggaga

SEQ ID NO: 183167 - DNA, 601 bp, Human
taatgaaacgtctagagctgtggatttaatccattctggctacagattacggttgcttggagagcatctagcctttcccccaattccttatggggagcgaaaggagtcagaccggctcccccactatgacacacaccacatgaccccattcccatgaggcccaggaacaggtggaagtgagttatagtgacagaagtcagaagtggttgccctcggggcagaaagcggtagcaactgtgtggaagggggcccgaggaactttctggagagttggcaatgttctctgtcttcttttggatgstggttacgtgggtgtttatacaattgtcaaaacccaccaaattgagcccttaagaagcctgcgtttccgtgtttgtaaattataactccattaaaaaaagaaaaagaaaaagaaaacccagcaggctctactgagatgaaataaatcagaacgtcgggcattgagagcgggcacgagggcttcgtaaagccaccgagggaattccaatatggagcccaagtggtgaccctctggcttacagcagtacttcccaaatctgcccaatcccagggatcacctgggattgcttattaaaaatac

SEQ ID NO: 183168 - DNA, 601 bp, Human
aggcatgtctggctaatttttaaaaaatttttgtagggatggagtctcgctatgttgctcacggtggtcttgaactctaaaatggggatactaatagctccttcctcatcgggctaggaaggtagagtaaactcatctacataagggggtttggagggtgcaggcaaggtgggagtcctgtgtaagagctgaatgctgaatgttaccaccaggatgaggccaaaagataaggtgaggggacagcgtccacgctgcacagaaaatctaaggacacaccttccttttctttttctttctgtctttttttccttcaattttgcagttttgcctgaaaactcactggagtgaacgtaattggtaagtacttaatgaaacgtctagagctgtggatttaatccattctggctacagattacggttgcttggagagcatctagcctttcccccaattccttatggggagcgaaaggagtcagaccggctcccccactatgacacacaccacatgaccccattcccatgaggcccaggaacaggtggaagtgagttatagtgacagaagtcagaagtggttgccctcggggcagaaagcggtagcaac

SEQ ID NO: 183169 - DNA, 601 bp, Human
agcctcctgtgtagctgggactacaggcatgtctggctaatttttaaaaaatttttgtagggatggagtctcgctatgttgctcacggtggtcttgaactctaaaatggggatactaatagctccttcctcatcgggctaggaaggtagagtaaactcatctacataagggggtttggagggtgcaggcaaggtgggagtcctgtgtaagagctgaatgctgaatgttaccaccaggatgaggccaaaagataaggtgaggggacagcgtccacgctgcacagaaaatctaaggacacacyttccttttctttttctttctgtctttttttccttcaattttgcagttttgcctgaaaactcactggagtgaacgtaattggtaagtacttaatgaaacgtctagagctgtggatttaatccattctggctacagattacggttgcttggagagcatctagcctttcccccaattccttatggggagcgaaaggagtcagaccggctcccccactatgacacacaccacatgaccccattcccatgaggcccaggaacaggtggaagtgagttatagtgacagaagtcagaagtggttgcc

SEQ ID NO: 183170 - DNA, 601 bp, Human
tggagaagggaggcctagggtggagggtgtcacatgggggcaggtcacagtgaggctaatgtgtagaaagctatgtggccatagggaaggcatcctgcacatgggttaccttcgtgggcctcagtttcctcacctgtaaaatggggatatagatatattttttgagacagggtctcactctgacaaccaggctggagtgtagtggcacaaccgtagctcactgcagccttgaactcttgggcccaagtgatcctcctgcctcagcctcctgtgtagctgggactacaggcatgtctggctratttttaaaaaatttttgtagggatggagtctcgctatgttgctcacggtggtcttgaactctaaaatggggatactaatagctccttcctcatcgggctaggaaggtagagtaaactcatctacataagggggtttggagggtgcaggcaaggtgggagtcctgtgtaagagctgaatgctgaatgttaccaccaggatgaggccaaaagataaggtgaggggacagcgtccacgctgcacagaaaatctaaggacacaccttccttttctttttctttctgtctttttttccttcaat

SEQ ID NO: 183171 - DNA, 601 bp, Human
acaagggcagccaaggcgtcttccagaccccctgcccctcacctccagtgtccatttgactggacaatcctcgaccccttatctggaagacgaggcaagaaccacctgctctgcattcttcctggtctgggtcacagaccccacatgcttggctcatggacaggggaatcttttgaaggacaaacctcaggttccaacgtggtagattgtgactcaagaaatcaggatggggccttgggggtctccattttagagagggattcccatggactcagggctcatgggactgtgaccttgtgargtgctctgtggactccacactagcctgtaggtatcggaggctgatcttcacggtcactacttacaaagaggaggaaagctcctttcttttcaggtcagccttaacagagactggggtatgaaggtttggggctcagtacagagaagtttcagtggagaagggaggcctagggtggagggtgtcacatgggggcaggtcacagtgaggctaatgtgtagaaagctatgtggccatagggaaggcatcctgcacatgggttaccttcgtgggcctcagtttcctcacctgtaaaatggggat

SEQ ID NO: 183172 - DNA, 601 bp, Human
gcctgcagcgtggagtactctgcgggaaaagggcaggggcgcaggactgaggaccttggccagccggcactgcggggtacacagcgaccgcagcagctccagagtaggtgtgacaggaggcaaacaggaaggggttcaggcggtcgtctacatggtctgagcacaagggcagccaaggcgtcttccagaccccctgcccctcacctccagtgtccatttgactggacaatcctcgaccccttatctggaagacgaggcaagaaccacctgctctgcattcttcctggtctgggtcacagaycccacatgcttggctcatggacaggggaatcttttgaaggacaaacctcaggttccaacgtggtagattgtgactcaagaaatcaggatggggccttgggggtctccattttagagagggattcccatggactcagggctcatgggactgtgaccttgtgaagtgctctgtggactccacactagcctgtaggtatcggaggctgatcttcacggtcactacttacaaagaggaggaaagctcctttcttttcaggtcagccttaacagagactggggtatgaaggtttggggctcagta

SEQ ID NO: 183173 - DNA, 601 bp, Human
tgcttcaggcggaagagctggagcacgaagatgaagaaggcgatgcagcagagaatggtggagaggatcatggtggcctggaccgcctgcagcgtggagtactctgcgggaaaagggcaggggcgcaggactgaggaccttggccagccggcactgcggggtacacagcgaccgcagcagctccagagtaggtgtgacaggaggcaaacaggaaggggttcaggcggtcgtctacatggtctgagcacaagggcagccaaggcgtcttccagaccccctgcccctcacctccagtgtccayttgactggacaatcctcgaccccttatctggaagacgaggcaagaaccacctgctctgcattcttcctggtctgggtcacagaccccacatgcttggctcatggacaggggaatcttttgaaggacaaacctcaggttccaacgtggtagattgtgactcaagaaatcaggatggggccttgggggtctccattttagagagggattcccatggactcagggctcatgggactgtgaccttgtgaagtgctctgtggactccacactagcctgtaggtatcggaggctgatcttcacggt

SEQ ID NO: 183174 - DNA, 601 bp, Human
acacaccggcacacagcaccgcgcggctgccaatttctcctttccaaattctccctcctcctggcttccctcctggcggctgggaagggagtgcttattccagaaagccccttgttagggaagcccgttgatgtacttacatgacattagctggatgatggaggttaggacaaacctctctccctgcttcaggcggaagagctggagcacgaagatgaagaaggcgatgcagcagagaatggtggagaggatcatggtggcctggaccgcctgcagcgtggagtactctgcgggaaaaggrcaggggcgcaggactgaggaccttggccagccggcactgcggggtacacagcgaccgcagcagctccagagtaggtgtgacaggaggcaaacaggaaggggttcaggcggtcgtctacatggtctgagcacaagggcagccaaggcgtcttccagaccccctgcccctcacctccagtgtccatttgactggacaatcctcgaccccttatctggaagacgaggcaagaaccacctgctctgcattcttcctggtctgggtcacagaccccacatgcttggctcatggacaggggaatct

SEQ ID NO: 183175 - DNA, 601 bp, Human
tggcctgcaagactccatggggcgtggccctgcctgccctgctggttcacttcccactgcactccagccccactgggcagctctccgtccctcctatcacagggcttccgtcatgctgttccctctacccaggacactgttccctcctctctctattgagacacaacactgtcgacagcgactcctactcaccctccagatcctctggcttcatgtctccaggatgccttccctggactcccaactcaatccaaactcccaaatataaacgtcccactgtggtacagcatgcatgcgcccccacacacacacacacacacgcaaacacacaccggcacacagcaccgcgcggctgccaatttctcctttccaaattctccctcctcctggcttccctcctggcggctgggaagggagtgcttattccagaaagccccttgttagggaagcccgttgatgtacttacatgacattagctggatgatggaggttaggacaaacctctctccctgcttcaggcggaagagctggagcacgaagatgaagaaggcgatgcagcagagaatggtggagaggatcatggtggcctggaccgcctgca

SEQ ID NO: 183176 - DNA, 601 bp, Human
tgctaaaattcctaagtagaaaaaaatgctctgagacctctgcttcctccaagttcctccaggactgaggctgtgccttgttcatctcttgagcccctgcagccagcacaggcctggtgcaacgtgggcacctctgtcacccaccagcttgaaacctgttgatggcttcccatcagcttagaacaaagaccccaaatcctttctatggcctgcaagactccatggggcgtggccctgcctgccctgctggttcacttcccactgcactccagccccactgggcagctctccgtccctcctrtcacagggcttccgtcatgctgttccctctacccaggacactgttccctcctctctctattgagacacaacactgtcgacagcgactcctactcaccctccagatcctctggcttcatgtctccaggatgccttccctggactcccaactcaatccaaactcccaaatataaacgtcccactgtggtacagcatgcatgcgcccacacacacacacacacacacgcaaacacacaccggcacacagcaccgcgcggctgccaatttctcctttccaaattctccctcctcctggcttccc

SEQ ID NO: 183177 - DNA, 601 bp, Human
ccagatttcttgccttcatcaagccactcgttaactcctgattggaaagcaccctagaagggccttctgtattttgtcatcagaaagctttaaatcgtcactgagaaacaacaaatgatcatggtgtggcttctgacttctgatctgacttaagccttgctaaaattcctaagtagaaaaaaatgctctgagacctctgcttcctccaagttcctccaggactgaggctgtgccttgttcatctcttgagcccctgcagccagcacaggcctggtgcaacgtgggcacctctgtcacccaycagcttgaaacctgttgatggcttcccatcagcttagaacaaagaccccaaatcctttctatggcctgcaagactccatggggcgtggccctgcctgccctgctggttcacttcccactgcactccagccccactgggcagctctccgtccctcctatcacagggcttccgtcatgctgttccctctacccaggacactgttccctcctctctctattgagacacaacactgtcgacagcgactcctactcaccctccagatcctctggcttcatgtctccaggatgccttccctggact

SEQ ID NO: 183178 - DNA, 601 bp, Human
cctcctgcatgggcctcccaaagtgctcctgcacctgaccgggactttcagttttaaaacagaggatggtcccaggcaaactagaacaagttgtcactgcactgcactgatgacacgtctcagggtcatcctgagggcatggcaggtttggacttgaccctggcccgggaggtggagggctggaaggaggtggtagttagagtggttagggccaagcagcctaagttggctcccacacccagatttcttgccttcatcaagccactcgttaactcctgattggaaagcaccctagaagggmcttctgtattttgtcatcagaaagctttaaatcgtcactgagaaacaacaaatgatcatggtgtggcttctgacttctgatctgacttaagccttgctaaaattcctaagtagaaaaaaatgctctgagacctctgcttcctccaagttcctccaggactgaggctgtgccttgttcatctcttgagcccctgcagccagcacaggcctggtgcaacgtgggcacctctgtcacccaccagcttgaaacctgttgatggcttcccatcagcttagaacaaagaccccaaatcctttctat

SEQ ID NO: 183179 - DNA, 601 bp, Human
ggctggtcttgaactcctgggctcaagcagtcctcctgcatgggcctcccaaagtgctcctgcacctgaccgggactttcagttttaaaacagaggatggtcccaggcaaactagaacaagttgtcactgcactgcactgatgacacgtctcagggtcatcctgagggcatggcaggtttggacttgaccctggcccgggaggtggagggctggaaggaggtggtagttagagtggttagggccaagcagcctaagttggctcccacacccagatttcttgccttcatcaagccactcgtyaactcctgattggaaagcaccctagaagggccttctgtattttgtcatcagaaagctttaaatcgtcactgagaaacaacaaatgatcatggtgtggcttctgacttctgatctgacttaagccttgctaaaattcctaagtagaaaaaaatgctctgagacctctgcttcctccaagttcctccaggactgaggctgtgccttgttcatctcttgagcccctgcagccagcacaggcctggtgcaacgtgggcacctctgtcacccaccagcttgaaacctgttgatggcttcccatca

SEQ ID NO: 183180 - DNA, 601 bp, Human
gcccaggctggtcttgaactcctgggctcaagcagtcctcctgcatgggcctcccaaagtgctcctgcacctgaccgggactttcagttttaaaacagaggatggtcccaggcaaactagaacaagttgtcactgcactgcactgatgacacgtctcagggtcatcctgagggcatggcaggtttggacttgaccctggcccgggaggtggagggctggaaggaggtggtagttagagtggttagggccaagcagcctaagttggctcccacacccagatttcttgccttcatcaagccaytcgttaactcctgattggaaagcaccctagaagggccttctgtattttgtcatcagaaagctttaaatcgtcactgagaaacaacaaatgatcatggtgtggcttctgacttctgatctgacttaagccttgctaaaattcctaagtagaaaaaaatgctctgagacctctgcttcctccaagttcctccaggactgaggctgtgccttgttcatctcttgagcccctgcagccagcacaggcctggtgcaacgtgggcacctctgtcacccaccagcttgaaacctgttgatggcttcc

SEQ ID NO: 183181 - DNA, 601 bp, Human
tacagcaccccacagctcactgcagcctttacctctcaggctcaaatgatcttccactccagcctcccaagtagctgggactacaggtgtgctctgccatgcttggctaattttttttctttttgtatagaggaggtctcactatgttgcccaggctggtcttgaactcctgggctcaagcagtcctcctgcatgggcctcccaaagtgctcctgcacctgaccgggactttcagttttaaaacagaggatggtcccaggcaaactagaacaagttgtcactgcactgcactgatgacacrtctcagggtcatcctgagggcatggcaggtttggacttgaccctggcccgggaggtggagggctggaaggaggtggtagttagagtggttagggccaagcagcctaagttggctcccacacccagatttcttgccttcatcaagccactcgttaactcctgattggaaagcaccctagaagggccttctgtattttgtcatcagaaagctttaaatcgtcactgagaaacaacaaatgatcatggtgtggcttctgacttctgatctgacttaagccttgctaaaattcctaagtagaaa

SEQ ID NO: 183182 - DNA, 601 bp, Human
attacccagtctcgggtatgtctttattagcagcttgagaatggactaatacaagtggtacagcaccccacagctcactgcagcctttacctctcaggctcaaatgatcttccactccagcctcccaagtagctgggactacaggtgtgctctgccatgcttggctaattttttttctttttgtatagaggaggtctcactatgttgcccaggctggtcttgaactcctgggctcaagcagtcctcctgcatgggcctcccaaagtgctcctgcacctgaccgggactttcagttttaaamcagaggatggtcccaggcaaactagaacaagttgtcactgcactgcactgatgacacgtctcagggtcatcctgagggcatggcaggtttggacttgaccctggcccgggaggtggagggctggaaggaggtggtagttagagtggttagggccaagcagcctaagttggctcccacacccagatttcttgccttcatcaagccactcgttaactcctgattggaaagcaccctagaagggccttctgtattttgtcatcagaaagctttaaatcgtcactgagaaacaacaaatgatca

SEQ ID NO: 183183 - DNA, 601 bp, Human
cctcgcccagggtccttgggaagaacgcattctccctttaggcctcatttgttctggcttgttgctctccaacgcttggctcagggacaggagtacaaatccccaggctctaacccagcagatgctgattcaagagggcaggctggggccttgggagtctgcactttagaaaggtccccggaaggactgtggtggacttggggggttctcaagatcaagtgaccctccggagtcttttgcacttgaaaacactctcattctccacctgtacctagaaggggtggtacctggctgtccagtraaagtgccccaaggggaggggacgctgagtgtgaccaaccaccccactttgccctggactggggtttcctaggatgcgggactttcagtgtttttattttatattgtattttattctactctatttatcttattattttttcaaggaagagtctcactgtatccctcgggctggagtacagtggtgctatggtttggctgtgtccccaccccaatctcaccttgaattgtaataatccccacatgtcaaggacggggctaggtggagatcattgaatcatgggggcggttcccccatact

SEQ ID NO: 183184 - DNA, 601 bp, Human
caccccaagttaaatgacaggattcaattgcctttaatggggtcggtgagggtggggggtccacgcctctaactggcagatacagagacagtaaaggagggggatcagacacctcctgactacctcgcccagggtccttgggaagaacgcattctccctttaggcctcatttgttctggcttgttgctctccaacgcttggctcagggacaggagtacaaatccccaggctctaacccagcagatgctgattcaagagggcaggctggggccttgggagtctgcactttagaaaggtcccsggaaggactgtggtggacttggggggttctcaagatcaagtgaccctccggagtcttttgcacttgaaaacactctcattctccacctgtacctagaaggggtggtacctggctgtccagtaaaagtgccccaaggggaggggacgctgagtgtgaccaaccaccccactttgccctggactggggtttcctaggatgcgggactttcagtgtttttattttatattgtattttattctactctatttatcttattattttttcaaggaagagtctcactgtatccctcgggctggagta

SEQ ID NO: 183185 - DNA, 601 bp, Human
ttttcaataaatcatggaccacagtgcaccctgggtagcccaggggcatacggccagagttgaagacaaacttcagcttttattctttgtttattattattttgttgtagagacaagattttgccatgtcacccaggctggtcttgaactcctgagctcaagcaatcctcctgcctcggcctcccaaagtgctgggattacagacgtgagccaccgcgtgcagccttaagctcttattattaataggtatttattttagtctattggaaaaattacaactgatattttgtggaaggatatygtcacctaccctgtagctattttgcttcccattcttgctaactaaacccagttttgtttgggcagccacatcaccaacccagagggtgaacataattggtctaagccagaggtccacagacgtaccctgtaaagggccagacagtaagcagtttaggttttctgtgggccatggtcacacaagtctgccacagtagcatgacaccacctatagacaatacaaaaatgaataatagtggcagtgttacaataagattttatttacaaaaacatgtggcaggccagatttgacctatgggcc

SEQ ID NO: 183186 - DNA, 601 bp, Human
ggtacatcatgccgctgatgaaggtgcaggcgaaggccacccacgccaggatgtaggagtagccgtagctgccttctctggtcacgggatagaatttcgcgtttttgtcgtgaatgtcttcacgcctgtctgtataaatggaggccgcaatcatgacacacagacctgtcaggaagaaaggtgaattttcaataaatcatggaccacagtgcaccctgggtagcccaggggcatacggccagagttgaagacaaacttcagcttttattctttgtttattattattttgttgtagagacargattttgccatgtcacccaggctggtcttgaactcctgagctcaagcaatcctcctgcctcggcctcccaaagtgctgggattacagacgtgagccaccgcgtgcagccttaagctcttattattaataggtatttattttagtctattggaaaaattacaactgatattttgtggaaggatattgtcacctaccctgtagctattttgcttcccattcttgctaactaaacccagttttgtttgggcagccacatcaccaacccagagggtgaacataattggtctaagccagaggtcc

SEQ ID NO: 183187 - DNA, 601 bp, Human
cataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcrgaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattca

SEQ ID NO: 183188 - DNA, 601 bp, Human
tactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccsaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagt

SEQ ID NO: 183189 - DNA, 601 bp, Human
gctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcartgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaat

SEQ ID NO: 183190 - DNA, 601 bp, Human
ttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtcygcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgag

SEQ ID NO: 183191 - DNA, 601 bp, Human
gagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcct

SEQ ID NO: 183192 - DNA, 601 bp, Human
tgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctartacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttg

SEQ ID NO: 183193 - DNA, 601 bp, Human
acttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatrtaatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaa

SEQ ID NO: 183194 - DNA, 601 bp, Human
agactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaarcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagt

SEQ ID NO: 183195 - DNA, 601 bp, Human
agacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattcmctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgta

SEQ ID NO: 183196 - DNA, 601 bp, Human
gcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagygtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaa

SEQ ID NO: 183197 - DNA, 601 bp, Human
tacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaaataagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaac

SEQ ID NO: 183198 - DNA, 601 bp, Human
cgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcaraaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaact

SEQ ID NO: 183199 - DNA, 601 bp, Human
tttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgrgcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaac

SEQ ID NO: 183200 - DNA, 601 bp, Human
ttaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcrgcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatg

SEQ ID NO: 183201 - DNA, 601 bp, Human
caatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacrcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaag

SEQ ID NO: 183202 - DNA, 601 bp, Human
agagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatgkattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtggcactgagtatattcataatgttgtgcaaccattgccactgtacatttccagaactttttcctccttccaaaaagaaactctgtgtccatcaaacaataactccccatgaccctgctccctgcagcccctgg

SEQ ID NO: 183203 - DNA, 601 bp, Human
ccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgayttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatcttt

SEQ ID NO: 183204 - DNA, 601 bp, Human
cttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaaytcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgtttt

SEQ ID NO: 183205 - DNA, 601 bp, Human
aaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaatttttttttwaaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgttt

SEQ ID NO: 183206 - DNA, 601 bp, Human
atagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttytctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagccca

SEQ ID NO: 183207 - DNA, 601 bp, Human
agctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccwtttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattt

SEQ ID NO: 183208 - DNA, 601 bp, Human
gtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactataytcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcatt

SEQ ID NO: 183209 - DNA, 601 bp, Human
cttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaaygtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccat

SEQ ID NO: 183210 - DNA, 601 bp, Human
taatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccrcctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggctt

SEQ ID NO: 183211 - DNA, 601 bp, Human
atttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagacccyattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaa

SEQ ID NO: 183212 - DNA, 601 bp, Human
ttgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatctyggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcactt

SEQ ID NO: 183213 - DNA, 601 bp, Human
ctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggayggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcct

SEQ ID NO: 183214 - DNA, 601 bp, Human
cattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatat

SEQ ID NO: 183215 - DNA, 601 bp, Human
caattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatrctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttag

SEQ ID NO: 183216 - DNA, 601 bp, Human; identical to SEQ ID NO: 22176

SEQ ID NO: 183217 - DNA, 601 bp, Human; identical to SEQ ID NO: 22177

SEQ ID NO: 183218 - DNA, 601 bp, Human; identical to SEQ ID NO: 22178

SEQ ID NO: 183219 - DNA, 601 bp, Human; identical to SEQ ID NO: 22179

SEQ ID NO: 183220 - DNA, 601 bp, Human
agaccctccagcagcagaccttcaagatagacattgaccccgaggagacggtatgcgcgcgggccgggggcaggggcagccgcgtgcgggccgcggggagcgccaggagctcgtggggccgggcggcgcgctccagcgggggaagccccggagggcgcgatgagggccctgggtcctggtgccggccctggcggcgtacagcggagccgatcctcctgtcttggccgtgggctttgtggcaggagaatggggaagcagtggccggacgccgaaggcctggtggcagatggcgtggagcgcmcgcccgcgggcctgggcctaggagctcgtgctagcggggccggagggggatgggaaggtccaggccgtctcagccgtagagcctggctttctggtatgggtgcacaggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgagtggtggtgaaaatgaatttgcccctttcccctcagaattgtttacccttttatt

SEQ ID NO: 183221 - DNA, 601 bp, Human
tgaaaatgaatttgcccctttcccctcagaattgtttacccttttatttgcaaatgaatcgttctgctgccttcctcccgccaccaaacccacacccttgcgtagattgcactttgaggcctctttggtgatggttttagctgttagagctcttcacagccatccaggctcaaactaaacttcagatttaacgggttttctgtgttagaaatcttggaattgtaggagttggaacgctgcagccaccctcccccgatgccccaaacagtagcagttcaagggggaaaaaagaaaaaaaaamcaaaaaacaacaactttgaatcctttctgcagttaaagccttaaacatttcagaagtccacattatacatttttctgtatttgtgactgcataaagagacactgttgaggtcagtacaactttatgccaagaatctaaaaacgctgtgagtgtaaatttactgcttatgttcggaaatacaccgccaagattgtcataatactaagtttaaaccagcagctttctgcccaactctatttttaaaagtagttgattctattttgggtggagatcaggggctttggtgttaagtagacctga

SEQ ID NO: 183222 - DNA, 601 bp, Human
ccaaggaaaagtaatatgttatacgtctggaagtatatttttgaaaagcccattgttagggagcggtttctacagctttcgctgctatttatataaatataattttgttgctgttagtataaaaaaactaatactgttagtccggggcaagaaattaaagcatttcctctgggatatatggaacgtttgcatttaatgacttgtcagtttttattttaatgactttaggaaatatttttcatgacaactgtttcaattctatgtttgtagtgggttttaattagtatgtgtttttgatacracaccttagaattccagtaagaaaataaacaatgaaaattatgttttctagggcaacgctaagtgtcctgtttctaagttgttgtgagaacgaggtaaccaaggatattagaaatagatctaaaataagataggatcttattgagacctgtttttggtctggtcacagatttgtccttgtttaatttttacctagaaggaaccaaggaaattaagtaacttacgtagccagtatagcaactcttgtgagcttgagatgagcatgagcaaaaatggaagaaaggactgtgagataagtgga

SEQ ID NO: 183223 - DNA, 601 bp, Human
cactgaaatggtgacaagaaaaagtatgtgatatacaaattaatcctgcagtctaactcttgacactgtttgccttgaacaactaaaaacaaaactcagtaaatttgagatgagactttaaatgcaaaagctgaaatgtgattggattagtatataagtgacattaaaattctacatatacattggatgtttttgctaagagaattgcaaagacatcagttttaatatctataaatagcatattagtgtgctgtgaagaattacctaatttcgtggtttacctctataatgtgattgttayaaaatactgctttacccagcaccttgggaagccgaggcgggtggatcacctgaggtcaggagttccagaccagcctgaccaacatggtgaaacctggtctctactaaaaatagaaaattagctgggcatggtggtgcatgcctgtaatcccagccacttaggaggctgaggcaggagagtcgcttgaacctgggaggaggaggttgcagtgagctgagatcgcaccattgcactccagcctgggtaacaagagcgaaactccatctcaaaaaaaaaaaaaaaacaaaaaaactgtgtgtg

SEQ ID NO: 183224 - DNA, 601 bp, Human
tgtttgccttgaacaactaaaaacaaaactcagtaaatttgagatgagactttaaatgcaaaagctgaaatgtgattggattagtatataagtgacattaaaattctacatatacattggatgtttttgctaagagaattgcaaagacatcagttttaatatctataaatagcatattagtgtgctgtgaagaattacctaatttcgtggtttacctctataatgtgattgttataaaatactgctttacccagcaccttgggaagccgaggcgggtggatcacctgaggtcaggagttcsagaccagcctgaccaacatggtgaaacctggtctctactaaaaatagaaaattagctgggcatggtggtgcatgcctgtaatcccagccacttaggaggctgaggcaggagagtcgcttgaacctgggaggaggaggttgcagtgagctgagatcgcaccattgcactccagcctgggtaacaagagcgaaactccatctcaaaaaaaaaaaaaaaacaaaaaaactgtgtgtgtatattgctttagtacttgctctgtattatacagtatttactagccatcatttattagtgaagtat

SEQ ID NO: 183225 - DNA, 601 bp, Human
tattcctgtggtggtttattgtattttcaatatagtcatgctagatacaatttcatattatacaagcttcctagattaaggtaatgagtagtaaatgtattaaaaatactatatcacagaggtgaaattaagagttcttggcatattggcagaacaagatacaggaagaaactgagaaatctggtacatttttgccagacttttgctgttttgatgccgtgcacacagtaggcatttagtaaagatctttgaatgaactgaatatattcttttggtgaactggcaaagcagtgatcccccmacgtagtgtgtttgcatgttgatttatttatttaataaatatttgctgtgtacttactagatgtcaggccctgctgtgatggtatgtgcattctagtgggataaaactgtcaaaaaatacattttaaaaaccaggtaatggtaagtgctatgcagaaagttgaaataggataaagtatttgataatacttcactgggtggctacatttttgttgttgttttgttttgtttttgagacgcagtcttactctgtagcccaagctggagtgcagtggcgccatcttggctcactgcagccttc

SEQ ID NO: 183226 - DNA, 601 bp, Human
ccacaggatgctttcatatcatctagcctgcttattttcacttgatgaccctagtctttatttgattgagaatttggaaataatcgagacagaatgtctacaaggtcctaccgtagctacctacctgctagcctcttcttactgtagatagttctgaattgtgggcggtgctatctaaggcaggtccttccacttttccactgtacctcatcccctgtcatgtgtgaaggacatcactccatcagatcttttctcttcatcactgatttttcccatttctagggtatacaaacatttttcyccatcttaatgatacactcccttgtgtccacatccctctttagctgctgccctatttccctgcttctcaagaaaattcaggagtatctcttaattctgtttacttttttccacatcttgctcttttcacatccaccatactgttcctaaaagggagtcctcacaactttgtacttgtgctttgtccttaagcacaatacttttaaaaaagtctttctcctctttattaaaatgagagtaataataattgaactgctttcctaacagttgtgaaaatcaggtgagatcatgggcatggaaa

SEQ ID NO: 183227 - DNA, 601 bp, Human
gtcaggctgagcgccgtggcttacgcctgtaatcccagcactttgggaggctgaggtgggcggatcacgaggtcaggagttcgagaccctcctggccaatgtgatgaaaccccgtctctactaaaaatacaaaaaattagctaggtgtggtggcgtgcacctgtagtcccagctacttgggaggctgaggcaggagaatcgcttgaactcgtgaggtggaggttgcagtgagccaagatcgtgccactacactccagcctggtgacagagcgagactctgtcaaaaaaaaaaaaaaaaaaagcctggtcagtacttacacacattaacaatacttgttatttacaaataccatctcccatatgagtagccaggattcaaatttagagactctgcctctagagcctgtatgtttaacctttttatttcatctgccttagtgtccccattagaaaaagaggataatagtatctacctgtgtactagttaacctattactgcataacaaattaccccaaaacttaattagaacagtaaacacttactatttcataatttctgtgagtcagaaattcagggatattttagctgtgtggttcttac

SEQ ID NO: 183228 - DNA, 601 bp, Human
agcctggtcagtacttacacacattaacaatacttgttatttacaaataccatctcccatatgagtagccaggattcaaatttagagactctgcctctagagcctgtatgtttaacctttttatttcatctgccttagtgtccccattagaaaaagaggataatagtatctacctgtgtactagttaacctattactgcataacaaattaccccaaaacttaattagaacagtaaacacttactatttcataatttctgtgagtcagaaattcagggatattttagctgtgtggttcttaytcaagagtctcaggaagttggatttaaggacttcattctatgcattaaaggcttgactggctggagggttcccactgaaagtgacttcctcacatggctaacaacttggtgatggttattgactggaggcctcagatcctccccatatgtcctcatgacattgtggctggcttctcccagtgttagtgatccaagagagcaaaatagaaacgatggcttttatatataaaccagcctcagaagtcacacttttacttcagcagtatcttactgttcttgtggactagccataatttagta

SEQ ID NO: 183229 - DNA, 601 bp, Human
tatgattgtcttcctttggaggaaaaaagaaaaaccatgcccatcatgtttaatattatgttgagtacgtttttatttttaaatgcacgattttttaagagagaattaagtagctagaaaaaatgtttgatttcttgaatgttaaccatgtctttgtctctagtggaattgatgataaaccaccattatttatgtagtgggaaatgcagcacaatgaaagttctagccttggttatgtactgggactgtggtgctcaggtttatattcactctgttgagatggcttactggaatgggagcrttggtgtggggctcagcgcagttaaaggagtcataattgcatctgttggtgggccatatcctttccaagagaaaccttgtgctgagttcatacctcttcctttgaagcatccagaaagaaggcagtctttcttgctaatctgttttgaagtatgctcaattaggttggattagggatgatttaaacaaagtaatttagacacagttcttctacagatacattatggtttaaatacctctaggacatcccgtgaaggtgttcagtagagagttaagtgtgcataaatgaaggtcagggaga

SEQ ID NO: 183230 - DNA, 601 bp, Human
aacaatctttccagtgtgatagtctattggattaataacatgaggcatcaaaatttatgtctttggttactaatgaggttgagcttttctgtgctgtgactgtgtaattgtgaattgcctgcccaatcatttgtccaatttttttattagtgcaaaaacagttttgtgccttgtctctctctctttttttttttctttttcttgagacagtctcattctgtcacccaggctagagtgcagtggcatgatcttgactcactgcagcctcagcctcccgagtagctgggattacaggcgtgcrccaccatgcccagttaatttttgtatttttagtagagatggagttttgccatgttgaccaggctggccttgagctcctggcctcaaatgatccgcccacttcggccttccagggtgttgggattacaggcgtgagccatggcacccagctgccttttctctttttttaattgcttttttttttttttttgagatgcagtattgctctgtcgccaggctggagtgcagtggcacaatttcggctcactgcaacctccagctccctggttcatttggttcccctgcctcagcctcccgagta

SEQ ID NO: 183231 - DNA, 601 bp, Human
attgtgaattgcctgcccaatcatttgtccaatttttttattagtgcaaaaacagttttgtgccttgtctctctctctttttttttttctttttcttgagacagtctcattctgtcacccaggctagagtgcagtggcatgatcttgactcactgcagcctcagcctcccgagtagctgggattacaggcgtgcgccaccatgcccagttaatttttgtatttttagtagagatggagttttgccatgttgaccaggctggccttgagctcctggcctcaaatgatccgcccacttcggcyttccagggtgttgggattacaggcgtgagccatggcacccagctgccttttctctttttttaattgcttttttttttttttttgagatgcagtattgctctgtcgccaggctggagtgcagtggcacaatttcggctcactgcaacctccagctccctggttcatttggttcccctgcctcagcctcccgagtagctgggactacaagtgtgcaccaccatgcccggctaatttttttatttcagtagagacggggtttcaccatgttggccaggatgatcgtgatctcttaaccttgtg

SEQ ID NO: 183232 - DNA, 601 bp, Human
atcagttggttgacttggcaagtctcttagcatgtaggatagcagtcttcaaatgacttggtttcaagacttgtttacatttaaataagttattgagggctccaaaataacttttgtcgatatgcttacgttttattttatttatttattttttaaggcagattctcactctgtcacccaggctggagtgcagtggtatgatcttggcccactgcaacctccacttttcaaatgattcttgtacctcgtcctcccaagtagctgggattacaggcatttaccgccatgcttggctaattttttttttttttttttttttttttttgcatttttagtagagacagggttttaccatgttagccaggctgacctcgaactcctggcttcaggtgatcctcccactgcagcctcccaaagtgctgggattacaggcatcagccactgcgcctgacccaatgtacttacatttattaatgtttaccacattagaaattaaaacaaactttattaatgttcatttaaaaataaatataaacttattataataaatattatacttactttttttgcaaaaaataactatctgccaaaacaacagtaa

SEQ ID NO: 183233 - DNA, 601 bp, Human
gaggttttcagcctgggctgaactttggaaacacctgtaaaactttttaaaaatactgatgtcaaggtcccactctcagagattatgttttaattggtgtttgtaaagtccccctggtgattgtaatgaaacataacacttaaaatgaatcatttgccttttaacattcacaatttaacctttaacattgaagtattcttattgttgatgagactgttttatttcttagattttttaggtgatcaagctttactttcttgctccgtgggaaataaacccatgaacagtatataaaccaaawctttgatgttgaaaactttattttaaattatcagttcaactagtaaatttttaaaaatctgtgtgtatcagatggtgttaaagtttatggctatcataactagtaatatgagttaatgttgaatcttttttgatataaattggaaaaacataatatttgaggttttggaaacattaataattatgtatataatttttgtcttccattatttattcagattctggattgtcattttttatttagactttttccaaaacaaatctttatttttcctataggtgaaagcactgaaagagaaga

SEQ ID NO: 183234 - DNA, 601 bp, Human; identical to SEQ ID NO: 26149

SEQ ID NO: 183235 - DNA, 601 bp, Human; identical to SEQ ID NO: 26150

SEQ ID NO: 183236 - DNA, 601 bp, Human; identical to SEQ ID NO: 26151

SEQ ID NO: 183237 - DNA, 601 bp, Human; identical to SEQ ID NO: 26152

SEQ ID NO: 183238 - DNA, 601 bp, Human; identical to SEQ ID NO: 26153

SEQ ID NO: 183239 - DNA, 601 bp, Human; identical to SEQ ID NO: 26154

SEQ ID NO: 183240 - DNA, 601 bp, Human; identical to SEQ ID NO: 26155

SEQ ID NO: 183241 - DNA, 601 bp, Human; identical to SEQ ID NO: 26156

SEQ ID NO: 183242 - DNA, 601 bp, Human; identical to SEQ ID NO: 26157

SEQ ID NO: 183243 - DNA, 601 bp, Human; identical to SEQ ID NO: 26158

SEQ ID NO: 183244 - DNA, 601 bp, Human; identical to SEQ ID NO: 26159

SEQ ID NO: 183245 - DNA, 601 bp, Human; identical to SEQ ID NO: 26160

SEQ ID NO: 183246 - DNA, 601 bp, Human; identical to SEQ ID NO: 26161

SEQ ID NO: 183247 - DNA, 601 bp, Human; identical to SEQ ID NO: 26162

SEQ ID NO: 183248 - DNA, 601 bp, Human; identical to SEQ ID NO: 26163

SEQ ID NO: 183249 - DNA, 601 bp, Human; identical to SEQ ID NO: 26164

SEQ ID NO: 183250 - DNA, 601 bp, Human; identical to SEQ ID NO: 26165

SEQ ID NO: 183251 - DNA, 601 bp, Human; identical to SEQ ID NO: 26166

SEQ ID NO: 183252 - DNA, 601 bp, Human; identical to SEQ ID NO: 26167

SEQ ID NO: 183253 - DNA, 601 bp, Human; identical to SEQ ID NO: 26168

SEQ ID NO: 183254 - DNA, 601 bp, Human; identical to SEQ ID NO: 26169

SEQ ID NO: 183255 - DNA, 601 bp, Human; identical to SEQ ID NO: 26170

SEQ ID NO: 183256 - DNA, 601 bp, Human; identical to SEQ ID NO: 26171

SEQ ID NO: 183257 - DNA, 601 bp, Human; identical to SEQ ID NO: 26172

SEQ ID NO: 183258 - DNA, 601 bp, Human; identical to SEQ ID NO: 26173

SEQ ID NO: 183259 - DNA, 601 bp, Human
tttcccttcagtttagctaaaggttttaattttgttcattttgtggtggttgttgttaatgacaaaaataactttgggttttgttgattctccctattgtttttctagtcttttgttttgttttgttttaagtctctctaatgtttatttccctcttgcttgcttctagtttgttcttccttttttaggttaggtttagtttagttctttgtttagttttagtttaagattaaattattatctatctttgttagcatagatgtttatagctataatattccttctgcgtttatgctatagyagcatcccataagttttagtatgttgtatttttgctttctttcatctcaaaatgttttttaatttcccatttggtttctaatttaattcattcgttatttaggattgtgttaatttccacaagtttatgaatttcccacattttctcctttcgatttctaaattcattccattataatcagagaatatactttcaatacttttcaacttattgaggttcgttttgtggcctaacatggtatttctgaagaatgttctatgtatactgaagaagaatatagtgtagttcttattaagtggt

SEQ ID NO: 183260 - DNA, 601 bp, Human
acttcacctatcctagctttaatctggataaaacccagataacaaactgattttttagtttcttctgctttcatagatgaatagttattcgtgatgaattgggatttttgcccaaattttaagggttatttccaaatataatctgacacagcagtctttaacctttttggcaccagggaccagttacgtagaagacctttttttctaccaacataggtggggtgggcgcagtgattttgggatgaaactgttccacctccgatcatcaggcgttagttaggttaggaagtggggtggggcrgtggttttgggatgaaactgtttcatctcacatcatcaggcatttgttaggctatcatacggagcacagaccctagatccctctcatgcacagttcacagtagggttcatgctcatatgagaatctaatgccgccactgatacaacaggagacggagctcaggtggtaattcgagtgatggggagtggctgtaaatacagatgaagcttcacttgttcgcccactgctcacctcctcccgtgcggcccagttccttgctcacccactgctcacctgctcctgggcagcccagttcctaac

SEQ ID NO: 183261 - DNA, 601 bp, Human; identical to SEQ ID NO: 26174

SEQ ID NO: 183262 - DNA, 601 bp, Human
tggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatraccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaaca

SEQ ID NO: 183263 - DNA, 601 bp, Human; identical to SEQ ID NO: 183262

SEQ ID NO: 183264 - DNA, 601 bp, Human
tgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcattyataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctgg

SEQ ID NO: 183265 - DNA, 601 bp, Human
atttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccamagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgag

SEQ ID NO: 183266 - DNA, 601 bp, Human
agaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaaytaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactg

SEQ ID NO: 183267 - DNA, 601 bp, Human
tcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactyttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagag

SEQ ID NO: 183268 - DNA, 601 bp, Human
cttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaawcctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggc

SEQ ID NO: 183269 - DNA, 601 bp, Human
ggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagarttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaa

SEQ ID NO: 183270 - DNA, 601 bp, Human
aaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgwgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttccttt

SEQ ID NO: 183271 - DNA, 601 bp, Human
atagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgaga

SEQ ID NO: 183272 - DNA, 601 bp, Human
agaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggaga

SEQ ID NO: 183273 - DNA, 601 bp, Human
actgtgaagttttgaggaactctcaaaagcttgtgtacaactccttattattgctaaagaaaaccaaaggtaagaacaaaattatctctgcacaacaaataacaactttcttgcagtcccagaaagactcagcatatatcatggacaaaagtaaatatgttatgaaataatggctaattatgattctctgtgccacagatgtgcctacatcaagtctgtcccccatggcaacaagaaaaaaaaagggcggggaagggagggtgcagtgcaagaattctgagattaatcatggaaagtaaaytgctatctctgtaacaataacaatgtggaggtgtcgtttctttatttaatggacaaaagggagaaaataaatggcaaaaactataaagttgaattcaacccccccaaaattgagggatatagaagtagaaatgcaaaagaaggtagaataaagaaaaagagataaaataagaacgctcttccagggatcagcattttccatcatctcaagaaatattccttcaaaaatgtaaaggcaatttgcttgcaagaacagaaaaacattggtatcaggaatttggaacaaatgattaagtgcata

SEQ ID NO: 183274 - DNA, 601 bp, Human
ggaatctgggaaagagcagtccaagcagaagaaacagccagtgcaaaggctctaaagcaggggtgggtttgtcatgatgtgaagaaacggcaggaaaactgatatgactggagcacagtgagtggtaagtaaggagctagtaagggttagggagatgaggtcagaaagatagtcccctaggccatgtcacagagggcattaaattccatactaaggattttggacgttgaagaatccattggagaaatctgaacagaggagttgtcacattatctgacttactatgaacaggataactgtrgagcacaaagtggggaggcataaggatggaagcagggatgctaatgaggagactataacaataactcaggtgtgagagggtagatgtagaaggtagaagtggaagtgatgagagttggtttagttctggagtgcatatattctgaaagaaagccaaagatttgtggtgcattgatgtgtcatgtcagagacagagagaaggcaaggaaaactccaaggatgttgacctaagcaaatggaaggatggggttgccgcttattgagatggagaagactgtgaacatataatatttagggaagt

SEQ ID NO: 183275 - DNA, 601 bp, Human
agtgcctacgaacaaacttttctggaatactcaacttatatttacatgtaaacaactgaaacactaattatatatcatttcattaattcaagtcatctgaggacaagagttagcatagtttgagttaatctagaaaattcatgtaattatgtttccttaaaaatcctttataagactgacctacttcataattaatttttagttataagtggattttgtgtgtgttgtgtgcactggaaaagtttcaatgctgttctttagctatgacaaacacacatgaccatcaccatcgccaccacccccaccgccatcatcatttccattattaatctacatcatcataaagtatatttaaaatatattaaaattgattacataactcttagtggaaataaatgtatatttcaaatactcacaatgctccctagcaacaaatgtcagcaagtgataaggaatcaatagttggactataggagttcaatataaattaggctgaattacgtctctgcttcatatagagggatactcttatcaagaaaaacctccggtttttctatttatatttacctgcttttggacaagtcaacatttcctcatcaaa

SEQ ID NO: 183276 - DNA, 601 bp, Human
aatagtcataataacgagtaaacagcaggtttgaaacatggtatgcatagttattccaaatgtacatatatatctttatgtaatatatatgtattttatatatgtacacatatatgtgtatacatatattatgctatatcatatattaggttatatatgtatattatgtatttatacatatatataaaatacgtatatattacatgaagatatatatgtatatttggaatatatgtatacatatataatatacatatatattacataaaaatgtatatttggaatatatgtatatatatakagagagagagagaaagaaagacaaagacagagagagagagatatacacgaattccagctagccactacaaggatctataacagaacattaatattggttttctcttggttgggggactttgtagatacctttttgtattttccaatttttctgcaaagaacatatattacattggtaaacagaaaataaacatacacaaaataactgttcagaaagaaaagctcaattagaaacttaacattcttactgaacctgactataagagagttacaaagacatttcaataactactaaagagac

SEQ ID NO: 183277 - DNA, 601 bp, Human
ccatttatcttatataaatctgtccacttaacattctcctagatcatggcatgaaaagttcactcttctactgcaaaaatactcacaactgagtttgggcacatgttgggttttttatttccagtgaactctactctagaggtattcaggaaatgaccctagagcacctttactgaaattaggcttctgccttttcaggtacagacgcaggtaacacatataaggagatatataaattatttagtcagattcgtgtgtgtgtatgtgtgcactcacatgcatacatacatgagagagacasagcgaaacacagaaatacaaagcggagaaagacaacagagagtgaaaacacagaaagttaaaaaaatgggccatttgctttccccaattctataaacctgtggactttgagaaatatccaccaccctcacccgtgaatgtttaacggggaaggctggaaagtaagttgtctcccctttgctggagaagacatctctttactgtccaaactcccagctgtgctcagagctcagggtgaaatccgataggctgcccaaggtaagtaaagttcttctgtaaagttagtgtctatagaggagcc

SEQ ID NO: 183278 - DNA, 601 bp, Human
gtccgtgatccatgaccttcaccttccattcccaatgccactgctctactttgcgccttattacctcttcactggactgctgtcataacatcctaactggtttcttctcttcagctggcaggtttgctttcctaaagcaaagttcccttccttgggaaattttgatgatttcaccttgcctatagtaaaaacaacaaacaacttgatgtaacatttaaaaattctccacaattcagtcactaccatgccttccagcgtcatcttccagtgtcattcaccacagaaccatgtgtgcctttgygctttactgatgccattcatttcctttgcttagaatgtcattcctttgtttctctacctactggctttcctctaaccctccaaggcctagctcaaatatgactgtttccagaatcacatataatctctcccaatcagaactgattacacctgttatctgtgctcccataaactctatctacatctctagcatggccctgtgactcatacaactgtatgattagctccagatggtagggaacttgtcttattttttccccaatctaccttcccccaacaaaaatgacacgttagcacatgg

SEQ ID NO: 183279 - DNA, 601 bp, Human
ggatgaaagctctctgtctcctcctcctccctgtcctggggctgttggtgtctagcaagaccctgtgctccatggaagaagccatcaatgagaggatccaggaggtcgccggctccctaagtgaggaccccccacttgggcaagctccccaagggtctcagagacctcactgatccctggcacagacctgactccaacccagccccagcgctcaccaaatctcatcctcaaatccaaccagatcataaattcaaccccaactccactcccaacccctccgactgtccccaccttatccacrgctccaaacccaatccccgctctcactccaaaccttcccttactccaaaacacccaactcaagacagggtcctggaggccagtgagctcctatgcccacagggacctagctccaaaccaacagggctaggggaggatgggggagggaccgtttggtctcacagctccccctgtctcctttcctcctgccccccagtatttagggcaataagcagcattggcctggagtgccagagcgtcacctccaggggggacctggctacttgcccccgaggtgagtgcaggagactgttgtccaggc

SEQ ID NO: 183280 - DNA, 601 bp, Human
agccacaaactctattactgtcagagcagatttgggctgctaggtagaatcttattttcactgtttcaattctcatttctttgtaattttttgtattatactacatattttagccccaaattgtgggctgcaggaacaacgttgttaagtatttcttgctggctgtgttcactgaattgcttcctgagcctgaacttgctcaaacttcctgttttttgggcacagaactcctggtttctccatttatgatggatgagaggggtttggagtctctcttctagactttcatagcatgtttcargatttctcactgatatctaattgtcttataagagacattaaatttttttcacactcaaaaatccatgatcccctctaggtaaggtctgagtctctgtcaaacattttcgcttttgtgtaacatttagcacagtatttatcaggcattattttgtttgggggtagaggaggtaggcggcggtgggcagttgggaccccccgtacttatgttctgctccaatattaagtcttgtagaaaatggtctaaaatagatctttactatctgaaatatcatctagtgagagcattggcatcatcaaa

SEQ ID NO: 183281 - DNA, 601 bp, Human
taaatgaccagccttgagtatatggttaaatatataagttataagcctttgggttttgagagttttagataacacaagaaggtatttatgatattatattaaatcaagataaaagtcacaatgtaatataaagatatacaatcaatgatgtaaaagtacatagaagaaaactctaatgaaaatatgccaaattgttaactatgatgacttttaggttacggaattatgggaccatttttgtttccttatgcaattgaaaagtcataaatgagcatgcatcactttttcatcagaaaaatawatgagttacatatttttttaaagggaagatattgtaaaggaatatttgttgacagaatgcattaaaaaacctaggtaatttccttatttccctgggattctgagaatttttttactcttgggaatatctttccttgctcttagttattttcatatgttagtcttgttcctggggataaaaaatggtaagtttgctatttgagctctgctcgaacatatggagtagttctctcttacatatacagaattggtttgacattcaaggtctttcagagtcaaatcccaattgatcttcccaatt

SEQ ID NO: 183282 - DNA, 601 bp, Human
aaaagaacaaacacacacacacaaacaagaagctcgaggccaaacacatttaaaggatattatttggaagaaatgcactggtggtgagtgagggaccagcataagaagagctgtcctttaactagttaccatgttttatgcaatgttctcaatatgatatccaaatgattaggatggcttagattgcataaatgaggcaggagaatgacaaaggacacccccacaaccccaacaatgacactacccctctccctcaagggaagtgtctagggaaggccagtcagcatctggttaggcttgrccttaattgtcatcttcctcaattatctgcaggaaatattagctgttattaaaatttgcagatgcagtcaattgtcagagtcactggagaccaagaattattactcagagcattggagagaggctggaaagaaaaagaacaattcagcctggaaaaatgcaaactaatggataaagtgaggtagggggagtgggggaagaatttagagggataaggccagtagtagggtgaggcagtgaagcactcccctggagtacaaactttaaggggatgccaaaaactcagctatcaagataaata

SEQ ID NO: 183283 - DNA, 601 bp, Human
ggtctacagcctagccaagctgacagatcagaagagccatgacaacaatgataaaagaaactgttgccctctagtttcctcctgggcattaataatttagctaatataaacccaaatactttggatacgattgactgaattcagctttgctgatgcctctgatttcagttgctttaaccaaatgcaaacccctagtgcttctgttgtctgttgatacccagaggctcatgtgatctggaagggtaagtggcttctctctgatttgccagaagaaagtggttatgttagctgaggagccagracactaatttcagtgatttgactctggtacaagtggtgggaggcccgagggtgggatgctgctttttcctttggccctggtaaacattttatgcttgttatggtggttgaaatgctgtatttaaccttttcttcatgtgccaggaggttcacagtaaatgaggggtgtggtctgtgaagggaaaagtggctgtggcttggcctctttgtaccctgtcagcacacgtacacgcatggtctgtaacatgtgaacctatcacgtgggaactcattactgagctgtgagggctgcccctgagga

SEQ ID NO: 183284 - DNA, 601 bp, Human
tgttgcttcatgtcagatagaccctactgggtccagggcagggaagagctccattaattcacatagggccgatttctcttaatcgtaaaattttaaggtgacatcaatgcttaatgagtcatgggagaggaatgaactaatgttagggcaactctggctttttatttctcttgtgtcctattaaaagatgagaagatgaagcattttaggctcatggggtttgtatttttcatttgtgcatgggtagctgattatcatctgtcattatgtgcgtgtgtgtgtgtgtatgtgtgtgtgtgtaagagagagagagagagagagagagagagagagagagacagcaagagagagccagaatctgttttttaagaactctcaatgattcagatctccattttttcccttcacctacagcactttagttaaaacaaaacaaaacaaaacaaaacaaaaaaaccgacgagttccagcatttccccccatggaccatgctatgtccatttcagccgacacattttacatgtgtatctatttgcctccacttacaaatccaaggaaaaaaaggcagtgtggtagagtagaaagagccttagtaagggtc

SEQ ID NO: 183285 - DNA, 601 bp, Human
tggatgatttacagataatttaagcttgctgtgttcaaagctgggtttactttcctccaaatgtattgcttttctattcttcccaaactcaataaatggcaaaaccatccattcaagtactcaagctgagtcatccttgattattctttcgacatatgagccatcagcaaggcttgtttcaccctccagaacctatcttcaatctgtctgtttccctctccctcaattcaggctgcaatcccaatgcagagtgttcagtaaagcaaaaggggtggtctgctctcaccaaaagcaatttgcrtgctcttaattcacggatggattacctagcacttaacacagacccagatatatttggtactcagtaatatacactgaagaatgaatgagtgagttaatgaattaatgaatgaataacagaaactctacctcctaggacttaataatacacagcaggattaacctgctttcataagtaatcagtgaacctggtaaagtgtgacatttatcttttggtgaaagcagctcaccccttttgctttaccgtttcaccagcaatctctgttttatttttacctgttcttttggacacacaatttag

SEQ ID NO: 183286 - DNA, 601 bp, Human
gacatatgagccatcagcaaggcttgtttcaccctccagaacctatcttcaatctgtctgtttccctctccctcaattcaggctgcaatcccaatgcagagtgttcagtaaagcaaaaggggtggtctgctctcaccaaaagcaatttgcgtgctcttaattcacggatggattacctagcacttaacacagacccagatatatttggtactcagtaatatacactgaagaatgaatgagtgagttaatgaattaatgaatgaataacagaaactctacctcctaggacttaataatacasagcaggattaacctgctttcataagtaatcagtgaacctggtaaagtgtgacatttatcttttggtgaaagcagctcaccccttttgctttaccgtttcaccagcaatctctgttttatttttacctgttcttttggacacacaatttagtcagaaatttgcacctgagtcttacttctgccacctgctagtataaagatcaactggtgcagagcactatacagagattatttattgtttgctacaatgttggatatagagtttcctctctaggacctctttaactgggagggataaaaa

SEQ ID NO: 183287 - DNA, 601 bp, Human
tgcagagtgttcagtaaagcaaaaggggtggtctgctctcaccaaaagcaatttgcgtgctcttaattcacggatggattacctagcacttaacacagacccagatatatttggtactcagtaatatacactgaagaatgaatgagtgagttaatgaattaatgaatgaataacagaaactctacctcctaggacttaataatacacagcaggattaacctgctttcataagtaatcagtgaacctggtaaagtgtgacatttatcttttggtgaaagcagctcaccccttttgctttacygtttcaccagcaatctctgttttatttttacctgttcttttggacacacaatttagtcagaaatttgcacctgagtcttacttctgccacctgctagtataaagatcaactggtgcagagcactatacagagattatttattgtttgctacaatgttggatatagagtttcctctctaggacctctttaactgggagggataaaaatggcacaactaaattttcatgatttggataagaagagaaacattgggtgggcatggtggctcatgcctgtaatcccagcactttgaggggctga

SEQ ID NO: 183288 - DNA, 601 bp, Human
gtgcagagcactatacagagattatttattgtttgctacaatgttggatatagagtttcctctctaggacctctttaactgggagggataaaaatggcacaactaaattttcatgatttggataagaagagaaacattgggtgggcatggtggctcatgcctgtaatcccagcactttgaggggctgaggcgggtggatcacctgaggtcaggaatttgagaccagcctggccaacatagggaaaccctgtctctactaaaagtacaaaaaaaaactagccgggcatggtggtgggcacckgtaatttcaactactagggagcctgaggcaggagaatgcttggactcgggaggtggaggttgcagtgagtcaagatcacgctattgcattccagcctggccaacaagagtgaaactccatctcaaaaaaaaaaagtagaggagaaacattgcttcattcagaaagtgcttcctaagagattcccatggtccagggatgatgctggatggtggagatgtagaataatgtagagattacagggtagcggggatggggatgcacttgtaagccaatgagtagaagaaaggggttctggcggtg

SEQ ID NO: 183289 - DNA, 601 bp, Human
taaaaatggcacaactaaattttcatgatttggataagaagagaaacattgggtgggcatggtggctcatgcctgtaatcccagcactttgaggggctgaggcgggtggatcacctgaggtcaggaatttgagaccagcctggccaacatagggaaaccctgtctctactaaaagtacaaaaaaaaactagccgggcatggtggtgggcaccggtaatttcaactactagggagcctgaggcaggagaatgcttggactcgggaggtggaggttgcagtgagtcaagatcacgctattgcrttccagcctggccaacaagagtgaaactccatctcaaaaaaaaaaagtagaggagaaacattgcttcattcagaaagtgcttcctaagagattcccatggtccagggatgatgctggatggtggagatgtagaataatgtagagattacagggtagcggggatggggatgcacttgtaagccaatgagtagaagaaaggggttctggcggtggcacagcagcaaccacaggacgaaagcaactgcagaggacatgtgctcaattctgtgaggggacgatggcgggacatggaagggtcct

SEQ ID NO: 183290 - DNA, 601 bp, Human
tttggttggttgggttacacaatctacaattgtagattgattgagagtcttttgaaatatgtttttctttatgctagttacccaggtcctctcctctctggtgacagtggtaatttaccagggcattgtgtcctcttttcattaattaggccactcaggcctacccgaatcccaagagaccatttatggatgatgaaggtggtaagatagggttgtagtatgttggacctgctgtcacaaactaccatatgcagggtgacttataattaagagaaatttatttttcacaattctggaggcygggaaatcctagatcaaagtgccagcagatttggtgtctggttaggcctgcttgctggttcagagataactgtcttcttgctgtgttgtcacatggcagaagggggaagagaactctctggggtccttagtataagggtactagtcttatccacaagggctctgtcctcatgatctaatcaccccacaaaggcttcaactccaaatgccatgactttgggggtcagatttaaacataggaattttaaggggacacaaacattcagtttatagcagagagtgtatgttcacagcacaggaa

SEQ ID NO: 183291 - DNA, 601 bp, Human
caattgtagattgattgagagtcttttgaaatatgtttttctttatgctagttacccaggtcctctcctctctggtgacagtggtaatttaccagggcattgtgtcctcttttcattaattaggccactcaggcctacccgaatcccaagagaccatttatggatgatgaaggtggtaagatagggttgtagtatgttggacctgctgtcacaaactaccatatgcagggtgacttataattaagagaaatttatttttcacaattctggaggccgggaaatcctagatcaaagtgccagmagatttggtgtctggttaggcctgcttgctggttcagagataactgtcttcttgctgtgttgtcacatggcagaagggggaagagaactctctggggtccttagtataagggtactagtcttatccacaagggctctgtcctcatgatctaatcaccccacaaaggcttcaactccaaatgccatgactttgggggtcagatttaaacataggaattttaaggggacacaaacattcagtttatagcagagagtgtatgttcacagcacaggaaggttcacagctgaagcgagccattaa

SEQ ID NO: 183292 - DNA, 601 bp, Human
tagttacccaggtcctctcctctctggtgacagtggtaatttaccagggcattgtgtcctcttttcattaattaggccactcaggcctacccgaatcccaagagaccatttatggatgatgaaggtggtaagatagggttgtagtatgttggacctgctgtcacaaactaccatatgcagggtgacttataattaagagaaatttatttttcacaattctggaggccgggaaatcctagatcaaagtgccagcagatttggtgtctggttaggcctgcttgctggttcagagataactgtyttcttgctgtgttgtcacatggcagaagggggaagagaactctctggggtccttagtataagggtactagtcttatccacaagggctctgtcctcatgatctaatcaccccacaaaggcttcaactccaaatgccatgactttgggggtcagatttaaacataggaattttaaggggacacaaacattcagtttatagcagagagtgtatgttcacagcacaggaaggttcacagctgaagcgagccattaattgtgtatagactttcatgtctctgctctgattcattgtataatctgc

SEQ ID NO: 183293 - DNA, 601 bp, Human
atgattcaaaccaaccacccaaagaggattatatgtaaattcatattgtgtgggtcctgggagctttgaaaaccacatacacagagcacagaaacacacaaacacacccaccaacacacacacacacacacacacacacacacacacacacacacatacatgaatagcacccttagcaccattgctaccttatgtgattcctaccatgaaaatctgcactttaaaaagcaggaaaatttgaaatctacagatgtggataacactcaaacttgaattgggacacaagaacttttccctctcrggctagtgagatagtatggcctagtggctacaagggtgaattctggagataaattttctgggtttaaatcacaattttacctttcattaactgtgatttggggcatgttttttaactattgggtgccttggtttgctcttcagtatgattggaataattatatacaaaatatacaatatctatctcacagtattgctgtgaggatttgaagaaatcatttatactaagcttttatgcatgaaatatatttagaacagagtgaagcagaagtatctgtgttctttcatagaatgtatgaat

SEQ ID NO: 183294 - DNA, 601 bp, Human
cccaaagaggattatatgtaaattcatattgtgtgggtcctgggagctttgaaaaccacatacacagagcacagaaacacacaaacacacccaccaacacacacacacacacacacacacacacacacacacacacacatacatgaatagcacccttagcaccattgctaccttatgtgattcctaccatgaaaatctgcactttaaaaagcaggaaaatttgaaatctacagatgtggataacactcaaacttgaattgggacacaagaacttttccctctcaggctagtgagatagtayggcctagtggctacaagggtgaattctggagataaattttctgggtttaaatcacaattttacctttcattaactgtgatttggggcatgttttttaactattgggtgccttggtttgctcttcagtatgattggaataattatatacaaaatatacaatatctatctcacagtattgctgtgaggatttgaagaaatcatttatactaagcttttatgcatgaaatatatttagaacagagtgaagcagaagtatctgtgttctttcatagaatgtatgaatgaaatgggacagtgggt

SEQ ID NO: 183295 - DNA, 601 bp, Human
agattcataatccagtaagttgaggtacgcacaccaggcattctattcagcatcagacagtgctaggcaaagaataaccgaagaagagggactgtgttctattcactttgttttccccacagatctgtaagagtgcctggagctttttataggttctgaatagatatttatcattcttgcagtggcttgatcttggctcactgcaacctccgcctcttgggttcaagcgattctcctactttatcctctggagtagctgggattacaggtgcccggcaccatgcccagctaatttttgtatttttttttttaaattttattttaagttctgggatacatgtgcagaacgtgcaggtttgttgcataggcatgcatgtgccatagcggtttgctgcacttatcaacccaccatctaggttttaagccctgcatgcattaggtatttgtcctaatgctctccttccccttgccccccaccccgtgacaggccctggtgtgtgatatcccactccctgtgtccatgtgtcctcattgttcaactcccacttatgagtgagaatatgcggtgtttggttttgtgttcctgtgttagtttgctgag

SEQ ID NO: 183296 - DNA, 601 bp, Human
agagggactgtgttctattcactttgttttccccacagatctgtaagagtgcctggagctttttataggttctgaatagatatttatcattcttgcagtggcttgatcttggctcactgcaacctccgcctcttgggttcaagcgattctcctactttatcctctggagtagctgggattacaggtgcccggcaccatgcccagctaatttttgtatttttttttttaaattttattttaagttctgggatacatgtgcagaacgtgcaggtttgttgcataggcatgcatgtgccatagyggtttgctgcacttatcaacccaccatctaggttttaagccctgcatgcattaggtatttgtcctaatgctctccttccccttgccccccaccccgtgacaggccctggtgtgtgatatcccactccctgtgtccatgtgtcctcattgttcaactcccacttatgagtgagaatatgcggtgtttggttttgtgttcctgtgttagtttgctgagaatgatggcttccagcttcatccatgcccctgcaaaggatatgaactcattgttttttatggctgcgtagtattccatggtata

SEQ ID NO: 183297 - DNA, 601 bp, Human
taaattgccatgcagtctggtaaagacagaaatagaagtatgtagaaggtagaaaggtatcacaagggacactggttcaattctgcggtgggcatatccacatggtaggctgcaaacaaagacaggcaaggcctgtaggtgggtggagacagagaccttcagagcatcctcagtgccttcaggtcatggggaaatgccttggcctgccttaaggtcccgtgcagtctagcctcaccttacctggctgaacattctcccacatttactgacacaaaccttctgctctagtgagtccagcccmgtgttttcagtcttgagagcacatccctgccttggctgacacccacctcctcccaccaccgtttagaaagtgccttccctccacctccacttccctgctctactcatccttctttatgaatgcttcctacaacagctccaagccacagaaagcactgacagaaagggaaagattgatcacgtgaattccattaaagtgaagaatttatgtttatcaaaagtcactgttaagaaaggaaaaggcaaacaatggagtcagaggaactgtttggaacacttatgaccaatcgaggatttgtat

SEQ ID NO: 183298 - DNA, 601 bp, Human
tttgccctaggtcatatagcaggtcaaagctaatgctgaactatgaacacagttcctctgactgaaaatgtgcaaggctactaacgactaggtcctactggcttatgtattgaaaagtagatcaatgaactcattctggagctaaatgttgtctattactgtggattatccatgacataacccactcattatattccagtattggttaaaaggtaggagagaagtgatagtaaatttcatgggttcggcatatcttctgaccgacagaagacatggaaatgttttaaatgtttcttttcctttttttttttttttaaaaaaaaaacaaaaacaaataacactaaaagtttcaccaaacaagggttcataaaaggatcgtctctaaattgtgagtgtggtgagtgtgcatgctctgagcaaaaagagcctcccctttctgagggaattgtgaccctggaaaggaggagagcaggaacagctggccatctccccctgaaaggccagggcccccctctcaggcctctgggctccagctctggctgagggtgtgtttgtttggctgtgactctttcccttctgtttccctctcggtgtcatattt

SEQ ID NO: 183299 - DNA, 601 bp, Human
atagcaggtcaaagctaatgctgaactatgaacacagttcctctgactgaaaatgtgcaaggctactaacgactaggtcctactggcttatgtattgaaaagtagatcaatgaactcattctggagctaaatgttgtctattactgtggattatccatgacataacccactcattatattccagtattggttaaaaggtaggagagaagtgatagtaaatttcatgggttcggcatatcttctgaccgacagaagacatggaaatgttttaaatgtttcttttcctttttttttttttttaaaaaaaaaacaaaaacaaataacactaaaagtttcaccaaacaagggttcataaaaggatcgtctctaaattgtgagtgtggtgagtgtgcatgctctgagcaaaaagagcctcccctttctgagggaattgtgaccctggaaaggaggagagcaggaacagctggccatctccccctgaaaggccagggcccccctctcaggcctctgggctccagctctggctgagggtgtgtttgtttggctgtgactctttcccttctgtttccctctcggtgtcatatttcatgagctccaggct

SEQ ID NO: 183300 - DNA, 601 bp, Human
tgaattcagcttctcttaatctcacttttatctcctttctgtaagacttagtcattatttccgaatatgccatcaattttatccaagtgaaaattcagttttagttttaaaacacacagatataaaaataagatgcaaagttctacagtaaaattcttagacataaacactgagatttttggattcacaaataaatagtttagataacactcagaaagatcttttcctcctaattagcttctattgtcacctcttcctaagttgatatgtagctcaatttgttaggaaatggatttcccaygcatgccctaactataatcataagcatctgcaactctgttttcaaacaaagcatctgcaactctattttcaaacaaaggtagttactcatgagagagcttctttaaactgcaatggaccacacagaggtggatgtctagcacatttacagtgaccatgatcctatctctcaccatttcttcttttcaatattgcaggattctaaccatatgactttcccacccctcacctgatgtttggcgacaatatcctggcttctactggcaacaccatcttttgctatttgggtaaatgtgctcct

SEQ ID NO: 183301 - DNA, 601 bp, Human
agattcacacttgggggaatattttattctcaggcagctaagaccttgaaactccagcatagtatggagagtgctgagccttcagcatttttagcacatgatttcagccttggaaatctgatgtacttgcagacctctacacaagaggaggtatttgcatagaaacatgagcatgctggggctgggtcatccttttactacacatgttaaagcatacattgtaaccaaaattttggaagcaatgagaatctcttactctactattgggatttggggtcacagcaagactttggaagaggtrttactgagaagatgcctctatgaggtgttactcaaagtcattaattacttacagggctctacgagaatggcatagttcatgtcttaaaaccgcttatagctactggttgagacagaaaaggaaactatgtgctgtgtgattaaaccggtgttttcttttttgcattctgtcttctacatgtgttgtggtgaaatgaaactttaccacattcagcagtgctcaggagaaacattgagcagtgttggtatatatttcaatggcattcaaaaccctgataaataatttaggacttggggagat

SEQ ID NO: 183302 - DNA, 601 bp, Human
aggtgttactcaaagtcattaattacttacagggctctacgagaatggcatagttcatgtcttaaaaccgcttatagctactggttgagacagaaaaggaaactatgtgctgtgtgattaaaccggtgttttcttttttgcattctgtcttctacatgtgttgtggtgaaatgaaactttaccacattcagcagtgctcaggagaaacattgagcagtgttggtatatatttcaatggcattcaaaaccctgataaataatttaggacttggggagatctgggtatgggaagaagaactgaaaaaaaaaaaaaagcagcggtaatttactaatatatgtttgtaggttaaaacactttttatagctgaccgtagtagatagaatcattctttacaactattaagtggtattaaataggttgacccaactcccttggaaaagtgattaattttgtcttccagacctgacttctgaagctcaaagttggtttaaacagttcagctgtagtagaggatagcctgatatcctagttttgccacagtatctgggccagatggcatttgcagtaaatggaaggtaacaatgatcagctctggtattt

SEQ ID NO: 183303 - DNA, 601 bp, Human
ttttgggagaatcattgagagaaaaaggacctggctcctgtgcttttcgcatgctcacccactccggcccttctgattaatgtttgctgttctgctttgcagatgcctcccaggacccagagggagactgtagcctcatttctgtggagacctttggctggactctcctggctctcccagaggtgagagaccgtggttcctgtagcctcaggcttggcaccagctcatctctggtggatccaggattccagatatccaatctcactacagccagggcctctttgtcccagtgtgaccttgygggctgtccccctgactgcgtcttaacagcccctgccattggtgattttcattccagctacgagccaatggatccctgaaagcgactgtgtgggcttctctcaccatgtcgctctggcctcagcctggcggtgtgctcctctgtggtctggatggggatgatgaactcgggctgcccgttgtttttgttttgtgatatttaaagcagccgaagctctcattactgtaatacagtatgtgcctgggctaaagggggagcagcattccttctggatcagggggcaactctattctgttgtgg

SEQ ID NO: 183304 - DNA, 601 bp, Human
gggatcaggaaggagggtctattggcatcacacatgatctcttctgggttcaggaggggttcctatagctagatgagatagaattgattgatgtctcagtgatgcttcaggccatgttgattgggcctgcactaaaagtaagcagcccttcagagccatgtgctctcaagaggcagcacagccataaccgcaagagtaggatggtcctggtggaaatggcacaatcaaaacaagctcctgggccttgtggctttgagtggctgaactggaaggttcttgaggtatgagcactctcactcayggtattgatcaagcagcgtaatcacatcactgcccccacagaagtggctgccactcagttctcctcagcccaggctgatttctgctctgctggttcataggaaactgcttgggtctttcatgactgctgaagcccaaggcactttccccagaggcagcatcactcacaggatggaccaaatgaaatgtcctggtcaaaggcaggaagtttgtattgttgttcttgcctattttactatcatgtaaatacctgccaaccaacctacacatattctctgagtacttactgagtacttactat

SEQ ID NO: 183305 - DNA, 601 bp, Human
tcccagaggaaagttgagagttaggaaaacttcaacaaatcctcaggaatagaaacagaacatgagatgagaatgtttgggacagctctgctgtttgtttctgtgtatgtgtttgagggcccatctcttgccaaaaccaagctcatttctgcatatttgtttgcttaatatgaaatactccaaaactgctcttcatatttgtttaatctgaaatgaaaatgactcagcagagaggaaaaacaagatttaaatgccctgaatggcccctgaattaaaatacatagccctaaatcatgggggygttcttctccccaccaaatcttaatcttcaacacacacaaatgcaagtgccacacacagtcatgcacacacacacacacacacacacacaaacattgtatttgcctgccccaacttgacctcagtccctttatctcttttccccttcatactccagcctttccagggtcctacctttcctgcaggggaggtgcatttgagcttaggtggagaggcctggcctgggctacaggccacagatgattttcctggagggccagcacttcctctccagtccagatcacaggctcagtgtcaagat

SEQ ID NO: 183306 - DNA, 601 bp, Human
atacttctaggtgctttacagtgctctgtttgttagctgacagtcatctaattttaggcaaaacagaaaaataattattgcttttggagattcgcagcttgaagcccggcaacagtttcaaaaagtaaattagtcaacattttttgaacacttagtaggtttggcttagttcagttaaaaaccatttttgagcacatactttgtgcacgatgtaaagtaatactttggcaatataagaatgaaccattttgaagttaatgattaaatggataattttataacaatgttgtgaaggatccartagagttaaattaagcatgtgttttggtgaaggaaagaaaggaaatgaggtgtgggagacattctttgcagaaggaattattggggaaggttatggaggggaggaagttacggccagtaacccatgagagaggtgccacaggagagagagagaattctaggactgtcctgcaaaagactgctaggagagggcggtgagccaagtcagtcctgggcctcagcacttactggatggctgcttacaaagagctcgggtctctctggaaggacatcctggattatggtcatgagttagtgctca

SEQ ID NO: 183307 - DNA, 601 bp, Human
aaatagacttcttgctttgcaaagacctttataggaaaacaggacatgttgaaggactaatccttctctctgccatttctttctattttaccaagtcaaaccagagatgagtgtttgaggcagatgagacattttcattcattatcagtgataaagagtctatcatgaatcctgaggctcatagaatgttatagcttgcacactgctgagcataaagtcagcatatgataaatgcatgttgatttaaggatgactcttcaggagtccttactggtgtcaactgaaagactgactataactraaagtattgaaaggtaactgaaggcactgaaagactgagtgaattcttggccagttaggtttttcccacagaatggccacatgatataacaaatagaacttaagccaggagacctgagttataagcaaatccaatatgcaaccaattattaaattactgaaacattttagttggttattagctataacatattggttggttaatagtaactgagctaagcattaaactcaataaaataaaaataaaataataattagttgaagctcattgttgaagatcttacaatgactattggtcaat

SEQ ID NO: 183308 - DNA, 601 bp, Human
aaaggtaactgaaggcactgaaagactgagtgaattcttggccagttaggtttttcccacagaatggccacatgatataacaaatagaacttaagccaggagacctgagttataagcaaatccaatatgcaaccaattattaaattactgaaacattttagttggttattagctataacatattggttggttaatagtaactgagctaagcattaaactcaataaaataaaaataaaataataattagttgaagctcattgttgaagatcttacaatgactattggtcaataagccttcaktattagcatgatttagttgataacaaacattaaacatgatatgatatgaaatatcaatcttggtgtctcagcagataccaagagaggataaataatcttgtttacatttaaaaaaactctctagtatttgaaatcataaatgtctcacaggtgtcatccatggaggctgcagagtagtggtggtatgacagagatagttggctgaagcacgaaggcagcagagtttttggctcactgttctaaagtatctgagttttggcaaagcaggcagtcaggcagatggtgttagtggcatttcca

SEQ ID NO: 183309 - DNA, 601 bp, Human
actgaaagactgagtgaattcttggccagttaggtttttcccacagaatggccacatgatataacaaatagaacttaagccaggagacctgagttataagcaaatccaatatgcaaccaattattaaattactgaaacattttagttggttattagctataacatattggttggttaatagtaactgagctaagcattaaactcaataaaataaaaataaaataataattagttgaagctcattgttgaagatcttacaatgactattggtcaataagccttcagtattagcatgatttakttgataacaaacattaaacatgatatgatatgaaatatcaatcttggtgtctcagcagataccaagagaggataaataatcttgtttacatttaaaaaaactctctagtatttgaaatcataaatgtctcacaggtgtcatccatggaggctgcagagtagtggtggtatgacagagatagttggctgaagcacgaaggcagcagagtttttggctcactgttctaaagtatctgagttttggcaaagcaggcagtcaggcagatggtgttagtggcatttccagtaatggcagtgttaa

SEQ ID NO: 183310 - DNA, 601 bp, Human
aatcatttatacaaatcaacagatgattggaatgttattagttctgatgaatgatttggagttaacttagaaaaaagtatttagcttaacttttgagtaacaaccctaattataatcctgacttggtcataaattaattgtgtgacagtgagggagttgttacgtgtctctttatacttccttaatattttcacttgtagtaagattaagttggattagataatctatgggaccctttctgctacaaaattactgtgatttttatgatgtgagaactttatagcccatactggaagatttsggcttggaagtatagcccctgaagttgcatggctgttttttgcaagaaagactacttgtttccaactccctaccacttcccaggctcagggatgtgaagtctgaatttcaggagaatcttgcctttggggctaagcacacaggaagtgactgataaatacttaaaaattttaaaccctaaaactctgcttagtggcaggtgaatgcagaaaccctgccccagcctaacctgcaggagagtcatagtgctacaagctaccctgctccagagcatcttttgctctagaggtggggccaagag

SEQ ID NO: 183311 - DNA, 601 bp, Human
acatctcttcttctcagcaggcaaaccaggcctttaggatccatggtataaagctgaggcagggcagtgctggaacttcccattttcatgtcacactttcccctcataggaagcaggcaacttactaccagttcagagtcctggggtgggagtccccctttggtatccagaatgcttccactttgaaaaagagtggcaaagccattcagggtttgggattaggagaggacgagcttttctcctcctggccccaaatttattttaggttcaccactgtggtttttgttctttccagcatcartcccacatgtcagtgagttcttagggtcaggcaactagaattctagactgttcatgttggaatggaccttagaaatatctaagtcactcttcctcactttacagatgaggaaactgggagtcaaagcaggtgagtgatttgcccatgctccacatttagctaatagttaagctaggacgaggacccagggctacctgtctcccaatcccaggtgacttctacctgggccctcagggagcaatgtgctgaagtgacctttatctaaaaatcacatatatccatgcagcctcatgctttcct

SEQ ID NO: 183312 - DNA, 601 bp, Human
atctaaaaatcacatatatccatgcagcctcatgctttcctttctgcaaccaacttccaatgtatatttatggggatgagatgtaattgagatttgagggacagcctgaggccaaagaatggagtcagacgaataggatatacagtgctcacacctagtctcatgctaaatgaggaaggctggagctagaagccctgcgggccaacttacccccacccagaaactgaagcaccagggatgctttggttcccttctgcaccaggttgtgcctttatcaccgctcccttgtcttccaccaagrctgctatgtgttaattcacctacacatatttccaaattggaaactcatttttgtttccctggcttctcgtcattcgtgttcccagagatgtgctgagaaggtttatgtggcctcatctgttaacgagaaggtgatgctagtttcaggtttgtgaaaccaggcctgaggtactagtgttgtgatgtgtgtgtatgtgtgtgtgtaggtgggtggcgcgggggtgtagtgtgtgttagatagcctgaacaggccttgagaaaaagataaaaggccggcaaaagacctctctggttgaattta

SEQ ID NO: 183313 - DNA, 601 bp, Human
tgctttggttcccttctgcaccaggttgtgcctttatcaccgctcccttgtcttccaccaaggctgctatgtgttaattcacctacacatatttccaaattggaaactcatttttgtttccctggcttctcgtcattcgtgttcccagagatgtgctgagaaggtttatgtggcctcatctgttaacgagaaggtgatgctagtttcaggtttgtgaaaccaggcctgaggtactagtgttgtgatgtgtgtgtatgtgtgtgtgtaggtgggtggcgcgggggtgtagtgtgtgttagayagcctgaacaggccttgagaaaaagataaaaggccggcaaaagacctctctggttgaatttatcttaagtgagcaatgctagaagctgcccagattggctctttcttgcttgtgtgtttgttttttaagtctaggctgacgcctgagagtggcctttggcatccttcctgccagtaaaagagcctttctctgggtaaaacagaaactcatctgccccttgagccctcttggttgtgccaaatagggaaaaagagaatgcaaaactcaaagaatattcaatgaacacttaatatattctgg

SEQ ID NO: 183314 - DNA, 601 bp, Human
gactccaaactttactgagtgagtcaaagtaaaaataattaaaaataaataatacctaactttattgaatattagtgctctaagtgcttgacataattaactcatatattccttatggcattcctataaacaagtgcaattactaccatgaaattgagaggctgaaagcttaagtaacctttctaaggtcataaaaccttttaattgtttaaggaagagtgaatgtactattttaaacaaatagttctctcttctcctcttagatatcatttattgagccccattacattctataaagtaygctaacttctttgtatacattatgttaaccttggcttggcaggattatgaaagatgaagaaaccgaagttcatagaggtttggtaactggtagtggggtcccataattcagaagtggcagagccaagtcttaatataaactttccatgattccaaaccgtggcctcagttttcttcttcactcctgatctgcatagctacccagtttcctcttcagcttaccttcttgttggggaaaggagatactatttactatgaaagtttcactgtctttgttaaccaggaagaagaattcattatc

SEQ ID NO: 183315 - DNA, 601 bp, Human
tgagccccattacattctataaagtatgctaacttctttgtatacattatgttaaccttggcttggcaggattatgaaagatgaagaaaccgaagttcatagaggtttggtaactggtagtggggtcccataattcagaagtggcagagccaagtcttaatataaactttccatgattccaaaccgtggcctcagttttcttcttcactcctgatctgcatagctacccagtttcctcttcagcttaccttcttgttggggaaaggagatactatttactatgaaagtttcactgtctttkttaaccaggaagaagaattcattatctgatccctatgttagtatcctgaaacccactacagcttggggactgctctcctggggctctgcaagaattgtttctggaaagtattttgggcttccaggaaaactgcaatcctaaaggtctattcctaaggggaatttcaacttgtgcaagaggtctgggtgaccattatacccaaagaatagccctgtaggctgaagaaagaaacccaaataatctttcttggcccccctgtggaatcccattgtgtcaatatttatctgcacaaaggaccag

SEQ ID NO: 183316 - DNA, 601 bp, Human
tttttttttattacagttttattttttatttattttttttggaataattttttttttattatactttaagttttagggtacatgtgcacattgtgcaggttagttacatatgtatacatgtgccatgctggtgcgctgcacccactaacgtgtcatctagcattaggtatctctcccaatgctatccctcccccctcccccgaccccaccacagtccccagagtgtgatattccccttcctgtgtccatgtgatctcattgttcaattcccacctatgagtgagaatatgcggtgtttggktttttgttcttgcaatagtttactgagaatgatgttttccaatttcatccatgtccctacaaaggacatgaactcatcattttttatggctgcatagtattccatggtgtatatgtgccacattttcttaatccagtctaacattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctag

SEQ ID NO: 183317 - DNA, 601 bp, Human
tgttttgcaatatttgctgttttgcaatatttgctgttctgcagcctgcactggtgatacccaggcaaacagggtctggagtggacctccagcaaactccaacagacctgcagatgagggtcctgactgttagaaggaaaactaacaaagagaaaggaatagcatcaacatcaacaaaaaggacatccacaccaaagccccatctgtaggtcaccatcatcaaagactaaaggtagataaaaccacaaagatggggagaaaccagagcagaaaagctgaaaattctaaaaatcagagcacytcttctcctccaaaggaacacagctcctcaagagcaatggaacaaagatggacggagaatgactttgacaagatgacagaagtaggcttaaaaatatcagtaataacaaacttctccaaggaagtttggaggatgttcaaacccatcgcaaagaagctaaaaaccttgaaaaaagattagacgaatggctaactagaataaacagtgtagagaagaccttaaatgacctggtggagctgaaaaccatggcacgagaactacgtgatgcatgcacaagcttcagtagccaatttgatcaag

SEQ ID NO: 183318 - DNA, 601 bp, Human
tgcactggtgatacccaggcaaacagggtctggagtggacctccagcaaactccaacagacctgcagatgagggtcctgactgttagaaggaaaactaacaaagagaaaggaatagcatcaacatcaacaaaaaggacatccacaccaaagccccatctgtaggtcaccatcatcaaagactaaaggtagataaaaccacaaagatggggagaaaccagagcagaaaagctgaaaattctaaaaatcagagcacctcttctcctccaaaggaacacagctcctcaagagcaatggaacaargatggacggagaatgactttgacaagatgacagaagtaggcttaaaaatatcagtaataacaaacttctccaaggaagtttggaggatgttcaaacccatcgcaaagaagctaaaaaccttgaaaaaagattagacgaatggctaactagaataaacagtgtagagaagaccttaaatgacctggtggagctgaaaaccatggcacgagaactacgtgatgcatgcacaagcttcagtagccaatttgatcaagtggaagttcaagtgaatgaaatgaagcgagaagagaagtttagaga

SEQ ID NO: 183319 - DNA, 601 bp, Human
agactaaaggtagataaaaccacaaagatggggagaaaccagagcagaaaagctgaaaattctaaaaatcagagcacctcttctcctccaaaggaacacagctcctcaagagcaatggaacaaagatggacggagaatgactttgacaagatgacagaagtaggcttaaaaatatcagtaataacaaacttctccaaggaagtttggaggatgttcaaacccatcgcaaagaagctaaaaaccttgaaaaaagattagacgaatggctaactagaataaacagtgtagagaagaccttaartgacctggtggagctgaaaaccatggcacgagaactacgtgatgcatgcacaagcttcagtagccaatttgatcaagtggaagttcaagtgaatgaaatgaagcgagaagagaagtttagagaaaaaagagtaaaaaaaaaatgaacaaagcctccaagaaatatgagactgtgtgaaaagatcaaatctacatctgactggtgtacctgaaagtgacggggagaatggaaccaagttggaaaacactcttcagggtattatccaggagaacttccccaacctagcaaggcaggccaaca

SEQ ID NO: 183320 - DNA, 601 bp, Human
ctacaacttaaagtataataaaaaaaaaagagaaaagaaaaaaaaaacttttgttgcttatccgaaatttaaatttaactaggtatactctattttatctggcaatcaggtgtcctgagactctagcttcctttacttctctggactcccatttttgtctcctcaactcaggaaattctccaggctctgcctgagttcccactcattgtgttgtatcctggacacactctcatgccagtaagctgatgccaccgtaggggtcaacttttttgtttcctgactctcagattgttgtccttcrttgtcagatgctcattatcttaaaacataatttttcatatattttgtcctttttggttgtttcacactggagagcaaatctggtctctgttactccgtctttggttgaaagtggaagtctgtatccagaagttattgtttatagccaggagccagaacatggttctaaccagggccaaaaatgtgtgtttgatcccttcataggtgagtgtgtagtttctttatagtttttatgcaattaactactgaaaaaaataattctttgggtcataaaggcgcctggtgattatgagggttcctc

SEQ ID NO: 183321 - DNA, 601 bp, Human
agctgcttgcctgtgaaccagtaaacagctctgtggtttcatggttgctccctctctccccaaccctcacctctcaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcaygggaaacaggtaggaagaagagacatccagatcctggatgtccaagaccatattttgacttaggctaggagaagaagggtacaggttttctgtgtggatatgtgtgtccacagaccaggcatgcccttgtaaatgtgtgacccagggtgagggaggcagggaaggaatatcaaggctgtggggaaagcagagtagatgcattctgctcctcgaattaagaagagagagtccatcaaaaacgtggtggggtgaagaaaagtgagcatgatttaataccacctcttcactcattctcttctc

SEQ ID NO: 183322 - DNA, 601 bp, Human
gcataatttcgctcagtcacaccccaacaggcatgtattcaaggcacagaggaaatcagagatcaaccgaattcagtttaatttaataagcctttgttaatcaactgttactatatacaaggaatttggccaggcatgttaggtattcaaaggtaatggagtcattgatcctacctttaaagtgctcacaatttggagtaggggctaaaacagaatataagttactatgattcaagtatatgagcaagagatagcctatgactgctctggggttcaaaggaaaaagtaaactatagtaggraagcacaaaaatggggatgaaaacatctggatttcatataataaaagttacttctgtttgctacaaggcttaagggattaaaatgtgtgtgaaaagcatttcgtaagataaattgctatgcacatataagttgttatctgattatcatttttctgaatgaaggaccagtaaagatatggtagaacagatgaaatctgaactgggtcccaaagaatgggtagtactttcacaggtgcagaatcttgaaatggaattttaggcagagggaataatagcatgaggaaaaaagaatcatggtta

SEQ ID NO: 183323 - DNA, 601 bp, Human
tgtttttaaatgagagtacagtgtgttaaaaattttatataatttaaggtagttaacgagtgcgctgttaaggaaaagcacacctaagcattactgagatatttaaatgaaaatttctaaatatacacaaaagtaaagagaacaataaaccactcatcactcagctttactaatcattgatattttgccatatttgtttcacccattccttccttttggctgtagcattttaaagcaaatatgagatactacttgatttcattagcaaataattggactgcatctaagaaaatagcatcattttcataggtataatgccatgataacatctaacaacctttattattaaataatttcttaataccacccaatatcctgtccatattcaagtatgactaactgtccatcaatgtcttaattcagttgactttatcaaataaggatcaaaataaggatctgttggtgagtttctttattctatttgctctgtgtctcttttaatctaaaaaattccttccatttttatttctttttaaatggattctggcttggctgatggctttctgtggtgtcattttacttgagcttctgttctctgtca

SEQ ID NO: 183324 - DNA, 601 bp, Human
cgccatgttggccaggctggtctcgaactcctgacctcaagtgatccgcctgccttggcctcccaaagtgctgggattacaggcatgagccaccgtgtctggccattattctttttaatactcaagttgtgctgtctttgactagagtttgcatttttttttttttgagacggtatcttgctctgttgcccaggctggagtactatcttgagtcattgcaacctccacctcccaggttcaagtgattctcctgcctcagcttcccaaatagctgggattacaggtgcctgctaccacgccyggcttttttttttttttttttttttttttgcatttttagtaaagacggggtttcaccatgctggccaggctggtctcgaactcccaacctcaggcgatccagccacctaggcctcccaaagtgctgggattacagatgtgagccactgcacccagcctagagtttgcatttttaagggggctctttgctcttttgatctgaccctagaagcctttgataactttcttgttttccgaaagaacaaggtatttcaagctcattttgaacatgtacagcatccgacgtggaatcaaccatttc

SEQ ID NO: 183325 - DNA, 601 bp, Human
taatattagttttcaccggagcctgacagccgaactccgaaagcacatgcagaggccagatacctccttatttatataataatattaagaagaagaaaaattaggatacctggaagaaatgtctcttagaaaggaaatacatattctaattcttgacccccttgattagacaaatcagagggaaaaactctggcaaagctgccaacatcaatctggcaaatacgcttttgtggtttagtctcaaaagctgtaaaatcacagaaaaagacactccaatgtcagtaaatatctataaagattragccttaattcataaattgaagggctaggccgatgaggcatagtggagactcttttataaacaatctaatatccttgaaggaaaaagcatcttaacactatgtctgtcccttgcccatttacccgctatattctgtctatattttcgctgaatttgggtcctgcttcttatgctttatgacaatgtgtggtacagccctttgaatcactgtttcttaaacttttttgtaccatagcatctagtatgtaatatgtgaaacaaaaattttacaaaggaaaacttgcttttactatttagata

SEQ ID NO: 183326 - DNA, 601 bp, Human
ctaagtctattttctcatttttagagtggacatgttggaaccttcctaacgttcctcggaaatgcagaaaactcttcttaatacattgaatctccattcaggcattttccttgaagattctgattcactggattttgggtagagtccaggcatccatatttaaaaaaaaatttaacaagtgcttctgatgcacattcgaggttaagaattactctcctaatgccaagctgaaatttctgataatgctgttgaagttccttctcatctttttcactttgcttgtctgtttggtgtgtgtgtktgtgtgtgtgtgtgtagaaaaacatccagcttcattaatattcaagccaagtttctcactattctatttctacttttgtgtacttgaaggttgtgattatgtatccctctgagtccctcttcagactctgtctatgccaaatgatctgaataactttttacattgtctaacactttacaggaagcagaatttttcctcatgcataattttatatacacctcattgagtaataactcataggcattgttatgtttaactatttttctgatgagaaaatgtgatgtgcttaaggtcatacaa

SEQ ID NO: 183327 - DNA, 601 bp, Human
tggtgtagccatttaaataactaaaataaataactacttgagttatctattttttgttaatttctctttggtaaacatttattagagtaatatgagattttattatgagagtaaaacatttctcaccttttctcaataaaagcattgaaataaaacaataaaacaggtaaaacagtaagtagtgtcagttgattcaaatttcgatgtctttcaaaaaatgatgcagagtcatatcagaagggaagctggagtcacctctttagctcagagcaacttttctataagatcatcaacctgaggracccgagtcagtagaaaagaacttgtagtgttcaggagagaggagctaggcctgagctggatgtagaagcagacaggactaaattcaagagcataggattttataggaaggagcctgaaggggtcttttcaaaggataaaaggaaacttgcatctattttattattcaatggatagaagacatgaaagagcatgctaaattcaagtaatttcacagagacagcaagaataaaggatataaactaatttatttcttggggtgaatggaagtaatttacctatttcctaagtctaaaacatc

SEQ ID NO: 183328 - DNA, 601 bp, Human
accttcaacctttaatattcccaccctgatataccatgagccttcctatagcttcaccacacaattccacaagtttagccacagaatttgttaatgatcatgtattatgaggaaaagaatgagaaataaaatgatgttctacattctgtaggccacaagaaaatctctagaggaagcaaaaccattttccaagtaagaatgtcatgaagcaggttaggctttcacaggggcatgttttagccctcctctcagagttccttcctgaagagatctccaaagacactccacggaatgagggctygttgcccttgtcttcccaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggtgagttgattctttgattcccttatagctcgaagaaggtggttggataaaaatgat

SEQ ID NO: 183329 - DNA, 601 bp, Human
aacaatatattagactgacattcagaggaccttggttcaaatccagtttttccactactaatggtcttattaaccagaagaatttgggaaacctctcctgtttcatttttctgatctaaaaaataaggataactggcatggtggtatgtacctgtagtcccagctactcaggaggctgaggcaggaggatgaaaatctgggctgcgctgcgctatgacaattgggtgtcctcactaagtctggcattaatatggtcacccctaggagcagtggaccaccaggttgcctaaagagggatgarccagcccaggtcagaaacagaggaggtcaaaactcccgtgttgatcagtaatgagatcaaacgtgtgactggccattgcactccaggctgggcaacataatgagaccccatttctcaaaggaaaaaatatttaataataaataatatcatccacttcacagtgtggttgtctgtattgagtagaaaatgtgagtagtcaatgcatgctatttacacctgaatctcattgctgtcacttgttaaagtctatctttcaacactgtgattatcactgaactggtaaatgagagtcctggattc

SEQ ID NO: 183330 - DNA, 601 bp, Human; identical to SEQ ID NO: 34885

SEQ ID NO: 183331 - DNA, 601 bp, Human; identical to SEQ ID NO: 34886

SEQ ID NO: 183332 - DNA, 601 bp, Human; identical to SEQ ID NO: 34887

SEQ ID NO: 183333 - DNA, 601 bp, Human; identical to SEQ ID NO: 34888

SEQ ID NO: 183334 - DNA, 601 bp, Human; identical to SEQ ID NO: 34889

SEQ ID NO: 183335 - DNA, 601 bp, Human; identical to SEQ ID NO: 34890

SEQ ID NO: 183336 - DNA, 601 bp, Human; identical to SEQ ID NO: 34891

SEQ ID NO: 183337 - DNA, 601 bp, Human; identical to SEQ ID NO: 34892

SEQ ID NO: 183338 - DNA, 601 bp, Human; identical to SEQ ID NO: 34893

SEQ ID NO: 183339 - DNA, 601 bp, Human; identical to SEQ ID NO: 34894

SEQ ID NO: 183340 - DNA, 601 bp, Human; identical to SEQ ID NO: 34895

SEQ ID NO: 183341 - DNA, 601 bp, Human; identical to SEQ ID NO: 34896

SEQ ID NO: 183342 - DNA, 601 bp, Human; identical to SEQ ID NO: 33115

SEQ ID NO: 183343 - DNA, 601 bp, Human; identical to SEQ ID NO: 33116

SEQ ID NO: 183344 - DNA, 601 bp, Human; identical to SEQ ID NO: 33117

SEQ ID NO: 183345 - DNA, 601 bp, Human; identical to SEQ ID NO: 33118

SEQ ID NO: 183346 - DNA, 601 bp, Human; identical to SEQ ID NO: 33119

SEQ ID NO: 183347 - DNA, 601 bp, Human; identical to SEQ ID NO: 33120

SEQ ID NO: 183348 - DNA, 601 bp, Human
ttagatgttttagaaattaggggggcctgatattaactttcagtagttaaaaccaggaaaaaagagtgagtgtgtgtgtgtgtcggtcacacacacgtttttgtctttgtgtattcccatttggtaacaggatggccggtaattgctactttgtaacaatgacgggtgggggggtgaacattttataaattttgaaatcgtgctataaaatccagaaaagatacatttagaatggctgcttctctcctgtttttaatatatcctgaaaatttacccgttttagcactccccttttttttaygttaacgagttgggacagaattatttctgtaacaaattacatggttctgtgtcttaaacaagagttcattgtacattgtttgactatttctttatgattcagaattattgatgctctgagatcctatagggtcttgtagtaggattctgcgcatttgaattgttggtttcctttttaaggcttttctaggcagtcagttgtcaggagtgctcctgctgtcaggagtgtataagtatgtaaacttcttaggttagaaaaatttggactttctggcccaattatctttctgagcttcagttt

SEQ ID NO: 183349 - DNA, 601 bp, Human
aagtactaaatcagaacttttgcttttttccatttgtgagcttgagccactcatttcatctcttttgtcctcttgttcttgatctataaaatcagaagattggatcaggttatctcttagagttccttgaaactccaaatgttcttatttttttacgtaggaattactggattgaataatggggttagaactgtgtgtatatatgtatatatctttgaaaactgggggtaaatcttttttcttttttgtttttggttttggtaaatttattattataagaacttagatcaggcggagtgcrgtggctcacgcctgtaatcccgacactttgggaggccgaggtgggtggatcacctgaggtcggagcttgagaccagcctgaggaacatgaagaaaccctgtctctactaaaaatacaaatttagccgggcatggtggcgcatgcctgtaatcccagctactcggaggctgaggcaggagaatcgcttgaacccaggaggcggaggttgcagtgagccaagatcgcaccattgcacttcagcctgggcacaagaacgaaactccctctcaaaaaaaaaaaaaaaaaaaaaaaaccttagat

SEQ ID NO: 183350 - DNA, 601 bp, Human
cggagtgcagtggctcacgcctgtaatcccgacactttgggaggccgaggtgggtggatcacctgaggtcggagcttgagaccagcctgaggaacatgaagaaaccctgtctctactaaaaatacaaatttagccgggcatggtggcgcatgcctgtaatcccagctactcggaggctgaggcaggagaatcgcttgaacccaggaggcggaggttgcagtgagccaagatcgcaccattgcacttcagcctgggcacaagaacgaaactccctctcaaaaaaaaaaaaaaaaaaaaaaacccttagataattgcaagtacaacattaagagtattagccgtgagttcccagttagtatttgcttttgtagtttggtagtgacaaagatgtattatatttttatgtctctcagatcgtatatatagtaagtgcgtaatatccttatttaacactgaattaggcaacattatgggttatctctgtaagttttctagaggatttaagaatttcagaagtgtctatactctgctaatcatgttgctaccagtgcagtggtttgcatcagggtggtttgtgtccatcagaaacatcagtggaagg

SEQ ID NO: 183351 - DNA, 601 bp, Human
atcccagctactcgggaggctgaggcaggagaatctcttgaacctgggaggcagaagttgtggtgagctgagattgcaccattgcactccagcctgggcaacaagaaagagcgaaactctgtctcaacaacgacaacaaccaaaaaaaaaaaagaaaagaaaagaaaaaggaagcaagcagtacatgtttaagaggataggcactggattataatagagtctagttctgttcatgcctcaattaacattctttttatttgataacgtcactgtgtttggtgttgaagatacaaaggtttcraattgttggagtttatgataaaagagtaacatttaacaagggaggatcatttaaaccttagaaagtcagggcctggagcggtggctcaagcctgtaacgccagcactttgggaggccgaggcaggcggatcaccaggtcaggagatcgagaccatcctagctaacacggtgaaaccccatctctactaaaaaaatacaaaaaattagccgggcgtggtggcgggtgcctgtagtcccagctactcgggaggctgaggcagaagaatggcgtgaacccgggaggcggagcttgcagtgagc

SEQ ID NO: 183352 - DNA, 601 bp, Human
attgcactccagcctgggcaacaagaaagagcgaaactctgtctcaacaacgacaacaaccaaaaaaaaaaaagaaaagaaaagaaaaaggaagcaagcagtacatgtttaagaggataggcactggattataatagagtctagttctgttcatgcctcaattaacattctttttatttgataacgtcactgtgtttggtgttgaagatacaaaggtttcgaattgttggagtttatgataaaagagtaacatttaacaagggaggatcatttaaaccttagaaagtcagggcctggagcrgtggctcaagcctgtaacgccagcactttgggaggccgaggcaggcggatcaccaggtcaggagatcgagaccatcctagctaacacggtgaaaccccatctctactaaaaaaatacaaaaaattagccgggcgtggtggcgggtgcctgtagtcccagctactcgggaggctgaggcagaagaatggcgtgaacccgggaggcggagcttgcagtgagccagaggtcacgccactgcactccagcctgggtgacagagggaggctccctctcagaaaaacaaacaaacaaacagacctt

SEQ ID NO: 183353 - DNA, 601 bp, Human
agaagaatggcgtgaacccgggaggcggagcttgcagtgagccagaggtcacgccactgcactccagcctgggtgacagagggaggctccctctcagaaaaacaaacaaacaaacagaccttagagagtcagcgtgaagttcccagagagtgaactctggctaactaattatctggctaatttgcatcttaaaaggacacacgggaatcagtgaggagaatcctaagggtcagagacttgcttggcatcttaatcgttaaaaataatttactcagactaggcaatatatccacaaaaaaawttttaaaaattagctggaggtggtggctcacgcctttagtcccagctactcgggaggctgaggtaggaggattgcttgagccactgcgttccaggctgcggtgagctgtgatcttaccactgtgctccagcctgagcggcatagcgagaccctgtctctaaaaatagaaataatttactttgtattttttctagattagaaactcggtgctatgctgacttcctcataatgtgtgaaacttccaaataactttaaaatataataaagttaccatatgcctacttataaatgccatgtccg

SEQ ID NO: 183354 - DNA, 601 bp, Human
tacaggcatgcaatgcataatgatcacattagactgaatgaagtatccgtcttctcaagcatttatcctttttgttacaaacaatccagttatactctttatttttaaatatacaattaaattttttttgagtatcgttagtcaccccattgtgctagcaaacactaggttttattgattcttaactatttttttgcacccattaaccatcctcacttccagtccccattaccctctcaagtgtctagtaacagtctctctactctcttatctccaagagttcaattgtttaaatttttakctcccacaaataagtgagaacatgtgaagtttgtccttctgtgcctggcttattttacttactataatgaccttccagttccatccatgttgttacaaataacaggatcttattctttttaatggttaaatagtactccgttgtgtatatgtatcacagttttttgttttgttttgttttttgcttttgagactgagtttcgctcttgttgcccaggctggagtgcagtggcgcgatcttggctcactgcaagctctgcctcccgggttcaagcgattctcctgcctcagccttcccgag

SEQ ID NO: 183355 - DNA, 601 bp, Human
gctcagctcacttttgtgtttttagtagagacaggatttcaccatgttggccagggtggtcttgaactcctgacctcaggtaatctgcccaccttcgcctcccaaagtgctgagattacaggcgggagccaccacacccagcccacatattctttatctggtaatctgttgatagatacttaagttacttccaaatcttggatattgtaaatagtgctgcaataaacataggagtgaagatatctccttgatatatgatttcctttcttttgagtgtatacctaggagtgggatatgttayaataatttttaatagataatatattcatgtggtataaaattgaaaatatgaggttataaagtgaaaaatcttagccctcttttccagttacccattttctctctccctagatgcctttttgttaagcaaatacatacttgtaaaatttaatttaattttgtttttggagatggtctgaggctggagtgcagtgatgctaccatagctcactgcagcctcaaaatcctcggctgaaagagtcctcccacctgatcctcctgagtagctaggactgcaggtgcacgtcaccatgcctggccc

SEQ ID NO: 183356 - DNA, 601 bp, Human
acctccgcatcctgggcccaaatgatcctcctgcctcagcctcccaggtagctgggactacaggcatgcatcactatgcccagctaatttttatattttctgtagagacggttttgccatgttgcccaggctggtctcaaactcctggactcaagcaatccacctgtctcagccttctaaagtgtaagccactgcatctagccttttattttctttttcttttttttggagaggtagtcttgctctgtcgcccaggctggagtgcagtggcgcgatcttggcccactgcaagctctgcctyccgggttcacacctttctcctgcctcagcctcctgagtagctgggactacaggcgcctgccaccacacccggctaatttttttgtatttttaggggagacggggtttcaccgtgttagccaggatggtctcgatctcctgaccttgtgatccacccaaagcggcctcccaaaatgttgggattacaggcatgagccaccgcgcctggcttattttctttttcatttaacaaaataagttaacatttacagattttaggaaatagttctccctatcttggagacagcagtaaatgaacaga

SEQ ID NO: 183357 - DNA, 601 bp, Human
gcatgagccaccgcgcctggcttattttctttttcatttaacaaaataagttaacatttacagattttaggaaatagttctccctatcttggagacagcagtaaatgaacagatttctcattctttctaatagctttgtactttctacaggtatacagtggtatacctgatttatatttattaaattattttgtattatatatcaaattatatatacatttatcaaagtattataaatatttatatgtatataaatacaggtaaatatttatatgtatataaatacaggtaaatatatttrtataaatacaggtaaatatatttatgtaaatataggtaaatatttatatttatataaatacaggtttatatttctataacctgttcctcctttatggacatttaggtttacagccttttactactacaaattatggtacattgaataaccttgcacatatcttattttgcgaatgtgtaaggatgtacataaagtaaattcctagaagtggaattactgagtcagagagtcttaaatgcatttgtaatatggatatttgttgtcaaattggcaatcaagtaattctatcagtttatccct

SEQ ID NO: 183358 - DNA, 601 bp, Human
gcactcagaaaatttcagatttggggttttcagatttaggatgctcaatcatgatgtagtaatcatgacagtgagacactttaaaaatgtcattgaaaaacaaaaacaaaaataagaaaaaagaaaaaaatatataattgaagatttaaattacatgcttacctgagtttctttcataagtctgctgtatacaacctaggaaatgcaaaaactaaaataaaaatcacctataactcatttacttagagatagactcaatattttcatttatttcctattttgttttactgtgcagatacaktttaaacttttatgaattttaagttgaaaaactaatacatgaacatattcttattgcaaaaattcaaaccttatacgtaaagctgaaggcccccaatgacttccattcctagactcagtcccttttgcagagattctgtgaggagtttggtatatatagtattttcaagatctctctttgtagaaatagggtattgttttatggtgttaaaagaaatacttatgtacaatttacttttttgtttcttttgaactaaacagtaggtttcttggcttgtgttacaatgaaactgccatatag

SEQ ID NO: 183359 - DNA, 601 bp, Human
cactttaaaaatgtcattgaaaaacaaaaacaaaaataagaaaaaagaaaaaaatatataattgaagatttaaattacatgcttacctgagtttctttcataagtctgctgtatacaacctaggaaatgcaaaaactaaaataaaaatcacctataactcatttacttagagatagactcaatattttcatttatttcctattttgttttactgtgcagatacattttaaacttttatgaattttaagttgaaaaactaatacatgaacatattcttattgcaaaaattcaaaccttataygtaaagctgaaggcccccaatgacttccattcctagactcagtcccttttgcagagattctgtgaggagtttggtatatatagtattttcaagatctctctttgtagaaatagggtattgttttatggtgttaaaagaaatacttatgtacaatttacttttttgtttcttttgaactaaacagtaggtttcttggcttgtgttacaatgaaactgccatatagtattaaatagcattttataccgtaatttgttcagtttctccccattgtaagatattttgagtgtttccattttttt

SEQ ID NO: 183360 - DNA, 601 bp, Human
tgagctaccacacctggcatagcttgctttaattttttatttactctattttagatttctccatgcatattacttttctcttaacatgaagattacacagcagtgactagggcgtgaaagtaattcttagaaatattatggctgggcagccaggcgcagtggctcatgtctgtaatcccagcactctgggaggccgaggggggtggctcacgaggtcaggagttccagacgagcctggccaagatggtgaaaccccatctctactaaaaatacaaaaattagccaaatgtggtggcgcacrcctgtagtcccagctatttgggaggctgaggaaggagaatcacttgaacccgagaggcagaggttgcggtgagccgagatcgtgccattgcactccagcctgagctagaagagcgagactccatctaaaaaaaaaaaaagaaagaaatattatggctgggcacggtgtggctgggcatggtggctcacacctgtaatcccagcactttggggggccgaggtgggtggatcacttgaggtcagtagttcaagacaatcctgtccaacatggtgaaaccccatctctactaaaaatgcaaat

SEQ ID NO: 183361 - DNA, 601 bp, Human
ggcggaggtggcagtgagccaagatcactccactgcactccagcctgggcgacaagagtgagatcctgtctcaattaaaaaaatagaggccaagtgtggtggcccatgcctgtaatcccagcagtttgggaggccgaggtgggtggatcacttgaggtcaggaattttgagaccagcctggccaacatggtgaaattcagtctctacgaaaaaaaaaattagccgggtgtggtgacaggtgcctgtaatcccagccactcaggaggctgaggcaggagaatcacttgaacccaggaggcgsaggttgcagtgagccaagatcgtgccaccgcactgtagcctgggtgacagagctagactctgtctcaaaaaaaaacctaaaaccaaacattagttgtaaaggtatattatttgagagtgatttctacattctccagaaataacgtgggtgattttttaaatgaatttttaaaaaaaaattcctgaaaggaatgaaaatatgattttaagtctgcagggttcaagaggggcatattttacatttattttgctttcatactactttgatttcctttctattaaatgtcctatttttttatct

SEQ ID NO: 183362 - DNA, 601 bp, Human
ggtcaaataggaaccagcagtctacactgatataaataaatgattaaataatgagagagaagggaagctgttcccttattagaatgtcaactaataaatttaaacggaatggtggagttagaaaagtcaccattttgtaatcatcacagtaatgactgacccaggcaagaatcttctattgatgctaaatttagaggggtgatttcagtgagaaactagatgtttacagagtatttctccgtaaattacttaattacaaagaataaaatgcagtcagttctcactattcatagattctgtmtttgtgaattcaccttctcactaaaatttatttgtaacctccaaatgctaaggatttccaattccaactacaaaaaaaattatgaccaggcctgttgtcagtaatgcctgtttttaaaatcctatcttatgggtataggtttgttctgttcggtagccttgaaatctcttgttctgtgaggaatttaatctgtcagtaccatgtggattattctgtcatttccctattctgtatttgttaactgttcaacagtgagaaatctggcgcctgattatcttcaacatttctgttctttattga

SEQ ID NO: 183363 - DNA, 601 bp, Human
agtcaccattttgtaatcatcacagtaatgactgacccaggcaagaatcttctattgatgctaaatttagaggggtgatttcagtgagaaactagatgtttacagagtatttctccgtaaattacttaattacaaagaataaaatgcagtcagttctcactattcatagattctgtctttgtgaattcaccttctcactaaaatttatttgtaacctccaaatgctaaggatttccaattccaactacaaaaaaaattatgaccaggcctgttgtcagtaatgcctgtttttaaaatcctrtcttatgggtataggtttgttctgttcggtagccttgaaatctcttgttctgtgaggaatttaatctgtcagtaccatgtggattattctgtcatttccctattctgtatttgttaactgttcaacagtgagaaatctggcgcctgattatcttcaacatttctgttctttattgattcctagaatgaacagttgccatcccatactgctgtaaagaaagaccaactaactagagttcactatttctttatccttattttcgtttttagactgagtgtaggtagttaaacaccaagttta

SEQ ID NO: 183364 - DNA, 601 bp, Human
aaaagttgatgtaacatccaactgtatgtccctcaaactcatgctaacctagcataccttgcccttatcagtttcagcaatctgagatttggccctttattaatatgtatctgcccaggagtttctaaaaggtcagatttgttttgagccagacttccaatggctactctgttctgaatcacactgtgaaaagaggaaaagatctttagtttgaaaacacacacttgggcccctgttattccataatccttcagttaccattcagaacattggtcagagtagattttgtcatgcatcttayatataagcagagctatatcttacatccacttagtaagtttgatggccttcttaattaattgggaacagtcaaaaagcattgtaacactgtggtatttatcatcattatatttaaaaccttgtatgagagatttacacctgttttttttaacttcctgaaagaaaacaaaaagacttctgaagaaatctgacagtcttggtccatctatatgtgttcttggggagtctgggcaatcaatcttcctgggcctttctctctttgcaattttgagattggagatccttctttttgtgactattt

SEQ ID NO: 183365 - DNA, 601 bp, Human
cacttgggcccctgttattccataatccttcagttaccattcagaacattggtcagagtagattttgtcatgcatcttatatataagcagagctatatcttacatccacttagtaagtttgatggccttcttaattaattgggaacagtcaaaaagcattgtaacactgtggtatttatcatcattatatttaaaaccttgtatgagagatttacacctgttttttttaacttcctgaaagaaaacaaaaagacttctgaagaaatctgacagtcttggtccatctatatgtgttcttggkgagtctgggcaatcaatcttcctgggcctttctctctttgcaattttgagattggagatccttctttttgtgactatttgagtgtgccagagaaaattcaaagtcaaggagaaaaaccttccagcagatgcagagatggaacactggaagctaataaaagctgcatcccctgtagaggctcagcaaagggctgtcaaaagtcagagtggaggatagaacacagaccagtaccttgattaagatatttcctagtttttcaggagctgacgtgacctcagatcatgctgttcaattcagagt

SEQ ID NO: 183366 - DNA, 601 bp, Human
aaaccttccagcagatgcagagatggaacactggaagctaataaaagctgcatcccctgtagaggctcagcaaagggctgtcaaaagtcagagtggaggatagaacacagaccagtaccttgattaagatatttcctagtttttcaggagctgacgtgacctcagatcatgctgttcaattcagagttcactgcagttgttaacccatttatgccggaggttgcaagttttttgtgtgaaaaatcagatcttggcaatgaccttgagaagtaggatatacataactcccacaagcttagcrtaccaataatgaaactaagagatgagaggattgctatgttacatagtacacagaaacacaagaacagagttgtggcaacatggcggtaagtagttgtatgagaagaaatgggaggaggcagattgcctgacaatacagaacaaatagcacaatagaggaagcagctggtgaatcttgtactcaggagacaagtgaagaggaacactagagattcatttctatggtgacagggtcccatttcagtgtccttattctgaaagtaattttggcacttttattggaaaatagtgagatgttaaa

SEQ ID NO: 183367 - DNA, 601 bp, Human
gaaaatattataactgagaaattattgtatatatttatggtatacagcgtgatgttatgatacatgtatacaatgcagaatgattaaatcaagctatttaacatagctgtcacctcaaatactatttttgtggtcagaaatttgaaatttattatctcaggaattttgaaatgtacaatacattattattaactgttctcaccatgctatgaaaatagatctcaacaaacttattcttcctgtcttaactgaaactttgtaccctagttttaaaaatttaatacatttatttggttcgaarttcagaaagtataaaatgataatctgtgaaaatctctttccatgagtttccattctcacattttgtacattattccacgtgtgtgtgaatgttgatcttgtagaatgaatttcctagaaatggaattgccagtttgcagaggtcatgcatttgtaatttggtagacactgctaccagaatataagaggataagttgccctacaccctgtataaaactacgtattattgtaaactctttcacctttgccagcctaatggattttttttttaacaaatgctagtttcaattagcatttctct

SEQ ID NO: 183368 - DNA, 601 bp, Human
ttttttgagatggagtctcagtttgttgcccagactggagtgcagtggcatgatctcggctcactttaacctctgcctcccaggttcaagcagtcctgcctcagctccccctagtagctgggattacaggcacatgccaccatgcccggctaatttttgtatttttagtagatacaaggtttcaccatgttggccaggctggtctcaaaactcctgacctcaggtgatccacctgcctgagacagggtctcattttcacccaggctggagtgcagtggtacaatcaaggatcactgcagcytcaaccttccagtctcaagcaatcctcccacctcaccctcccaagtagctgggactacaggtgtgcatcaccacatctggctaatttttgtatttttttgtaaaaatggggtttcgtcatgttgcccagactggtcttgaactcctgagctcaagcgatctgcctgcctcagcctcccaaagtcctagaattacaggcgtgagccaccgtgtccacccatttacctaacctttaaatactgtagtacctcagggttcccattcaaatcttctcacactgcatatactccttgagcaatct

SEQ ID NO: 183369 - DNA, 601 bp, Human
cctatgacactacacaaaacctagtccttgcttacctcatcaatgttatgtagtactactttcccttgcagtttttagatttggccatgtttggtctgtcttctcatcatttctaaagcatgctatgtttcttcttaactcagaaccttcctgtcagcatcttttcccttttccttttatacccattctattatagctgcatatatgtttaacatatgtgattatatgttcattcacatgctctccaagtcctgtagaatatgagttccaggaaagcacactcatatatcttggctcactratgttctctcagtatgtaataagagtgtttggtcatcctaagggttgaataagtgaacatctacacatttactctgttttccccataatatgagaaatatttgctttgaaacattaagtatatataacatttagattggaacttggcaacttatgagttgctctagcattacttggttaggactcttccatggagaagacgtatggctagcagctaaagtttttgtgattaatgtttcttggaatttgcaacatgacaacttaagtttctctgcctcattgatttcctatatgaaaattg

SEQ ID NO: 183370 - DNA, 601 bp, Human
ccatggagaagacgtatggctagcagctaaagtttttgtgattaatgtttcttggaatttgcaacatgacaacttaagtttctctgcctcattgatttcctatatgaaaattgggaaattttagtaattttcagggtatagaaatatcagacgttttattttaacctggaaacatatacttttaagctactgtttcaatgctttttatattttttttattttgtaccccttactacctcctgaccctcaccccagtacttccctccctcccagcacccatgcgagtccctctatacttctrtacattaatttttccccattttaattttctttagcgttatcgaactccttccagatccagatcaagggatcgtttcagacgtagtgagactcctccacattggaggcaagagatgcagagagctcaaagaatgagggtatcaagtggtgaaagatggatcaagggggataagtaagatttaactattattatttcaaatgtaatgataagtgtttgcttttactattatacataaagttattgtcattttagttattgctgaataccttaagaaaagtagaatatcattttagctaataa

SEQ ID NO: 183371 - DNA, 601 bp, Human
ggctagcagctaaagtttttgtgattaatgtttcttggaatttgcaacatgacaacttaagtttctctgcctcattgatttcctatatgaaaattgggaaattttagtaattttcagggtatagaaatatcagacgttttattttaacctggaaacatatacttttaagctactgtttcaatgctttttatattttttttattttgtaccccttactacctcctgaccctcaccccagtacttccctccctcccagcacccatgcgagtccctctatacttctgtacattaatttttcccyattttaattttctttagcgttatcgaactccttccagatccagatcaagggatcgtttcagacgtagtgagactcctccacattggaggcaagagatgcagagagctcaaagaatgagggtatcaagtggtgaaagatggatcaagggggataagtaagatttaactattattatttcaaatgtaatgataagtgtttgcttttactattatacataaagttattgtcattttagttattgctgaataccttaagaaaagtagaatatcattttagctaataatatctacagttcttttc

SEQ ID NO: 183372 - DNA, 601 bp, Human; identical to SEQ ID NO: 31592

SEQ ID NO: 183373 - DNA, 601 bp, Human
ctttgtttctgagtttagtagattagtacaccacgtagtatcttttgggattgagtctactattcaaatgtatattttatacttttgggaaatacctaaaattcatgtaataaagaacaccaacttgtaataaatataataaatgtagtagtttttgaaaactgtaattttattgcctattcttaagaacatgatatattacaaacaatatgcatccaaagcttaagctctgccatgaactttatgatacctagtgaagtattttctgagcaagacagagtttaatacgggtttagaaacraaaatgagaattccacgcaataaatatttactgggtagttactatgtcccaggaaccttactaggcaatgggtgtgcaaagattaaaaatatgtaattctggctaagattttgctgtcaagtaatataggaatgaaacagaagaggttagttatttcaacataacatgggaagcatataatagttaagaatagtattctgggaatacacaggaagggctccatgcctagtctaagggtttaaagaaaggtttttagagagtaggagactggggaatcatgagagtgttagctaattagta

SEQ ID NO: 183374 - DNA, 601 bp, Human
aaattaggaattaggagagattatgacaagcctaaacacaggtattagcatctgtttgtcaattaatgcaaccattttagtttgctagtcctggaattaaagcctaaactgaagttagctttaaattacttctttgacttaggaaaaaagtgatttatatactatcgattcccacaccctcctccaggggagaatgagaagaaaaatggtaaaatatggacgtgaaacctttgttaaaaaacaacaaaaacataaaagaatctcaaaggtgagtcaagaaactggaaccttgagttttatyttaaattttaacacctttcagtctatttccagggtatacaagtgaagctgagactgggtcttctgtacatgtttaattacattattaaaatcttaaatgagagctgcttaccataatataaaaacatcatgaattaaaggacacacacaaaataggagcattttgtatccttactacaagttctttttttatttttttgttttagagacagggtctcactgggttgcccaggatggagtgcaatggcacgatcatgactgcagcctcgacctcccaggctaggtgatccccctgcctcag

SEQ ID NO: 183375 - DNA, 601 bp, Human
taggaaaaaagtgatttatatactatcgattcccacaccctcctccaggggagaatgagaagaaaaatggtaaaatatggacgtgaaacctttgttaaaaaacaacaaaaacataaaagaatctcaaaggtgagtcaagaaactggaaccttgagttttattttaaattttaacacctttcagtctatttccagggtatacaagtgaagctgagactgggtcttctgtacatgtttaattacattattaaaatcttaaatgagagctgcttaccataatataaaaacatcatgaattaaakgacacacacaaaataggagcattttgtatccttactacaagttctttttttatttttttgttttagagacagggtctcactgggttgcccaggatggagtgcaatggcacgatcatgactgcagcctcgacctcccaggctaggtgatccccctgcctcagcctctcaaatagctgggactacaggcaagcaccaccacacctgactgatttttgtatttttcgtagagacagggttttgccatgttgcccgggctggtctcaaactcctgagcacaagtgatccgcccaccttggcctc

SEQ ID NO: 183376 - DNA, 601 bp, Human
ccctgcctcagcctctcaaatagctgggactacaggcaagcaccaccacacctgactgatttttgtatttttcgtagagacagggttttgccatgttgcccgggctggtctcaaactcctgagcacaagtgatccgcccaccttggcctcctaagggctgggattacagccatgagccaccaaacctggccttactacaagtcttaaaaataatttttagaacagtgttcaatcatactggctgtgtgccttccattctaatttaaatactcttaatagggtttttcttgcttaaacatargagagctatgacaacaggtacaatcatatattggccatatggagataaaagtttttaatattttccaatctagaaaattaggcagtcatcaaacggggcaaagtgcttagttaactgtgctgctagtttgttcagaaaagcataccatcaaagtaggggcacagagaaatacacagaaatattaatctatatatagtgcaaattaaaagatgtaatattatgttcattcttctaacagaaaggtgaatattttttaaagctggtatattttactccacatttaattttaagggaattcta

SEQ ID NO: 183377 - DNA, 601 bp, Human
tcagaaaagcataccatcaaagtaggggcacagagaaatacacagaaatattaatctatatatagtgcaaattaaaagatgtaatattatgttcattcttctaacagaaaggtgaatattttttaaagctggtatattttactccacatttaattttaagggaattctattcttttatcttaaaattaagaataaattacctaatttggggattggcatacatattttagctttctgagattggtaacatcaatgtttctactgaaccaaatgtaacaaagtggacctagcacctaaaaasttaatgtatcaccagtaccatttgtagttttaaattcaatcacacacagagaattggcaactaagtattagttgaagtaaaccaatggctagggcttaatttttgcatgcagaagtcatctgtacatctactgcctacagtagttaagaaaaacacacctcaattctttagggcacactaatttttagaaatctcagaagtatattaagaactgctttagtaaagtacagaaatttacctctaaagtcaaactttaatttaaattcataatgttaagtttcagttcaaaggcaggcattt

SEQ ID NO: 183378 - DNA, 601 bp, Human
ttatcattaatcctcagaaggaaagggtttattatttttacctttgtcttgaaaaaattatgtatccaaaattttcattaataagcaacataaataatttaaggcactaaaataactttgtagcatgtaaaatgtaaagcatgagctctgttaagatactttcacaaatggttctctttcaatttgaaaatcaatgtaagaaatttaaaaatatgtgtatatatatacgcacacacacaaaccaggtaaaagctcatattttcataaattttctaagaatgtaaacttctatttctgtttaaaaaaaaaaaagttataatgtcaatgtagaagtaccaaaacatactatgaaggagaaaaacagtattggtcctctactaatttagcagaagcaaattttgattttaacttatttctaaaatcaatatgaatgtgtctactttttcagtgacagcatccccaccaccaatagtgaaatatatgatttttgtttccagcaatgcagagagaattggaagccaataattaaaaagaagagattattatccaccaccaagaattcagtgtcaggacctcagtggctcatataattaacagcaca

SEQ ID NO: 183379 - DNA, 601 bp, Human
cagcttttgccaacatggccatgcactgtccaaagggaccaggaaaatctgtcaacaacccagataaatgtgaactaggtaacagtccttatacactaggaacatagggactacacaatgtactagcagaaaataattctatttgcctttcagatatggactgaactgagtgtaaagaatatgtaacgcattatattctagccaagtaattagctttttaaaattataagttattaagttggtaaaaatatataccctgcaattcttatcttaaaaagtacagctgggcacagtggctcaygcctgtaatcccagcactttgggaggccgagacgggcagatcacgaggtcaagagattgagaccatattggccaacatggtgaaaccccgtctctactaaaaatacaaaaattagctgggcgtggtggtgtgcacccatagtcccagctactcaggaggctgaggcaggaaaatcgcttgaatccgggaagcggaggttgcagtgagccaggatcgcgccactgcactccagcctggcaacagtgagaccgtctcaaaaaaaaaaaaaaatactagagaccaggcacagtgactcacgtc

SEQ ID NO: 183380 - DNA, 601 bp, Human
ctgcaattcttatcttaaaaagtacagctgggcacagtggctcatgcctgtaatcccagcactttgggaggccgagacgggcagatcacgaggtcaagagattgagaccatattggccaacatggtgaaaccccgtctctactaaaaatacaaaaattagctgggcgtggtggtgtgcacccatagtcccagctactcaggaggctgaggcaggaaaatcgcttgaatccgggaagcggaggttgcagtgagccaggatcgcgccactgcactccagcctggcaacagtgagaccgtctcaaaaaaaaaaaaaaatactagagaccaggcacagtgactcacgtctgtaatcccagcacactgggaggctcagatgggaggatcacttgatgccaggagttcaagaccagcctggccaacatggcgaaaccctgtctctactaaaaatacaaaaatcagtcaggtgtggtggtgcgtgcctgtagtcccagctgctcgggaggctgaggcacaagaattgcttgaacccaggaggaggaggttgcaatcagccaagatcccaccactgcactccagcctgggtgacagagggagactctgc

SEQ ID NO: 183381 - DNA, 601 bp, Human
gaagtacaagtattctttcatactgtatccctccatttttaattagatgatccacataaaaatgtctacaaatcaaatttgtttatctacttacatattatataccttcaaaaaaacaaatcaaacaaaaaaacccaaggccacaaaactgtataaaacctaaaaatctcttataaaaggaagccagatagttttctgatcaaatatgaatgctgtgttatattaaagtattaaggtcaaatagcaagaatcaattagtacttctgaggtagtaatcatacaaccaccaaaaaggagacamagctattttaggatattatcaaatgagaagtggacagcaacaaagtgggactaacaagactctttttatgtcctctactgcttttctactcaaagtatggtccaagtaccaagaaaaataccacctaggagtttgttagaaatgcagactcggtccccacctaaaccttctgaattagaatctggattttaataagcccagctgatttgtatgcataagaaaatataagaagcacttctttactgcaaccccttaaaacattatgcaaagtctcttaaattttttcttttctttgtgaaa

SEQ ID NO: 183382 - DNA, 601 bp, Human
actgtataaaacctaaaaatctcttataaaaggaagccagatagttttctgatcaaatatgaatgctgtgttatattaaagtattaaggtcaaatagcaagaatcaattagtacttctgaggtagtaatcatacaaccaccaaaaaggagacaaagctattttaggatattatcaaatgagaagtggacagcaacaaagtgggactaacaagactctttttatgtcctctactgcttttctactcaaagtatggtccaagtaccaagaaaaataccacctaggagtttgttagaaatgcasactcggtccccacctaaaccttctgaattagaatctggattttaataagcccagctgatttgtatgcataagaaaatataagaagcacttctttactgcaaccccttaaaacattatgcaaagtctcttaaattttttcttttctttgtgaaatgtaagctaaaatgttcagtggtataaaaagcatcttttaaaagttgtaagtaaagcaaatataaaacaacaatggtagaatctaggtagtatatttgcaaatgttttaaataaaactcaattttgtatttgaaaatgtttcataag

SEQ ID NO: 183383 - DNA, 601 bp, Human; identical to SEQ ID NO: 31593

SEQ ID NO: 183384 - DNA, 601 bp, Human; identical to SEQ ID NO: 31594

SEQ ID NO: 183385 - DNA, 601 bp, Human; identical to SEQ ID NO: 31595

SEQ ID NO: 183386 - DNA, 601 bp, Human; identical to SEQ ID NO: 31596

SEQ ID NO: 183387 - DNA, 601 bp, Human
aacatacacctttttgacttcttgaaaactgcttcttttaagagattttcttcttgctctgattaaaatgttagtctgtgtgtttaataccctgggacagtgaggcctaggaagactttttatagaaatccttgcaattcctcaaaatctctgctagagtgagtcagtgggtggggtgcaggcaggtgcaacactcactgagaccactgtgttgccagacttctgtggctccatccttctccaagaaggtccccacattgaggtcaaggatttttttgctttttttgtttttgttttttgtttttttttttgtttttttttttgagacagagtcctgctctgtaacccaagctggagtggagtggcacgatctcagctcactgcaacctccgcctcccgggttcaagtgattctcctgccacagcctcccgagtagctgggattacaggcgtgtgccaccatgcccagctaatttttatatttttagtagagacagagtttcgccatctaggccaggctggtctcaaactcctgaccacaggtgatccaccctcctcggcctcccaaagtgctgggattacaggcgtgagctactgcacct

SEQ ID NO: 183388 - DNA, 601 bp, Human
cccaattataaagatctgcctgctctatcaagaactgcctgctctttgatactgtattcacttaggaagcaatctaaattgtggagtaaccctggggaagcttaggaatgtgttggtgataactgcttatgctgtcaatgctttcctggaatttgggagttgtcagagtgtctgttggtgctacatactagtattacaactatgtgctctgcaagcctttatattatcttctgtatcctctctcacttctatacagtgctactctactcacacccagctccccacccgcacacacacacaytgacactcaaagtcatcaagaaactcaagtaacattgtatactggggttgcctcacaaggtataggccgtgggatgtcagagaagataagaattatagaaactactcttgtaggtcttgtttggtgacatggtttggctgtgtccccacccaaatctcatcttgaattcccatgtgttgtgggagggacctggtgggagataattgaatcataggggcaggtctttcctgtgctgttctcatgatagtgaataagtctcatgagatctgatggttttaaaaagaagagttttcctgcaca

SEQ ID NO: 183389 - DNA, 601 bp, Human
cacaaaggtaagtaatgctaataatgtactgcgacattgagttatttttccagcagcagtgatcatagacagtacagctttgcaaaaagctcactggacaaggaatcagaagaactaggttttttttggttttgtttgtttttgtttgttttttgttttttagacagggtctcactcttttgcccaggctggagtgcagtggcatgatctcagctcactgcaacctctgcttcctgggctcaagccatcctcccacctcagcctcctgagtagctgatactacaggtgtgtgccaccatgygcagctaaattttgtattttttgtatagatgaggtttcgccatgttgccaaggctggtctcgaatttctgagctcagtgatccgcccacctcagcctcataaagcgctaggattttaatcccacttctccttccgactgactgtgattttagagaagtcattagcactcctggttaagatttcctggtttgtaaatgagggagtgagattatgttagcatcctttcaactccatcttccaaatatcagtaaaagaaagaggaggtaggtttacagcttgggagccgacataattcagtcc

SEQ ID NO: 183390 - DNA, 601 bp, Human
ccctctttgggtcccctccctttgtatgggagctccgttttcactctattaaaccttccaactgcacactcttctggtccgtgtttgttaccgctcgagctgagcttttgctctttgtccaccactgctgtttgccaccatcgcagacccgccgctgacccgccgctgacttccacccttccagatccagcagggtgtctgctgggctcctgatccagcgaggtgcccattgccgctcccgattgggctaaaggctggccatcgttcctgcatggctaagtgcctgggttcatcctaatcragctgaacactagctgctgggttccacggttctcttccatgacccacggcttctaatagagctgtaacactcaccatgtggcctaagattccattccttggaatccctgaggccaagaacccaggtcagaaaacaagaggcttgccgccatcttggaagcagcctgccaccatctcgggagctctgggaggaaggacccccggtaacattatcatatatggcagtggtccccaaccttcttggcaccagggactggtttcgtggaagacagtttttccacagactgggttttgggatgat

SEQ ID NO: 183391 - DNA, 601 bp, Human
caccatcgcagacccgccgctgacccgccgctgacttccacccttccagatccagcagggtgtctgctgggctcctgatccagcgaggtgcccattgccgctcccgattgggctaaaggctggccatcgttcctgcatggctaagtgcctgggttcatcctaatcgagctgaacactagctgctgggttccacggttctcttccatgacccacggcttctaatagagctgtaacactcaccatgtggcctaagattccattccttggaatccctgaggccaagaacccaggtcagaaaacmagaggcttgccgccatcttggaagcagcctgccaccatctcgggagctctgggaggaaggacccccggtaacattatcatatatggcagtggtccccaaccttcttggcaccagggactggtttcgtggaagacagtttttccacagactgggttttgggatgatccaagcacattacatttattatgcactttatttctattattattaatatttaccatgataaagaatcagtgggagccctgagcttgttttcctgcaactagacagtccatctgggggtgatgggagacagtgaca

SEQ ID NO: 183392 - DNA, 601 bp, Human
ggagggtttgggagatggaaaatcactaagaggaagcatcagggataaggggggattcctgctgaaggcaggccagggtaatcagatatcacctgggggatggcaagaatttttttcagctattgagggtggtgagttattgaggacgggggattctttctaaactgatttagcaggattcttgataaaactgaactatgcaggtctggcaaggacggggcctagtcaggaaaagggttcagaggaacatgactaaaatatggtcaatgagtctttgttcagtagcaaggacacagctacragtaaactggactttagggacaggagtcaagttattaaaagtcctgaaaaaaatttagggctgggtgtggtggtggctcacacctgcaatcccagtattttgggaggccaaggcaggaggaatgcttgaggtcagaagttcaagaccatcttgggcaacatggctagaacctgtctctaaaaaagaaaattgtaaaagcaacaaatatagaggaagatggattctggatgaggcatcaagtcaagaagtgatagaatcagggcaacagattaagagctcaattactggaaaaagaattaa

SEQ ID NO: 183393 - DNA, 601 bp, Human
cttactttagttacatctgcaaagaccctatttccaaataaaatcacattttggggctctaggtaaacatgttttgtgagttatcagtcaaccaactacgtctattgaatatatcacccatatttctatacagtcttctattccatttggccaacaggtatgtgcacaggtgaatgcatgttctttctggaagaggagaggccttttttttttttttttttttttttcaagctgttgagcacatgctgtcccttgcttgactttatggacgttaggccttatacattgaccttgtcattcmcataaatattaaactcctcctagaaagtcaccccggacgttttgaatggagcatattaaatatgcatggtcttttatgccaggcttttccaacactcttatttttttactatctttttattgtttcaggtagtcagattgtacatagtatatgctaagttcctttgcttatatagttgacagatcactataaacttgttctttatgcatacaacccctgaaatttggtcttatccaaagatcgagagcatagtggggtacaaagatcattgaacttgtggacaaaagaatcaggttgaca

SEQ ID NO: 183394 - DNA, 601 bp, Human
gatcattgaacttgtggacaaaagaatcaggttgacatattcattgtgtgaccttagataaatcacactccctgaacttctgttttctcgcaactaaaataaataatcttacctcacagagttttggtgaggtatgaagtgtttaggagattattttacaaagtttaaagcattatataaattaagcagtgctgtattaacatcctgcatgaagggatgctttttgtatttatatcattcaaatatagagtgtttgttagtgacatggaaagaagtcaattagggaaatgttttaaaaggwcaagacatagttgtgtattctttgagcttatagtctaattggagaagagtaactagtaccaataactaggttaagctctgaggaatggatggagaacatgtttgtttgaaagaagtaattatggttgccctcatggaagaagtgagagagaccagaggaccaggaaagactaacaggcaggtagatgaatacagagtagcgtagtctagagtagcagcttgcatacaacactgcaaagaagagtcagatgccatacaaggacatttcagaaactcttcttaaagctgcagactccaaaga

SEQ ID NO: 183395 - DNA, 601 bp, Human
ctaattatgtgctaggccctaaagccaccaaaaagaacaagacaagttcctgtcttgaaggagccaatgtctagtagaggaaagtaacacagaagtgccgtgaaagagtcaacactgaagcagcaagttaatttatcccagatttctgtattattaacctgtctaggcagttagggtaggcttcacaaagagataattcctaggcagaggtctttgccaggtggccgaggatgggtatgccttcttgatagagtgaggtgcttgaggaagggcttgggatgccctacacctgctttttacyaaaacctaaaatagagcaatggagtaggagacaaggctagagaagggagcaaggactgcattataaaggaccttgtgggccatgcgaaagaacttggagtttctcctacatgatgaggagagtgctttaagtgggtgagtaatatgaatcagatttgctgtatagaaacagcctgtggctggctgggcgcagtggctcacgcctgtaatctcagcactctgggaggccgaggtgggtgtatcacctgaagtcaggaatttgagaccagcctggccaacatggtgaaacctcatctctact

SEQ ID NO: 183396 - DNA, 601 bp, Human
ttttcaaagtcatgcttttcttatttctaaggaatttacagctcatagcttttccataattaaaattggccatatattaatactcctgcaattctgtatttttgttttgatccatgcctatttttaccagatattcctaattaagctctggattttatacaaaatttacaagaatttttaaacaagacctcacctcatttaggatttgggatagaggagtgattgtgtctttaaaatcgtgtgtttgtgaccaggcatggtggctgacacctgtaatcccagcactttgggaggcgaaggygggcagatcacgaggtcaggagttcaagaccagcctggtcaacatagtgaaaccccgtctctattacaaacacaaaaaattagctgggcgtggtggcaggcacctataatcccagctactcaggaggctgaggcaggagaatcacttgaacccgggaggcggaggttgcagtgagctgagatcgcgccattgcactccagcctggcaacaatgtgagactccgtctcaaaaaaaaaaaaaaaattgtgtctttgtgtatgatgtgtgtgtgtaaaatttttttaaaaagaaactcttaaa

SEQ ID NO: 183397 - DNA, 601 bp, Human
ggccatatattaatactcctgcaattctgtatttttgttttgatccatgcctatttttaccagatattcctaattaagctctggattttatacaaaatttacaagaatttttaaacaagacctcacctcatttaggatttgggatagaggagtgattgtgtctttaaaatcgtgtgtttgtgaccaggcatggtggctgacacctgtaatcccagcactttgggaggcgaaggcgggcagatcacgaggtcaggagttcaagaccagcctggtcaacatagtgaaaccccgtctctattamaaacacaaaaaattagctgggcgtggtggcaggcacctataatcccagctactcaggaggctgaggcaggagaatcacttgaacccgggaggcggaggttgcagtgagctgagatcgcgccattgcactccagcctggcaacaatgtgagactccgtctcaaaaaaaaaaaaaaaattgtgtctttgtgtatgatgtgtgtgtgtaaaatttttttaaaaagaaactcttaaaatgtcagtgtgttaattggagtgaagtttagtgtgataaaccagaaaggggaaatgctggtttgtca

SEQ ID NO: 183398 - DNA, 601 bp, Human
tcatgtggtttatgtcctctccagtacctgttctgagttgatggtatacctactttgaactaatttgaaagctagattacaaatgaagtactaagaattgaggccacttctctgaggttactagaagtgcaagcatatgtctatacccaaacaataacacacattacagttgatgataatctaggcattgaaaggtattatagcaaggattgaaacggtctgctccctgggatgcactttcctcaagatccccttgagttgtatatctggatggcaatttaatatcagttttgtgttagcrcagttgtgtatcaaatgttttttgcagtgtctaagtcaaaaatatggtggtgcacgtcctatcccattgacctcacttcactatgctgaagttttatctatggtcagtggagtactttgtactcttcagagtgatggccagtaattccaaaagcctaaggttttctgaatgatctactctcattatctctgcatattttgaaaaagtttatatttattatcttctgacctatctaaccctaattcatatattctctctgcctaaaatcatctcttccctgcctgcctacctcaccaactc

SEQ ID NO: 183399 - DNA, 601 bp, Human
ttagcaagtcatattttttggagcatcattccatgcttgatctcattttatcatctcaactacttttagcatataagtgaattagaaagcaaaagccagaggtcatacaactagtttctaccagcagcactgtcatgggaactcctagatctatttactcttagcatgtcatcattatgcaatgatattactcccttaccagcaatattggcagtgctcttttttcaaagcagaggcacttaaaatggttagaatagttggttttggttttcaaattgactacagggttattatattttgwtgaacagttttctgcacagaatattctgagacttcacctctaaatattaaatcacaggttccaatattctcatttgaaaattgagaacctaattgaaaattgagaacaacttgttattaatacaccttttctagttgtattcttttcaaaattttttggaatttttggtaataggtctaatatgaaagtgtaaattaaagttcttattgcttttctggctacttttttttttcagttatgctaactgctctcttgccttcctctattcagttacttaggtaattttactataaggttttt

SEQ ID NO: 183400 - DNA, 601 bp, Human
aatggacctaggagacatttacagagctttcaacctcaaaaaccacaaaatatacattattctcatcagagtatagaacattcttcaaggtagaccatatattaggctacaaaagaagtctcagtaaatttttgaaaatcaagatcacatcaagtatcctctttgagcacagtggaataaaaccagaaatcaattccaaaaggaattctcaaaactacacaaatatatgggaattaaacagcctgttcctgaatgatcagtatgacaaaattaagatggaaatttaaaaaaattttgaaayaaatgaaaatgaagacacaacataccaaaacctctgggacagagcaaaagcagcgctaagaagaaagtttatagcattaaatgcctacatcaaaagaatagatcacaaattaataacctaatgttgcacttaaaggaaccacaaaaacaagaataaactgaacccaaagctagcagaagaaaagaagtaacaagtcagtacagaactaaaataaattgaaacaaacaaaaaaaatcaatgaaacaaaaagttctgttaaaaaaagataaagaaaattcatagactgctcaataggctaac

SEQ ID NO: 183401 - DNA, 601 bp, Human
acagaaatacaaaagatcatcagagactaaacaacactatgctcacaaactagaaaacctagaggaaatggatacatttctaaaaacatacaacctcccaagattgaaccaggaagaaatagaaatccagaacagtaataaaaatctcccaaaagcaacaaaaaaagcccaggaccatatggtttccagctaaattccaccagatatacaaagaagaactggtacctggcttaccaaaactgttacaaaaagacaaggaggagggaatcctccctaacgtattctgcaaagccagtaacaycctgatgtcaaaaccaggcaaggacacaacaaaaaaagaaaactatagaccaatatctttgatgaagatagatgcagaaatcttcaacaaaatactatgaaacagaatccaacagcacatgaaaaataaataaattaacaccacctgcagaggaggctgaggaagatggatgaatagacccctccagcaatcatccccacctatacaaacaccaaattgaacaactatccacacaagaaagcaccttcataagaaccagaagttaggtgagcaaatcacagtacctggttttaacatcac

SEQ ID NO: 183402 - DNA, 601 bp, Human
cttaggggagggagagcgcagtaattgtggggcattgcattggagctctgtgctgccctgtcacagtggaaagcaacacagggcagaattcagccagcacccatggaaggaacatttagaccagccctatagctagggggaaccatccattccagcctttggaacctgagttccagctagccccaccagcaaggctacagtgctttgaggtcctaaagaaatcagaaaggcagtctaggccacaagtagtgtgattcctggacaaatccttgtgctgtgctgggcttggagccagtggacytgaggtacatgtgacccactgagacaccacctgtggtggccagggaggtgttcgcgtcaccccaccccaaccctatgcatcacagtttgcagctcccgcagagactccatccttggtctgaggagagaagaatgggagagtgaagaagactttgttttgcaatttggatacagctcagccacagtaaaataaagcaccatgctgagtcctaaagcccccattccaggccctggctcctggatgatattttttacttaattttttttttatttcaatagatttttagagagcgggtggtgt

SEQ ID NO: 183403 - DNA, 601 bp, Human
acagtggaaagcaacacagggcagaattcagccagcacccatggaaggaacatttagaccagccctatagctagggggaaccatccattccagcctttggaacctgagttccagctagccccaccagcaaggctacagtgctttgaggtcctaaagaaatcagaaaggcagtctaggccacaagtagtgtgattcctggacaaatccttgtgctgtgctgggcttggagccagtggacttgaggtacatgtgacccactgagacaccacctgtggtggccagggaggtgttcgcgtcaccscaccccaaccctatgcatcacagtttgcagctcccgcagagactccatccttggtctgaggagagaagaatgggagagtgaagaagactttgttttgcaatttggatacagctcagccacagtaaaataaagcaccatgctgagtcctaaagcccccattccaggccctggctcctggatgatattttttacttaattttttttttatttcaatagatttttagagagcgggtggtgttaggttacatgaataagttatttagtggtggtttctgagattttggcgcgtaccgccctgaa

SEQ ID NO: 183404 - DNA, 601 bp, Human
aaacaactaaacaagaaaaaaaaaaaacaaccccattaaaaaagcagacaaaggacatagacatttttcaaaagaagacatacaaatggccaaaaagcatatgaaaaaaaaaatgttctctaatcatcagagatgtgaagattaaaaccaaaacacaataccatcttacaagagtcaggatggctatagttaaaaagtcaaaaaattacaggtgttggtaagaatgcagagaaaatgggaatgtaaactagtacaaccattatggaaaacatttgaacatttgtcaaagaattaaaaataraactctcattttatacagcagtcccactactggatatttacccaaaggaaaagaaataatgtataaagatacctgcactcatatgtttatcgcaatgctatttataatagcaaagcattggaataaacctacgcgtccatcaatggatgattggataaagaaaatatagtgttatataccatggaacactactcagccataaaaaagaatgcaatcatttattttgcaacaacatggatagaactggaggccattatcttaattgaaataactcagaaacagaaagtcaaataccacacg

SEQ ID NO: 183405 - DNA, 601 bp, Human
taaccagtttttcttttaagtatcatatacatatatagttttctctattacctctttcttttacaatacttgaagacttctgtttatgtcacctattgcctaattttattaacttagattagaatttatgatcatttgatttgttgatgtgcagtaacctacactttctgtttgtaaccttgatgtatgcattaaacaaaattttttataatttagtagtttaaagcctcataatatacagttatttatataattaggaaaaaattcatcaagtaattatgaacggttttcacaaatgaartgtaatgtgttccaccctttgttaactaggaaaagtagcacaaatcctgttttttttctactttgaatacctagtttattggcacagaaaagatcaaattatatatcttttgaataaatgttggtttacagtgtccaaaatatttcttctcacatctactcttcttttctagccttcccttcagaaacttcttgttcttggctttctgatttcttactgactactcttctcctggatattttggctcatggaccttcaagtcatcatttcttcctttcagttattcctttaccgctacct

SEQ ID NO: 183406 - DNA, 601 bp, Human
tttcccttttgtgttttaaccaataaatacataggtccaatgaacaaaataagtaataaaatattggctttaatactcaaaattaggggttccctcttaaactgttagtagatgtgactttgtactgtgttaaatgagccatttgatccctttcatgcctcggggattggaagagagaggtctgcttagtagatacttaaaccagatagctgtgtaagaatagctttgcaaacttagttgatagtagaaagcaggagagagtcctgaaaaagaggtacctggatgatgtgttcaagcacargtggtcaaagagaaggaaataggagacagagttgagtattgcgggaagtcagggaccccaaatggagggaccggctgaagccatggcagaagaacgtagattgtgaagatttcatggacatttattagttccccaaattaatacttttgtaatttcttatgcctgtctttactgcaatctctaaacataaattgtaaagatttcatggacacttatcacttccccagtcaatacccttgtgatttcctatgcctgtctttactttaatctctcaatcctgtcaactgaggaggatgtata

SEQ ID NO: 183407 - DNA, 601 bp, Human
ttgtaatttcttatgcctgtctttactgcaatctctaaacataaattgtaaagatttcatggacacttatcacttccccagtcaatacccttgtgatttcctatgcctgtctttactttaatctctcaatcctgtcaactgaggaggatgtatatcgcctcaggaccctgtaataatttcattaactgcacaaattgtacagcatgtgtgtttgagcaatatgaaatgtgggctccttaaaaaaagaacaggataacagcaattgttcagggaataagagagataaccttaaactctgacygccggtgagccgggcggaacagagccatatttctcttctttcaaaagcaaatgggagaaatatcgctgaattctttttctcagcatggaacatccctgagaaagagaatgtgcacctgggggtaggtctctaacctggccccccgggcgtttagtctcaactcttatggtcgagactgcagagatgaaatagactccagtctcccatagcgctcccaggcttattaggaagaggaaattcccgcctaataaattttggtcagacgggttgatctcaaaaccctgtctcctgataagatgt

SEQ ID NO: 183408 - DNA, 601 bp, Human
ctcttctcagtttgctgcatgtttatgtgctaaatttaatgatttttaactctaatcccagagatgcctaagatccaaggagcctcattggggatgaaggacagttggcacagatggcacactgaagactccctgtaccctctttaaccaaaaagtttctgctcgtacagattttatataatgggattttatgtgagataatttggagagagttccataacttaaaaaagtgtttgagaaatgttgctctctaataataataccaactcatgtgttactcagtcaaatgaaatactgttasttgcatttttgttttatatgtatatgttttgtctcataaattacactggaagctccttgaaattagttatctttcttttccccaatggggaaggattctagatagaatcaacaaacctagaatctggggacctgcaatattctttactagtgatacccttggacctgagactaaatatttgatagctcccttcttctgtgtccttatctgaaaagtagtaatgaggtattaaattcttcagatgaaagagtgattaggcctttgtattgaagtgcagtgccaagcaaaggggatgtattc

SEQ ID NO: 183409 - DNA, 601 bp, Human
aaaaacaaggctgctgagtggaatactgaactgagaataaagtgcctttgtcaccatagagccccgttgttctttaagcattttgttaaaagagtgaatgaatggagcaggatagcacaatattttttctgtgtgcggtacaagggtagagctgtggttttcttgagtcactgagacagaaagaagaaaaacttaaaaagaaacaaaactcttttctggctaaaaggtactttatacatatatacccgtgatgtcgctaggataaaaataactttgcccaattcctgaaaaggaattctaytgggtagaatcaacaaacctggaatctgggggcatacaatataatttaccagtgatatccttgggcctgaaactaaacatctgatagctccctgcttctgtttccttatctgaaaagtagtaatgaagtaccctcatcagatgaaagtgattagacctttatattgaagtgcggtgacaacatatggtgaaatcctgaccatgagatccagtaaaagaaacaaaagatactcagcatttcaggctttgtatagtcagtgagtaaataaacaaagaaacaaaccaaagagtattccctaag

SEQ ID NO: 183410 - DNA, 601 bp, Human
agacagaaagaagaaaaacttaaaaagaaacaaaactcttttctggctaaaaggtactttatacatatatacccgtgatgtcgctaggataaaaataactttgcccaattcctgaaaaggaattctactgggtagaatcaacaaacctggaatctgggggcatacaatataatttaccagtgatatccttgggcctgaaactaaacatctgatagctccctgcttctgtttccttatctgaaaagtagtaatgaagtaccctcatcagatgaaagtgattagacctttatattgaagtgcrgtgacaacatatggtgaaatcctgaccatgagatccagtaaaagaaacaaaagatactcagcatttcaggctttgtatagtcagtgagtaaataaacaaagaaacaaaccaaagagtattccctaagaacctagatgtagtgtcttaggaactgggccacctactgaggatagaacgatgaataaaccaaggcttttgtccttgagaaagtcacagagaggaagcaggcctataaacaggcaaatcacaatatggtttgataagtagtgtctgtgaatggatttgataagcaggtatgtt

SEQ ID NO: 183411 - DNA, 601 bp, Human
taaagttttaagaggcaggtaggatccagaagttgaagatccaggcagaaatttaagtctctgagacagtattaaagttaagtattaaaaattgctgttcaccacaaaagctgaaccacctctatgctaggatgtggtaacagagcctaaagaagttgcattgttggtggtctggccagacctgaaatcccacatgtcaggctataatataaagagctaaacaggattcagaaatcaagataagcaagaatcctttgatcaggaatccagatgtcagttagtccaaggaatcagtaacaayacagtaattcctgctacccactgaagcctgatataataagcacctggcatgtgccccttcctcttgaggatcactgcccaaattcagaccctcactgtatctcacctgggctgttgcaattgcttccttattggagtcaaatcactgaatactaataacattcagttttgtgaatatgcagtctctgccttccttccgtatgcgccttgaagtgccctgcttttccacactggacttgctccttttatgtatttgtacttgcccctatgtcttggttcaaataattgacttgttacactt

SEQ ID NO: 183412 - DNA, 601 bp, Human
ttcagcttgatgttagagtaatagggagtggtaagggtcatggcaaacaataacataccttctctaaggaagcagccatttagatccgattattgaaaagtggaaaatcactcccaatgttatcacaattttcaaatttttaatttttaatttatattattttattttactttatttaatttttttagagtcagggtcttgctctgttgcccaggctggggtgcagtggcccattcgtaactcacagcaaccccgaactcctaggctcaagtgatcatccagccttagccttccaagtagstaggactgcaggacacaccaccaggcctggctaacattttttttctttgtagagacaggatcttgctatgttacccaggctggcaaatttttttaagccagaatatgaaatcatttttttatgtctactctattcattttaatgatggtaactaattgaaattaaaatattttgcttagcaaataaaatatatcagtgaggtaaatttggcgtgagagttgccagtttgtaggtcctgagagagtgagccttctgcaaggtaagtgcatgaattttagcatctaatttgaatacatttta

SEQ ID NO: 183413 - DNA, 601 bp, Human
aaagaaagaaagaaagaaagaaaaaggcagctttaggagagatttttaatgttcaaggctttatgagagaaattaggatgaaaagttataaatgtgttaatgcatgcacaaaagtaacagctcatacaaactgagtagtccttattttggactttcagcctctagcatgctctttctagaaaggaataaaaggattttgtgcagtgtcccaggtaccatatcaacagatacgtgaattaagcaatcactgacatacaaatacattaggagagaaaaactgttataagatttaacaagtagrtaagttcatctatcaggtaaacatcctgagatataagtataaaagctacaggcagcacagtggctcacgcctgtaatctcagcacttttagaggtcaacgcgggtgaattgcttgagtccaggagttggagaccagcctgggcaacatggcaaaaccccgtctctactaaaaatacaaaaattatccggcatggtggtgtgcgcctgtggtcctagctactcaggaggctgagatgggagaatctcctgagcccaggaagttgaggctgcagtgagccgtgatcacaccactgcactcca

SEQ ID NO: 183414 - DNA, 601 bp, Human
ttgggtcccattagctatggcagtatagtcattaaatgaggctgttgccaatgattcagaaatgtggtaatggaattgagttctcactgacccattgggatgagtttaaaactgtttatgattcttactacttaacaataataaaactgccttcctcataggacatttctgataattaaatcagagactacatgtaaaattcctagcatgatgcctaatagaaacaggccttcttctttatcagtctgaccttaaagagagtaaagcccttcaactatgaaagccccagcttttgtagctycagatcatcacactgggcagtgtggcctctcaaatttgtctcactcctcagtgttatacagtacatgctgttcatttgcatttgtgtgtgtagttaatacatggctctgcaatgtcagcattttctgcagtatttgtctcagttgtaagtagatatcatttgctttccatgccagtgggctttttgtgggtttggttttgttaagcttttatgagcatcacatatctctgtgagaacctgttgaaagctgtgaacactatcccctgagaaatgtgcatataaatatacacatttttgtgt

SEQ ID NO: 183415 - DNA, 601 bp, Human
gctgtattatcagactttgccagtagatacctttgtctgtcccagtgtattattcttccctaaaaatactttgttatattcaggtacttctactctaataccatatttgtgttgctgaaaaactttgcattccacaaaatcacacaataagaataatagagatcatatgggggaagagggctagggacagatcgttcaaaaccaatggaactttgtaaccagagcaatcctaataaaaagaataacatggttaagtctccactggattcgcatccagaatcagtccagttaagtaatcccmataaaaaaagcgtaatatggttaattcttcactggatttgcacccacaatcgtagtccagttgattctttgcatccttgaattctaggattcatgcttccttcttcaaaatgtaggtccttgggggcacttacatcaaattgaggtcagtttcatcaaaattaaatatctaaccctgggtatagacctctgtcagtcaggtgtttttaaaacccaggaagaaatgcctttgagggatcttcatcctcattcttggctttcttgaaaatgtccctatttgctataaggaaggacttagaat

SEQ ID NO: 183416 - DNA, 601 bp, Human
agagcaatcctaataaaaagaataacatggttaagtctccactggattcgcatccagaatcagtccagttaagtaatcccaataaaaaaagcgtaatatggttaattcttcactggatttgcacccacaatcgtagtccagttgattctttgcatccttgaattctaggattcatgcttccttcttcaaaatgtaggtccttgggggcacttacatcaaattgaggtcagtttcatcaaaattaaatatctaaccctgggtatagacctctgtcagtcaggtgtttttaaaacccaggaakaaatgcctttgagggatcttcatcctcattcttggctttcttgaaaatgtccctatttgctataaggaaggacttagaattttcaggagttgtgttaaagatctgtatgtattgctgaggcttgcttttaataatgagaaagctcggccctgattgattcaaaccactgttgtgctggcaaaaatacatatgaaccaatacaacttatattgtattctgacattattctttaatttatcaaatatatatgagcagactcaaaggaacatatattaataaagactgtagtctaattatgtt

SEQ ID NO: 183417 - DNA, 601 bp, Human
tgagtatcagctaagacttgcctaatttaagaaagtttctatctcatatactagaactaaaagacaatttattagttttcattttcaaatcgagtcttgctttatagcaattatatattaatatatagtatgagatatatatatatatatatcttgttagaaaagtttgagaaattcacatgttcaaaaataagaatttaaatgagtggttatatggtactttcaaaagtttattttttattaattttcattttgcctttgttttttgagatagggttttgctctgtcacccaggctggcrtgaggtgacacgatcacagctcactgaagcctcaacctcccgggcccaagcaatcctctcacctcagcctcccaagtagctgggaccacaagtgtgtgccaccatgcccagctgattttttattttttgtaaagactgagtcttgccatgttacccaagccagttttgagctcctgggctcaagtgatcctcctgcatcagcctttcaacatgctgtgattagaagcatgagccacagcaccctgcctttattaacttttataggcctaaaaagaatcattctttatctgttccataaaa

SEQ ID NO: 183418 - DNA, 601 bp, Human
cacaggccaataaccaatcaaatctatctgtgtcagagtttaccttcccttcttttctatctcttcctctatagaaccaaataaataaaagcacttaccagtcactttgttcccattcttgccaaaaagccttttgtttgtcagtgtcttttgttacattggccatcctgttcagatcactagcttgtttgcaatgggttattctggttaattagatttaccagaaccaagattaggattttaatgtcttttttgcttattttcccctttactgttgaaaaatcatcctacatttatattyccaaatccctaatgtctgctccttctactggtagtaaggaaataacattgagaatttagttcctattagtatctgcctcttaaaacacagtatacacccagccttgaattctacttagagccccagcattcctagtcctggccctatcaaagtaagaactcgtagtagtcttaatttgaatgctctgaagtatcttcagtagtgcacagtaaaagcagtagagaaaatgaaatgtctttgatgtgaaagagtatgtaaagtaagcatataacatatagtatggtccttcatccttcattt

SEQ ID NO: 183419 - DNA, 601 bp, Human
gctttgctgacataagagggaaaggagcttcatcagtgttgtattgtcaaccatgtaattcacccatagtatggataggaaatcaagccatttctacaaagaggtccacctcaagtctaccagatggtttgttgctgagtccattttttagtagctcctgaactcattgagagttttctagacaaaaagaatagatttggaaataaccaacttcccggcccatcgtgggggaatctgatggatggatggatagtaccttgggaatgtataagaaagaaatgtctgggtatttctagaaagrttggacatgttaatagctttaatattttggtaggatagttgccaaatattcttattcaacccctgcgtgtctcatctttgctattgcttatgcttgcttataaattgaacaaatgggcttccctagaaactgtcggatgacaaaagatgctacaaagcttaacacctaaaacagagttttctttatagaatgagaatgtaaaaataaaaatttggacggggagcaaaagacttgttttccctgagtctatgtggaaaaatttgttgccttttctcaaataaatttttgttgtagacagga

SEQ ID NO: 183420 - DNA, 601 bp, Human
aacaatgcctggcacaaaataaatacacaatgattatattagtcatagtggggtagcaggttaattcagtgtacatgccaggtaaataaagacaactaggacttactttgccttctaagggctaacagcctgaagtggggcaaagaagatgaagagataaacaaattactccatatgatcaatgctgttataattttgagcaaggtgccaaaaaatcatttgggaatcagagaaaactttaaaatcttcttatctaaaaatgttatattaaaacttattttctggctgggtgccgtggctmacgcctataatcccagcactttgggaggccaaggcaggaggctcacttaaggtcaggaattggagaccagccaggccagcgaaacctggtctctactgaaaatacaaaaattagcagggtgtagtggcaggcacctgtaatcccagctactcggaaggctgacacaggagactcgcttgaacctgggaggcggaggttgcagtgagctgagattgtgcccctgcactctagcctgggcaacagagtgagactctgttacatactaactcaagcccccaaatacaacttaatacctcgcaa

SEQ ID NO: 183421 - DNA, 601 bp, Human
gaatatttaggtccattctcttaggaacaatttgaaaaaagagaaactgagcattagacatacaaaagggaaaaacaagtgaaccacagaggaataatagactgcaataaaaccttgggaaaaaataaagaaaattatggagatgaactgtactctagtgatttttggacaatgtgggctactgatatttgcataagaattgctatggggtattagggagactggaggacattgtcagagtacatataaatacaaagtagcttataaatgtatatatataacttcacagcaccaaatatamatactaaagaagaaacagttggagaaatgccatttggtacagggagcagaacagcatagtgtttgagtttaggctcaactcagaatgtttaggctactgactaacattgtgactttgggaacttagttaagttttctaaatcttgattctctcatctggaagattggattatggtagtactactgaataagatagttagaattaattaggaaaatgtcctaacacaccttgcaggtaatttgcaaatagcaagtagctgataaatgttagttgtgctgttgattattattaataccatag

SEQ ID NO: 183422 - DNA, 601 bp, Human
ttctcctacctcagcctcccaagtagctaggactacaggtgtgcaccaccacgcccagcttatttttgtatttttttagtagagacacggtttcaccatgctggccaggatggtcttgatctcttgaccttgtgatctgcccgcctctgcctcccaaagtgctgggattacaggcttgagccaccacacttacataattcttaagccatggtcaccagtgtaccagtgactgattcaattaattcataaattaagaatgcctttaaaaagaagataaagtaagaaaaaaaaaataggaaattttttttttttttttttggaatgatgtctagccctgtcacccaggctagagtgcagtggcgccatctcagcttactgcaaccttcacttcccaggttcaagcaagtctcctgcctcagcctcccgagtagttgggatgacaggcacacactaccacacttggctaattttttgtatttttagtagagacggggttttaccatgttggccaggctggtctcaaactcctaacctcatgatccgcccacctcggcctcccaaagctctgggattacagatgtgagccaccgcacttacataa

SEQ ID NO: 183423 - DNA, 601 bp, Human
gagacatagactttacacatacttcagctcttaaagatgctgtagaagatgttaggaagaggaataatatagccaggaaaaatgtttaccacatcacatatgtctagtgatcgagcagtcatctatttgttcacagaagcctgaattgtaatgcatacttgtgtaataggcaaatgataaacataagtcaacatagaaaattgccatgagggccacccagcacatactgtgtctacccagcgtgagagctttgttcttgtttgtgacaaataatcagaaacaggaaagagtttgcagatgygacaggaagcaacttaacagacaggcctggcatcatctgtcgccttaatgtataccatttattcccttggtgtgatgattcttagccataggtcacaattgagccttagaaccttaacccagagtgttgcagccttcccccttgcaagtaccccgggaattgctgccattggccagtgtccaagaagaaggcttgaacagctgccctgacaaatgggtttcccccattcaagcaagcaaatgaggggtttgagctgctttgcaatactccctgcctctgggctacaaacactgtttaaaa

SEQ ID NO: 183424 - DNA, 601 bp, Human
gttaattgaatgatatatattgccaactgctaaaataaactaattccctacatgctctcataggacatactctctgctcctcattatcatttgttattctttattctcattaaaatatatgtgtgtgtatgtctttattctcagagtattctgggagctttcttatatgcaacccagttatatgtggtgagatctgttgattttgtttcagacacttcttaggctagagatcttctaattcatactcaaccattgaaagaaatactacataggttattctttcctaaggcttctattagtyagcttttctttaatatgaaacctttatttttctttttgagtcctggctggagtgcagtggcacgaccttggctcagtacaacctccacctccctggctcaagcaatccttccacctcagcctccccaagtagctgggactacaggcatgcaccactacgcctggctaattttttttttttcttatactttaagttttagggtacatgtgcacattgtgcaggttagttacacacgtatacatgtgccatgctggtgcgctgcacctaattttttatgtttttaaatttttatggtttcac

SEQ ID NO: 183425 - DNA, 601 bp, Human
tcctgttacctctgtagtggaacttctctgcaccctttccttgcctagttaagcagttccaaaacagccccaaacagttggtgtcaattttcagcccttaggtagcaacttaggagcagttcagactgagggctactgttaagtagtatgcctttcggaaggggaaaacattctcttcctcttcagacttcatttctgtacttctggttctgccttgtcaaaaagcattctatgtgacctcattggtctctgaggggaaaaaaatgcttcaactctctattacaactttaattataggggmtctttcctgtccctgccttcccttttctgcatttcttgtaccgattcgtccccacatgacactagaggaactgtgttgtagaagattgagtttggccttggagccagagagacaaagttcacatctcaattctaacattttaattgaccttgggcaagtaaggactcattaaatggtagctgctaataattgtcattattgtcactatcatcattcttctcttctaccactttagccacctatatgtgccctctgacgctattaatataactattttgtctttttcatcaaatgtttgct

SEQ ID NO: 183426 - DNA, 601 bp, Human
agtggaacttctctgcaccctttccttgcctagttaagcagttccaaaacagccccaaacagttggtgtcaattttcagcccttaggtagcaacttaggagcagttcagactgagggctactgttaagtagtatgcctttcggaaggggaaaacattctcttcctcttcagacttcatttctgtacttctggttctgccttgtcaaaaagcattctatgtgacctcattggtctctgaggggaaaaaaatgcttcaactctctattacaactttaattataggggctctttcctgtccctrccttcccttttctgcatttcttgtaccgattcgtccccacatgacactagaggaactgtgttgtagaagattgagtttggccttggagccagagagacaaagttcacatctcaattctaacattttaattgaccttgggcaagtaaggactcattaaatggtagctgctaataattgtcattattgtcactatcatcattcttctcttctaccactttagccacctatatgtgccctctgacgctattaatataactattttgtctttttcatcaaatgtttgctgaaatgttgttgttg

SEQ ID NO: 183427 - DNA, 601 bp, Human
aagattgagtttggccttggagccagagagacaaagttcacatctcaattctaacattttaattgaccttgggcaagtaaggactcattaaatggtagctgctaataattgtcattattgtcactatcatcattcttctcttctaccactttagccacctatatgtgccctctgacgctattaatataactattttgtctttttcatcaaatgtttgctgaaatgttgttgttgtttttgttgtgtgtctcattatttccctgggataaatataaattattcactaccttagtcttattttaatatgttactttttcttatagtaataactgtcatatatattaaacacccagaattttggacagcgtgctttacatgcattattctatttaattatcaacaatttattttgcacatgaataaactgagtttcagaaagattaaataactttaagttcaggttcatacctttgaattcaaagtccttgcttctctattcaccattgcctccggggtggtaattaatacattaactatgatactttgaccactgtcttaatttaaaaagcaaaactgcttctagcataagatctgtgcagat

SEQ ID NO: 183428 - DNA, 601 bp, Human
taaaaaaaagtcattggccaggcacagtggctctcacctgtaatcccagcactttgggagtccaagacgggcagattgcttgagctcacaagttcaagactagcctgggcaacatggcaaaaccccatctctacaaaaaaaataggaaaattagttgggcatggtggtgcgtgcctatagtcccagctactcgggaggctgaggtggggaggatgtcttcagcccaggaggcagaggttgcagagagctgagatcactccactgcactccagcctgggcaatagagccagatcttatctcaaaaaaaaaaaaaaaaagtcattaataattcaaagagcagtctgttcacgaggatccaagctcttgcctggtcatctgttccacatggtttcacacagatacttttctaagactgtgaacattttccaaagtaaagtagtctgtgtattcaaggagttatcactgcctttcaacaggctctagacccaaaatggaactaattatatagggctgaccactagtctccgttttgtctagaggataccatccagatagtcctcaatggagtggcaaccaggactgacgatccactccttggtgt

SEQ ID NO: 183429 - DNA, 601 bp, Human
ttttgcctaacttgaataaagctaaaacagttctatgccaaagagatcctaatagacacacacatctgtattttttaagaaataagtccttctggggaaaaaatggttaatatctgttttcttatttgttttcctaatctctcaacagaagaacaagagaattattttttgttatgtgacgttttaccagaagatagaattcttagagaagagcttcagaaacagagactggtaagaattgtttttaaagggtgaatagtgtcttgaaaatacatataaatacatataaaatcatattggttttttttttttttactttttgttatggaaactttcaaacatatgtaaaagaggagacaatacaaaaaggtcttaaaacaaaaaaaaagtatacacttgactgaaaattaaagcgttttatgttaaaaatgcagagagaatttttggctttgttttgcttcctggattatctctaaaataacaacagaacttacacattttagtgtaattttagctgcctgacacatgctagggttcagtagtcatggaaaaatgccctcagctaaaattgagttgaattgattaacctttttttctcccc

SEQ ID NO: 183430 - DNA, 601 bp, Human
ataatgctgtgtcttaacaatgagaaggatttggatagttaagagagttgtagggaagggaagaaagatacatatgcatctaaatgttcaaggtgtattcaggaaaatcgagtaaaagtctactccggcttagatagaaaaatttttatggggaggagtatgagataaatttgaagaggtaaaatggagctaaattgtggaaatccttcagtgccagaaacttgactttgtagtaataaagacccattaatgtgccctcattgtccatcagtgacatgaagaaaagagtaaatgtagctgygtataaatccatttcaagctgtcaaagcctgagaaagactagaccaacttggggattggaagtaagctaacaatgactgatgaccatccataagccatgccttgtatttggttcttgcttcatagcaccctgtgaggtggctattaaatgccgttctatttatgagtaaaatgtggcctaggaagcttaatttgcccaggaacacatagtgaatgaggtgcagagctagagtttcaaaccaaacattccaggtacatgccttttaagccatgccatgccagcgtagtcattatttggcct

SEQ ID NO: 183431 - DNA, 601 bp, Human
cttgacacttctttgaatattttcatccatattctgaaagaaactacagaattaggaagattctcgaggatttcaatagcttgaacaccttcttccctttagcttcctttaaaaattctcccgtgatcttggtgcatcatcctcttatttctcatcagtctagcttagtcttgtccagtggttcttttccctcttttctcttaaatgtgtatacatatgtttctcaagatcttatcacctgttcagggcatgcacatctgtataactaccactattaggcctatggcttaaatgttagtgytggtgcagagtaggcagtcagagtaaatattcatgaattgagttcatccatagctttcatcctggttcacttctgagccccaaatctatatttccttatgtgaaacttttccatttggatttccagtccacactttaatatgcctaaaaacagaacttatttttttcctcccccaaaacttgctatttgcctgttctccttttattacataatgacaccaccattctcctggtcactcagtttggaaatctctagaagcatatttaattgattctttttttctcacccctatatctaagt

SEQ ID NO: 183432 - DNA, 601 bp, Human
atattattctgagtcctaaggttcaccactttgagcatcttcaacaaggacttaaaatttacaggacaatttgtatatatactggttgagtgagatcaggcaggaaatattacccctgtttaacaggaaatgcaaggtcaaggacagtaagaaacatgcacacaaccgtggttatatacagtgttaaatagaaagggaagcaattcaaactcctaaatttccaaccccaatcaccattctctttctaattgcaccaggatactttatcacatttgatctttctttctgagcaaataggcctttttttttttttttttgagacagagtgtcagtctgtcacccaggctggagtgctgtggcacaatcttggctcactgcaaccccacctcccagattcaagcaattctcatgcctcagcctcccgaggagtagctgggatcacaggtgtatgccaccacacccagctaatttttatatttttagtagagacagggtttaaccatgttggccaggctgatctcaaactcctgacctcaagtgatccacctgccttggcctcccaaagtgctgggattacaggtgtgagccactgtgtccagcc

SEQ ID NO: 183433 - DNA, 601 bp, Human
tggcagacagaacaagaggagttggtgttatgtctttagccagcctcactttgaaacaatttgaaaactctttcagtaacttagacattgttcacttattcacatcatgtaactagtaattaaaattatccaatactttcaaatttatttagaataaaaattcagactttttaccaagatctcaaaggatctggcacatgcctctctgagccactctcccacgtctctctcacccactttctcctgtgcttactgtactccagctacactggctatgtctgtgttcctcaaacacaccaakctgtttccagctttaaggacttcgcacttgctgtttgctgtgcttggaatgctcttctctagaatctcatgagctgggcccagtggctcatgcctgtaatcccagcactttgggaggctgaggcgagagaatcgcttgaactcaggagaccaggctcggtaacaaagcaagactccattccttaaaaataataataataataataagctcatggctttttttgaaggggaagggaagagtttttggggaagatgagcctctggaatggtactacaggcaaatgaatgctttggaagtgct

SEQ ID NO: 183434 - DNA, 601 bp, Human
taggtctcctcatctaccttcttttccagccacctttctatcaggttgtttccagacctgacctatcctgtcttttaaaagaaaaggcctccattttcataaattttaagtattttaaatatttaattttttaatatttaaatcttttaacaccaaatacatgcctataactttattttgaatgttctaaggcaagtgcattgcagaacttgcttggcaaactgcaggttaggttctctcaggcctgtccttacatccagctcttacaccccagaacactaatacacactcagataccgtygagaagaaaaactcaggaataattatattatttctcaacattttttactccatccccagcagtagccaacatctactttgcagtgcaggatttgggtccttctcccagcagcttatggcctttgctttgtgtgctaaagaatggtccccagaagcaagctggggttcgtgcctgttcaccatcaaagggcttttgttcatgtctctttgccctattcctagtctttctcctgagaacttggaggaagcccatggggggagttggaccccttgtgtctaggactctcagggattttgcctt

SEQ ID NO: 183435 - DNA, 601 bp, Human
ccccaacccactaatcacattgttggtcttttctggcatggccagttcccatcctgagtcatgtcatttatataaactatcaggtgtggtcaaagggcccaccatgaataacacagaccctccagtcactcaggaaattctcagggttaataagttatctcctaggaacagacaacaagggccatccgaattctccacacaaaccctttacctggtgtgtttcccttgtctgccaaagctgagagccacatttagggcctacctttaggttaggtttgagagagagagagagagagagagwgtgtgtgtgtgtgtatgtattttattttttatttgcaatgtaggtgccaccctacttttttctttcttcttttactcccatttctatgctacattgttctgtagcagcttgaaacatttattagaacaaagtggaggtataagtgaaataatcccagatacctcagagttaatccatggttcttaaaataaaaagcaggagaaataggaaattctgctgcctttctgtggagactttgggccactgctataattttcatgaggagatttgttgtgttctatattggaggagtgccactgg

SEQ ID NO: 183436 - DNA, 601 bp, Human
acagaatttaaaactgttttgttttctcacatcctatcaaggtaacagcaataggaataaaggtgctagggcatagtgatatatgactgtcttctacctagactcctattaactactggaggttttgaagaaatagaagccatgggaaacacagcaactccattcaacagttattgtgcaccctgtctataatgcccaggggagattacaaagatgaataaaacatttctgccttcagtgggcttattatctggtagactacattttgagttgattacatagagatgataacattaacaaygttttcctatcagtcattcatatactttggaagactattagtttggaaaaaaaaattttttctatgcatcagagcttgagtcctaggcagatgaattattttgtaatttaagatttagacgtagaatacctcacaaccaaatgaaatgtgtgaacctagggtggtcttgagtagaggttagggaggaacattaaaagacattcttggggtaattgaataaatctaagtattatctggacactacaagctattttaaatttactgttgattttcttacttgtgatgataatggttttgtgg

SEQ ID NO: 183437 - DNA, 601 bp, Human
gtcaaaagtatatgttatatctttgttgttattttaagaaatttacaaggcaaaagtactttgtagactaaactttattagagtggaaaggaggaaaaccttgatctcatatttcaattcttaatattttttaaaaaatgaaacaaaagtaattgtgttctataccaatgtacttcattttccttagctgttgggctttataattatcactaattcgtttccttattatgacttgcatcttctattttgctcaaaacgtcatgttagtaacaaactgtatttgtgcccttaaaaagtatgttttaaaatttttttttttttttcagactgggcctcgctgtcttgcccaggctggagtgcagtggtgtgatcacagctcactgcagcctcaagcttctgggctcaagcgatcgtcccacctcagtcagcctcctggatagctggactacaggcacgcaccaccatgcctggccaattgttttatttttagtaatgatgggggtctccctatgttgcccaggctgtgtttatagtattaaaagtaaaaatgattttttaacagtaaaaacctatccccaaatccctagtcctatagcaagta

SEQ ID NO: 183438 - DNA, 601 bp, Human
aaagtatatgttatatctttgttgttattttaagaaatttacaaggcaaaagtactttgtagactaaactttattagagtggaaaggaggaaaaccttgatctcatatttcaattcttaatattttttaaaaaatgaaacaaaagtaattgtgttctataccaatgtacttcattttccttagctgttgggctttataattatcactaattcgtttccttattatgacttgcatcttctattttgctcaaaacgtcatgttagtaacaaactgtatttgtgcccttaaaaagtatgttttwaaatttttttttttttttcagactgggcctcgctgtcttgcccaggctggagtgcagtggtgtgatcacagctcactgcagcctcaagcttctgggctcaagcgatcgtcccacctcagtcagcctcctggatagctggactacaggcacgcaccaccatgcctggccaattgttttatttttagtaatgatgggggtctccctatgttgcccaggctgtgtttatagtattaaaagtaaaaatgattttttaacagtaaaaacctatccccaaatccctagtcctatagcaagtaaaat

SEQ ID NO: 183439 - DNA, 601 bp, Human
gtatatgttatatctttgttgttattttaagaaatttacaaggcaaaagtactttgtagactaaactttattagagtggaaaggaggaaaaccttgatctcatatttcaattcttaatattttttaaaaaatgaaacaaaagtaattgtgttctataccaatgtacttcattttccttagctgttgggctttataattatcactaattcgtttccttattatgacttgcatcttctattttgctcaaaacgtcatgttagtaacaaactgtatttgtgcccttaaaaagtatgttttaaawtttttttttttttttcagactgggcctcgctgtcttgcccaggctggagtgcagtggtgtgatcacagctcactgcagcctcaagcttctgggctcaagcgatcgtcccacctcagtcagcctcctggatagctggactacaggcacgcaccaccatgcctggccaattgttttatttttagtaatgatgggggtctccctatgttgcccaggctgtgtttatagtattaaaagtaaaaatgattttttaacagtaaaaacctatccccaaatccctagtcctatagcaagtaaaattct

SEQ ID NO: 183440 - DNA, 601 bp, Human
tatatgttatatctttgttgttattttaagaaatttacaaggcaaaagtactttgtagactaaactttattagagtggaaaggaggaaaaccttgatctcatatttcaattcttaatattttttaaaaaatgaaacaaaagtaattgtgttctataccaatgtacttcattttccttagctgttgggctttataattatcactaattcgtttccttattatgacttgcatcttctattttgctcaaaacgtcatgttagtaacaaactgtatttgtgcccttaaaaagtatgttttaaaatttttttttttttttcagactgggcctcgctgtcttgcccaggctggagtgcagtggtgtgatcacagctcactgcagcctcaagcttctgggctcaagcgatcgtcccacctcagtcagcctcctggatagctggactacaggcacgcaccaccatgcctggccaattgttttatttttagtaatgatgggggtctccctatgttgcccaggctgtgtttatagtattaaaagtaaaaatgattttttaacagtaaaaacctatccccaaatccctagtcctatagcaagtaaaattcta

SEQ ID NO: 183441 - DNA, 601 bp, Human
cattctctttgtttaaacaaattatcaacttactgtcactgtgggaagctcttcattttactttataaatgaaatataaactacataataagtgccaaccatatgtcagtaagggataatcaagtgtgttataaacccctttcctttgagaaagccattttgattttcagtagagcacttagatttgtagtgtgtatgttgttgcacctcgggtataaatgtagtcatcatgtatttattgagaatctactataagaaattgtgtgcatgtggcatagaggaactcattttctgtgagtasagatggttgggacacagttttcctgaagaccaagcaatatagatgccaactgaatgctataaaactatggtaaaaaaggaagtatcacttctaatacaaaaacagtctgggaaagtcactttaatgatttgtagaatgtttcacaggcaatttagagatcatctgaaactgagtcctagagaagtggtatgcccaaggccacattaagagctacttcgtcacaaaaacaggacaagaatacagaacccctaagtgtcaggccattattctttccactcaccacaaagatacagcatttga

SEQ ID NO: 183442 - DNA, 601 bp, Human
acttgggatgctgaggtgggaagatcgcttgagcccacgaagtcgaggctgcagtgatccgtgatcatgccactgcactccagcctggctgacagagtgagactctgtctcaaaaaacaaaacaaaacaacctaggttggaatcaagtacagagtattgtgaatgccatgctaaatactggggattttattcagtagaaaacaaggatccattaaggtgttacttaagattttattgattaccagttttagttttatttccagatagtgtaattacgtatttgcagactaattttttaaargttcatttacagtgaaattttgtcttccatccctctgggcatgcatcagataaacatacttttaaaatatatgtatggggaaagtccttcctataaatccatccatctggtatctggtaagctcagtagatccaaattgaagagaactcaataataagaaacaaaccctaccagatgaaaataactcccccgacgctcatctgaggaagatattggaagctactttttcttaggtaccaaacatatttgagttaattttattcttagaatttgatgatctgtttttccttagctgagttt

SEQ ID NO: 183443 - DNA, 601 bp, Human
cctgtatcatatagaacaggttaaattatgtcttgaatttcgaatacagaaaaacatgagaattgtcttagaaaccgtcttgtgcaaaacttaaccaacttcaaatagcaaattaaaatgtctgtgacctagaaagtcttagaattcctctttttctaattaaactagaaataaggaataattatatttgcatatgttatctatgctgttattttagtgtgttctaagccccaaatgctgagtggctcatttgtattgaattcatctcaatgaggcttccgtgtgggtattttgtaagaargattttaatgctgcccgacctctccagatcactgtcccctggcttctgaagttgtttgttcactaaataagaaggtcattgttctaagctctgtatcgacatgtgctacaatgggtaccttctgagaaaaaattaaaagtgatatcatgaaaatagcaccaaatttggcaccaagtagctatgcagctttaaacaaatcccctaacatctcttacagggagtcagtagatagtttcatgagatccctttcagctgtcatgttgtaaaaagccagttctacacaatattggtcagaaagaa

SEQ ID NO: 183444 - DNA, 601 bp, Human
gggtttgttggtttttttcatatatttcttggctgtataagtgtcctcttttgagaagtgtctgtttatatcctttgcccactttttcatatgattgtttgtttttttcttgtaaatttgtgtaagttccttgtagattctggatattagccctttgtcagatggatagattgcaaaaattttctcccgttctgtaggttgcctgttcattctgatgatggtttcttttgcttgcagaagctttctagtttaattagatcccatttgtcaattttggcttttgttgccattgcttttggtrttttagtcatgaagtctttgcccttgcctatgtcctgaatggtattgcctaggttttcttctagggtttttatgctttagagtgttgatgggagtataaattagttcaaccattgtggaagacggtgtggcaattcctcaaggatcttgagccagaaataccatttgactcagcggtcccgttactgtgtatatacccaaatgattataaatcattctactataaagacacatgcacacatatgtttactgcaacactattcacaacagcgaagacttggaaccaacccaaatgcccatc

SEQ ID NO: 183445 - DNA, 601 bp, Human
cacatttataagtttagtgaaaactgattacaaacagtattaaaccaggacaaaaaatgagatcagagagcactatgtagggaaatatttgttcctaaagtatagggaaagaatatttgaaaggaaaagtacatgaaataatattttaagtaaaacttcatttcagcccaaaaggtattatgtatttatagttattacatgcttttaaggaccattgtgaatgtgaaaaaatataataccagtgctacttgatttacagtggggttacatctcaataaagtcattgtacatttaaaatatygtaagtcaaaaaaaatttaatatacctaacctaccttaggcatgctttgaacacttacattagcctacagataggcaaaattgcccaacacaaactgtactttataataaaggtttgaatatctgatgtaatttattgcatattgcactgaaagtaaaaaacaaaatagttgtatgggtactcaaagtacagttagttcattaataataaaattaagtttataaagaaaggagttgcaataataatttaaactgttatgcatttaatttcccataaattaaagcaagttgacattaggaa

SEQ ID NO: 183446 - DNA, 601 bp, Human
acctaaaatgaataaatatgaaactcaataataataaaggattattgcagcaactatacaagagacttgtttatcagtgtttgtgtatttcttgtagtttgcagtgcttgtactgtgagaagaccttcagggacaaaaatacacttaaagatcacatgaggaaaaaacagcatcgtaagattaatcctaagaacagagaatatgacagattttatgtcatcaattatttggtaaggctttcttttcataacttaaaatttgattgcagtactgcaaacaaaatctttctgaggaccaactratatttgaataagcaattattgcaaaagtcaaaatgtaattgaggggcacattcaagtagtgattagctttgaaatggttagagtacaagacatttgatttgacttgtcttttatttgacagtgtttatgtagtaaaaatgtcatgtctctagaactcacagtcatcttgaccaaaaaaaaaaaaaatacagcatttggatatccacataccatcccccatttatgtaatatcttttaacttggggccagagactcctttctttttttttttttttttttttttctttttttcttgagat

SEQ ID NO: 183447 - DNA, 601 bp, Human
ctcacagtcatcttgaccaaaaaaaaaaaaaatacagcatttggatatccacataccatcccccatttatgtaatatcttttaacttggggccagagactcctttctttttttttttttttttttttttctttttttcttgagatggagttttgctgtgtcgcccaggctggagtgcagtggcacgatctcggctcactgcaacctctgcctcctggtatcaagcaattctcctgcctcagcctccccagtagctggaattacagctactgtgctgcacagcactgggattacaccacacytggctaatttttgtatttttagtagagacagggtttctccatgttggccaggctggtctcgaactcctggcctcaagtgaaccaccagccttgccctcccaaagtgctgggattataggagtgagccaccacacctggccagagagacttctatatattctattcaaaagaaactgttgagtactggatgtgttaggtgctatgcaaaataattctttaaaaacaatctctttgctctttccccttcacccctacaaaagtgtgtatctttatcattctcttcagtcagcttatttttaa

SEQ ID NO: 183448 - DNA, 601 bp, Human
cctgtgcatcagtttccttcatttttacaattgagacaagactaatacctacatcttatgctttgggttgggtattttggccaagtaatggtgatgagttcataatgatctattctcccacccttgcctattctcttttataataaactaaaaagtgagccaaggtcaaagtaaagctgactttaatcagcactttaaggctctgctccacaatcttcatcttcctagcccgtttccacttcctattcctattccctattttctattccctattcctatgcgaaattcctgctgaggtaartaaccaaaaactgtaagaatgattaacaaaaaacgaaaacctaaaatgtgttgatgccttagcattatggaaatgatgtaaacacctttgaaaaggagtgaagaagcctattggcttcactaaagatatacacaggcactaaactagaggggtgcttaccagaggtatcaggcttagtaacattctaggaatatttgaaggaatactgttatatatttaaagtataatattatatagaacaagtgtataaaaaactgtcccaaatactaacagagtataggtagagaaaaataaaggcca

SEQ ID NO: 183449 - DNA, 601 bp, Human
tggcttcactaaagatatacacaggcactaaactagaggggtgcttaccagaggtatcaggcttagtaacattctaggaatatttgaaggaatactgttatatatttaaagtataatattatatagaacaagtgtataaaaaactgtcccaaatactaacagagtataggtagagaaaaataaaggccagtgtcttctcagtatcatgttagtattatttcagacctcattaaagaataatatttaacgtgaagaacatgagtaataaatcaatatgaagaataaattctaaaattttaamcaatgaataatgacaatactttatttaaaaaaaaaaaagatagatattcccttgttatccctctgagggaaaaggctgacatgagtgcatgagtgtgggcaaaagatagaattgttatattagtagtgggtttatacatctattttattgacatcatacattctgcatacatttgagtgccttccaggtaccagatgctagaagagaaagaaaaaatattgtagatagaaaggctgatttgagtcactactttcaaagagttcagaagtcagtatggaaaaccaccatgtaagcacgtta

SEQ ID NO: 183450 - DNA, 601 bp, Human
ttttgtgtaagcacatgtaagtgtgtatgtattagggcagaagtgtgatgggtgaaggggatcttttttttccatgtttttttccaccctctcattattcatgagccatctgatgcaggggtttgagggggtgtctgaacatctttagtgatatgccttccaaactttgtttttcttacattctttgctttcctgacatgattcattagcaggcacagtgtcttaattagagagttatgtgcttttttttttttttttgctttgggtcttgtttctataataaatcatatctttaactgtrccaaatcagagcactctaggaaactgggccactttcacgtgcaaattgcttatttcctaatatactgataaacatgtacattcattttcctctcaagtggggtaagtggttaatgctgtgtggcctagataactctctacatattgtactcaacactgaggaagttgcaaaataatgctttgagtttagaagtttaacagtgaaagatattttttgtacttttggctcaaaatattcattgacaagcaacatttgcccttatcattcagaatgatcaaatcacagaaggcccatacttta

SEQ ID NO: 183451 - DNA, 601 bp, Human
atatgccttccaaactttgtttttcttacattctttgctttcctgacatgattcattagcaggcacagtgtcttaattagagagttatgtgcttttttttttttttttgctttgggtcttgtttctataataaatcatatctttaactgtaccaaatcagagcactctaggaaactgggccactttcacgtgcaaattgcttatttcctaatatactgataaacatgtacattcattttcctctcaagtggggtaagtggttaatgctgtgtggcctagataactctctacatattgtacycaacactgaggaagttgcaaaataatgctttgagtttagaagtttaacagtgaaagatattttttgtacttttggctcaaaatattcattgacaagcaacatttgcccttatcattcagaatgatcaaatcacagaaggcccatactttagtaataccttgcagcaataaaaccatgaccttaagtccaagtacagaaaaaccaagtaaggcatgaaagatttaattcattaccaaactttctaacaagcatcttgttggcagtgttgaggccatttttggtgttctgtaatgagattca

SEQ ID NO: 183452 - DNA, 601 bp, Human
gccattgatgactaactttaaacattcacagcttctttgcttgaaattataagcttgagaaatgttcttttcaacctaaaaggatttcttatttttcatcttcttttcagtcaaagctttttggccttttttctctctcaggattttaaattattattattttaatagtgaggtaaagcccaaaggtagagagctgccatttgctgaattttcttgatgcatagagattcaggcagagagtcttccagactgaaataaaaacatctttcccattaagacatactagttggaatatttaatsagtgaatgttaaagttttaatgacacaaaaggttataaatagtaagtcatgacctgggccgggactggtggctccctcctggatggatagagttaaggaaaatgtttcctgttttctaatagggaagcttctgtgtgaattgggttaggttgatcttgagagtcttatcagtgatcatttctgagcttgccatgaaaaattctctcatctgaatttgaatgggtgttccttgtctccacaactcttccctcctggcagttttcctggtttgggaatgataagaagttggtagtatttcaa

SEQ ID NO: 183453 - DNA, 601 bp, Human
ggtcttgacagaactctctgtgaagcagtgatgctcaaccataatagtcaaatatggtttttggtttcatatactccttctttctctttcctacatatatgagtgcttcaagtgaaatataagttagtggttaataatatatcataaattggagggggctagtggaatatggatttttaagtcaaactagagttcagattccagctctggcacttactggctatgacattgggcctcaggtcagaaaaatgttatgaggagtgaataatgtatggtaaatggctactgcactgcttagcartatagctaggattgtttgttataggtgtacccaatgtatcattctaagtatcacaacaatagaacgatttggggcattaagacatacgtaaagtactgacttgctaatagatctaagacagtaaaaaacttacttctcacagctcagctcagtcactgctttcctaggtccttggatgtgttactttgctgcttttatagacatatatatacattgtttatataattagcttagtagtcaagcatgggctttgcagctgacagctatctatgcgatgctaggcagtttcctaatatgtaa

SEQ ID NO: 183454 - DNA, 601 bp, Human
agctgaactcctagaaataaaattactatgtcagagtttgcacactgctaggactttttgtatatattttgtatattggcacttgaaaaaattaagcagttggtcatctgttgttggattcccatgtatcctttgccagaactttgtggactggttcccaagtatcctttgccaagaaccttctggactggttctcacatcgttctggataacctcagtcgagggctcctctgagagactgtggggttctagctgcccagagctccttctgttcttagggaatgttaagtcagttcccccrgaactttaaccagaaagttctagtttttctccttcagaaaatcccacacttgtgagggtaccctgtttttatgatccttcttatataaattaaaatttgtaatattccaaaagtaacttcaaaatgtattcagagaaggaaccagaataacaaactttatattccgtaagtgtttccttttgtgattacctagaaagaaggaactattaggctggaaaacaaaacacaaggaagagcttattattctcaattatttgaataatttgtgtttgaaaaattaactatatttgaagtttgtta

SEQ ID NO: 183455 - DNA, 601 bp, Human
tacggggagctcgcaaatactccttttggtttattcttaccaccttgcttctgtgttccttgggaatgctgctgtgcttatgcatctggtctctttttggagctacagtggacaggcatttgtgacaggtatgtttgtggaggctcagacgcctagggagtggcatgagataaagctgcaagctgcatctggggcagaaatgctgatgtgctaatggccggccagagaatgagtaaaagggattgcagagagcatgcttaaaacctctgaccatcaggtttgcttctcagattgactacaytggaggtgggatattacaaaaatctgtctcttcctgccagatcccttcatctgtttttcgtgagctaagagacaaaataggcaggaaatagaaggtgccacttaccaaataattggcagctgttcttggctttggggtgctggggtctccgagcagcctctgctctagaagaagcagtccaaagatgtcagctcgcctcgcctgagtcccctgtgccagtgggaaatccagagaagggggatttcctcctcttgcagcctctctgcaatggacttacttggctttcctgtttgacctttc

SEQ ID NO: 183456 - DNA, 601 bp, Human
catcaaaaaggttatacttgatgttatgtgtgtatcaaaaatatggctgaaatatttatccagtgaaactcaatcaacactaaaaagtggttctttcggaagcatcagttctttgagacccattaaacagatgcctcggatgcagggttatatattatcaggaatctgtctagggaagaattattggaagcttgcaaagcctttcaaggacagaggacgatagctaccacgttgagttctaggaaattaaccattgttattgttaaaggaagacagcgtttctcagaggaagactgttaamcagtgcagtggcccaggctaacagccctcataagtgggagtatcagaatgagtggacttaattacttaaaaccaatacagggtggaacttcatctgctataacagaaatcaactcgtgcaagttctaacatgcagggtacagttctgagaccaagtctgactcacctgtcaaagctcagctcaactattaccacctttacaccacccttccaagctgtaggagtgcttgctgttctccatgtcttctgaagccctggatcacttgtagccagctcagcagactctacccagacagggatc

SEQ ID NO: 183457 - DNA, 601 bp, Human
ctgtgacctctctgagactccattccttcatctgtaacatggggacaaataatctcaccctgttgtgagcagtaatagtatgattaatcatttagccaactcttattcatgttctctgatgggccagacatacaaagtaagtgaaagtggattacggcaggtgctcttcttggtttctggagtgaacctccatttacatggaggctcctctttttagatttctgactagttcacccaccttattcatagaccttattctgtgcttagctgacagaaatctcctctcagagaatccccccggtaaattcttaggttctttcctcttccattcccctttttgctctctccctccgaaggcaagagtttccactttacaggcccactggagaaagttatggcttctggttgtggttggaggttcattcctgagggagtggggacatttctacacttcttcacggccaatgacattggagaaactggcttcctaacccagcccacaccctcgcacacacacatcacacatcatggctagaatggagagaaattcttcatatggggcacttgtacttcatgaaagaaaatcatatcaatcttgagt

SEQ ID NO: 183458 - DNA, 601 bp, Human
tccaaattaacattagtgaagcttactggaaggattgttactcctgggccaggccaggattttgaggagagatgtgtttgctgtcaccaaatccttgacagactttggcagaagtgtgttaggcttactctggatagcttcagaggacaaaactagtattgacggaaggaaggtaaggagaagcagcttctaacccaggggaagagagagtttccaaactgagaaatcaaaaatggtactgattccttgtcagggtcagtgcttctccccactgtgtgaattacaggggccatttgtccargattccttagagcaatactgatttcatgtaattatttgaatgaaaggtgatttgttaaatttatagtaaaatataatttgatttgtgtccctgtttgtcatgccaccccagaagaaaaattgtctttggttaggtcgaacataatggttttttggtttgcaaaccatgagcgattcccatattaggtgggagttcagattcaaagggccctcttttttttttttttttttttgtagtagccagcctaatgagtaggaagttgttctcactgtcattttatattgaatttcttttattttg

SEQ ID NO: 183459 - DNA, 601 bp, Human
aacattagtgaagcttactggaaggattgttactcctgggccaggccaggattttgaggagagatgtgtttgctgtcaccaaatccttgacagactttggcagaagtgtgttaggcttactctggatagcttcagaggacaaaactagtattgacggaaggaaggtaaggagaagcagcttctaacccaggggaagagagagtttccaaactgagaaatcaaaaatggtactgattccttgtcagggtcagtgcttctccccactgtgtgaattacaggggccatttgtccaagattcctyagagcaatactgatttcatgtaattatttgaatgaaaggtgatttgttaaatttatagtaaaatataatttgatttgtgtccctgtttgtcatgccaccccagaagaaaaattgtctttggttaggtcgaacataatggttttttggtttgcaaaccatgagcgattcccatattaggtgggagttcagattcaaagggccctcttttttttttttttttttttgtagtagccagcctaatgagtaggaagttgttctcactgtcattttatattgaatttcttttattttgagtatgac

SEQ ID NO: 183460 - DNA, 601 bp, Human
ccagcctaatgagtaggaagttgttctcactgtcattttatattgaatttcttttattttgagtatgaccatcttttcaaatgtatgagatagttatttccagttccacatactatctgtacatttcttttgcccgcttttagtttgggtctttggcctttttcttattgatttatagaagctcttttatacatagaaaattaatactttgtgactagttgcaaatattttcagttgctgaaatacacagtaggtgttccatgtaagagctgaacagctggttcctgattgctgtctcccycccttccagccaatagatttcagagtttgggcattacctattgagccaaagctgacaccacacaagcgcagagtatgggaacagagttctctgtctgattcctgtgagcttcctcatactaaatcaccaacagcaacctacttatcacagaatatgagaattgaacaagtgttggcaaggatgtggagaaattggagctcttgttccagttgtcgatgggaatgtaaagtgatgtcgctgctatggaaaatagtgtagcagttcctcagaaaattaaaaatagaatgaccacatgatcta

SEQ ID NO: 183461 - DNA, 601 bp, Human
acaatttgcaactattcttcaaccctttggtcaaacgattctgcttctaggaatatagcttactcccacctgtgtgatatggcatataatcaaggttttccattgcaacaaaagattggaaacaacgttaagtatccatcactagtggtctggaaatatatatatattattgtcatccaatagaatacaatagactaatatgcaacttttagcatgaggatactcgttacatgctgatacagaataatctccaaggtagtcatatgtgtgcaaaaccgtacatagtatgctaccatttgtrcttaaaaataaaaagaaaacagaatatgggtcaatgtttttgtttagttttgtctaaagtaactttaagtagaggcaagaaactggtaacatgtaacagtgatcacccctgttacctctgtggaagaaaactagacagctaagggacaaggctgggaggcagacttgctttccactatttatcacctttatctttcaaatttagtaccatctacatttagtaccatgatctattcaaaaatatttattaaaaaaagaaaaggtatagtctagaaggaaaaaaaacataacagacacttct

SEQ ID NO: 183462 - DNA, 601 bp, Human
tggtgttagcagtcaggggcattttgtatttgaattctacattctttttcttaactatccaccacctcccctcaaaattttaacagcatccagcctcacaaaactcagatcttccctgtttacagttccactttgagtttcagtttcttcatctataaacaggagttggctgcggtccctgccatgtatcctgtgactcagtgtctcgtagttactcctggcccaccccttcctgctgctccttgtctccacctgcaggcctgagagggaagccaccccactaagacagggaggtgaactragcctgaagtttggctacagcacccacaggccaccagccatgagttcacctcctccagatggccacacaccaggcccttggccactgtccccatgtctgctgtggatgatgaggagtcagggaactacaaagagatggtccctcagatccatgctggctgggataagccttttcagatttctgtttttctgcttagcaccttgagcttgtggagtccttgagtgcaaggtctgtagatgtgccagctgatcactgacttaggtaacaacagcagcttccaacccccagggcccatgacct

SEQ ID NO: 183463 - DNA, 601 bp, Human
attatctcttctcagcttcttaaagtcctgggattataggcatggcctatctatttttatgttttataatttcttgtactttttgatgttacttcaaatatctttttaagtatcctaaatatacttatttaaattttttttgagtaaatttatctataaattattgattttatgtcgatagacattgttctctatcattaataatgttaaaaataaataaaaaaacaaaaacaagtaaatcaattaatgcttaccacaggccagtatttgatccaacactaactcaaatattcatttcttyaatcctcacaacaaacctatgaggtaggtaccattattgttcctgctttttgcaagaggaaactgagacacagggaagttaagtaatttgcctatggtaacacaggcagtgagtagttgagctgagattgaactcacgctgtccagaatccatactattagttataatagtgtactgccctatagctttctgtttcacagctacatggcattactttgtatggatgtatcattatttgttaaaccatttaacttatttccagtgtattgttcttataaacaatgaatacctgtgtacctc

SEQ ID NO: 183464 - DNA, 601 bp, Human
aaattattgattttatgtcgatagacattgttctctatcattaataatgttaaaaataaataaaaaaacaaaaacaagtaaatcaattaatgcttaccacaggccagtatttgatccaacactaactcaaatattcatttctttaatcctcacaacaaacctatgaggtaggtaccattattgttcctgctttttgcaagaggaaactgagacacagggaagttaagtaatttgcctatggtaacacaggcagtgagtagttgagctgagattgaactcacgctgtccagaatccatactrttagttataatagtgtactgccctatagctttctgtttcacagctacatggcattactttgtatggatgtatcattatttgttaaaccatttaacttatttccagtgtattgttcttataaacaatgaatacctgtgtacctctaattttgtgcacatgtatctttttgtagaatgaattcttaagaaattgagttgctaagtcaatgcttaagcccataattaattttcttacatattaccaactgtcctccaaaaaggttgtaccaatttagaattttaccagcagtaaattcagcag

SEQ ID NO: 183465 - DNA, 601 bp, Human
aaaacaaaaataaaatagttcagcttttaatctcttactacgacggtataatcaagaggctaaaatgggaggaagggcagactctgcctgttccatttccccacatagagtgagtataccagtcgagggtcaggtaatcagtgcagacttagggggtcgccttaccattgaagaagccccaaatgaaaggctctagcagttttatggacctgggggtggaggaatccaagggtggggagaattcatgaggaaaatgaggtgagagggctaggagtggaaaagtacaaagtactgagttagygtggggaatagtgtctttagggctaggagtggaaaaaatactaggtactgagtcagagtggaaaacagtgtcttcaaggcagggagtggaaaagtgctaggtactgagtccgagtggagaaaagtgtcttctctatgatgaggaggcttcagcagaggtgcctgaagacctcaccccagagcctcagataaagagacctaagaatgagggtgcctgggctaagattgcaagtatgtgaaaaagcatgactggcgggaggctgagatcttgattgcagcccccttcagagactgccatgca

SEQ ID NO: 183466 - DNA, 601 bp, Human
ataggtactggggacccaattacatgaggtcttgtaaggccaggggaaggactttggatgtagttctcagtgtgaggggaagggatctggatatatttttcagtttggtggaaggcatcagaggcttctgaacaggaggattatgtgattggagctgtatttttaagggatcattttggcttgagaaactagacccggggacaaggacggagcaggcagatgagttaggagacaattacattagtctcctctacccttttcttaacatattggagttcagctctggctgtagtagttctaratctcctcagacacacttgtgtagagcctctgttgggtattttgggtacacaaatgattcatcttggttatacagatgatttagatgattgtagacagaagagggttgtctggtcattcccagacaggggagcattccttgagatagagtagaggaaggctgaaggggaggaagacagtacctgttgctatctagatagagacatccagcaggaagttgaatacaggtatctgaaactctagtgaaagttataggctggcaataagcacctgggagttattagcttttacttgacagttg

SEQ ID NO: 183467 - DNA, 601 bp, Human
ataatttattaccattatcagcaatcttttcaccatagcagaccaaggaatatgtggatgggaggggaggggaaagcttttggtgatggtgtagaagttatggaacctgtaacagctacagtgatgaaaactaaaattaaggttataggaaggtaactggtgggtgaatgggttgtctaactctactggtttttccctgtcttgcaatttaaattcacagaaccacagtactagaaagacccttggaacatttagtcaaccacttcattaatcagatgaggaaactgaggctcataaagaytgcagtttgtacaaggccacacatttagtcagcggtgaagcaaggacaaaggtcctaatctccagatgccaagcagatgtgcacagttccagagcttaatatcttattcttcagcatgattactgataagatagtatctgggtattgtataaagagaaatggaggttttttcccctttcctcttgtttctccctccctaatccttaaccttcttttttaggtgctgctcctctgaagattcaagcttatttcaatgagactgcagacctgccatgccaatttgcaaactctcaaaaccaa

SEQ ID NO: 183468 - DNA, 601 bp, Human
aaccatagagtaaaacagaagcaaaagtaaaaatagaatggagagctgctccctttgaaccctgtgtgatttaaactaggctgcagggctttaggaatagttaaccaagtgctaaatccgtgttttcaaaatgtggtcaggtaccattggaaatgttttaggtgggacacagataagcattttgaaaagccatgttgtatttgttttaatgtatattagaaaaactctaacttacgcaacatgtgatttcacagatcttgttaatgaagctaaacacggtctggcaattcaccttctacakgccacatagagtccaagaagagtgctcaaatagtacactgatatagcaaaacttataaagatgacatgcaaatgacagaccttttagtaagaatacactaaattataaattagtttgtagaacctgcaaactacctagtaactataaaagaacaagggattttttctgacagaaggcacatgacacaggtctagggactccatgccagtgatcctgaacagccagaaaagtgagaatggcaaaggcaagagaaacactgtgtttattaagatcatgtatttttccctaaaatagctggat

SEQ ID NO: 183469 - DNA, 601 bp, Human
cctgcttctcctgagtgatgcagggtccaggaggctacgagcctatgttgcacttgaagaaatatgcttttagccctgaaactgactcagtctcttggtttacctttggatggaggattctgaagttttgatttaaaaatacaggattcctccaggctagaattctttctttgattacaacacatacatgcgcttgcacacacacacacacacacacacacacacacacacacacaccatgcatacatgcagacatacaaatgatatttattgtgagtatagaaccatttgggacattatkggtcacaggagtgaaaacaaaaagatatgacaccccctctgcccttgaggaccttccaatagaatcagaaccctgtaatgtgcacacatgaaaaactggatttttaaaaggttgaattggaatctaaattttattccatggaaatatctgactaaatttaaaataaaagtgactggtaatgagatttatgggcattcagaggtaggcaagatccctgagggtcagggaatggttcctaaaggaaggggtaccttgtaacatgtaaaataaattattggggttaataaatgtggtgaggag

SEQ ID NO: 183470 - DNA, 601 bp, Human
acactgcaacctctgcctcccaggttcaagcgattctcctgcctcagcctcccaagtagctgggactacaggcacgtgccaccaagcccaggtaatttttgtattttcagtagagatgggttttcaccatgttggccaggatggtctcgatctcttgacctcgtgatccgtttttaaccaacatttaaacagaaatattcacaggcttaaagactgaaagttagtgatatcatcacatttccccttcaaaatgctgaatttataagcaaatttaaaagtttagaatctaccttttaattgwctgctttcatttttttgacagtggctttttttgatatggtgactattttgtcatgggtataaaaggataattcattttgtgttaatctgaagacatctgaaatactgtattcaactataagtacctttttttacatttataagattctttttcaaaatttttatttgaatagttttttgggaactactgaactaaactaggtggtttttggttacatggataagttatttagtggtgatttctgagactttggtgccacctgtcactcgagcagtgtacactgcaccagtgtgtagtctt

SEQ ID NO: 183471 - DNA, 601 bp, Human
cataatatttcatgatagaagactgattgcttttaccttaagatggcgaatgtggggaggatgtctactctctctacttttgttccacattgtactggaggtcatagccagagaaacaagactagaaaaagaaataaaagacatacagattggaaaggaagtaaaactgtcttttttcacagataatgatcatgcttgtagaaaatcctgaggaatctatcaaaaacctattaaaactgataagtgagtgtagcaaagacacaggatacaaagtcaatacacaaaatcaattatttctatrtactaacaaaagcaattgtacattgaaaaaaattaatagcatttataatagcatcaaataatattaaaaacttggaaataaatttaacaaaacaagtacaaggtctatatactgaaaactatacaatattactactggagaaattaaagtaaaccaaaataaatggagacataggccatgtttatgaatcagaagactagatgttaagataaccattctctccaagttgatctatggattaaatgtaatcacaatcaaaatcctggtaagctctctaatagatactaaaaatcttactcg

SEQ ID NO: 183472 - DNA, 601 bp, Human
atcctggtaagctctctaatagatactaaaaatcttactcgaaaagttatagggaaatgcaaagaatctacaattgccaaaacaattctgaaaaataagaacaaaggttaaaaatacaaaattagccaggcatggtggcgcatgcctgtaatcccagctactctggaggctgaggcaggagaattgcttgaacccgggaggcagaggttgctgtgagctgagatcgtgccattgcactccagcctgggcaacaagagtgaaactccctctcaaaaaaaaaaaaaaaaaaaaaaaaaaagamcaaaggtggacttaacctacctaatttcaatatttactatatatagtaattaatacagtgtgatattggtaaaaggacagacatatcagtcaatggaacaaaatagagagtcaaaaatagattcacactgttgacaaagctaccaaggtaattccatgcagaaaggatagtattttcaacaaatagtgttgggacaattagatatccacatggaaaaagtatgaacctagacacacacaaagtaacttatatattaagaattaaaatgaaaggacttccaaaagaaaacagaggagaaaa

SEQ ID NO: 183473 - DNA, 601 bp, Human
cattatgctaagtgaaacaatccaggcacaagaagaatacacattatacaatttcatgtatatgaaatttgagaaaaagcaaaactattttaagtagattcatggttatccatgggatgggggaaaggaatcagctgaaaagcgaactattttggcttataaaaatgttctcgatcttgattgtggtggtggttacgtgactatatatattcgttaaaatcaccaaactctaaactgaaaatgattgggttttattatttattaattatacctccataaagctgattgtttttatcttttrtttttattttatttcaatagtttttggggaacagatggttttcggttacatggatgagttctttagtggtgatttctgagattttgatgcacctgtcacccgagcaatgtccactgtacccaatgtgtagtcttttatccttcatccacctctctctcactcttccccccaagtacccaagtccattatatcattcttatgactttgtggcctcataaaagctgattgtttttaaatacacacatacacacataaaagagaacttccagtgacaggaagtgttcaagaatgctctattta

SEQ ID NO: 183474 - DNA, 601 bp, Human
gcgaactattttggcttataaaaatgttctcgatcttgattgtggtggtggttacgtgactatatatattcgttaaaatcaccaaactctaaactgaaaatgattgggttttattatttattaattatacctccataaagctgattgtttttatcttttatttttattttatttcaatagtttttggggaacagatggttttcggttacatggatgagttctttagtggtgatttctgagattttgatgcacctgtcacccgagcaatgtccactgtacccaatgtgtagtcttttatccytcatccacctctctctcactcttccccccaagtacccaagtccattatatcattcttatgactttgtggcctcataaaagctgattgtttttaaatacacacatacacacataaaagagaacttccagtgacaggaagtgttcaagaatgctctatttagtaaagacagaatcacaaaaccatcagaggtattgttgagtggattcttgtggtctataaatacctccatggacacccaggttagcaacctgttggagtttacgtgggacaatagcatcatcacaacagtcagcctagaga

SEQ ID NO: 183475 - DNA, 601 bp, Human
accctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaa

SEQ ID NO: 183476 - DNA, 601 bp, Human
aataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaatyttgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgagg

SEQ ID NO: 183477 - DNA, 601 bp, Human
cataaatattaattgagcagctatattggccaggctggagctgggaaccagaaacacagaggtggataaaatagacacagtttctaaccccagggaggtcacacagtctggtggggacatagacttcaagggtgtggctcctgggcagagattgggccacttcctgtgccctccctgggtgggtggggcctctccactccctgtctctcctgcctctacccagcagccaggccctccccctctgtcctggacccaccccctggtcagcccccggccagtcgtttccactgccagctttatyacccgcaactgtctgtctttctgtctgtcccacccaggctgcaggaggagattcagttgaaggaagaagcagagaacaatttggctgccttccgagcggtgagtgcccttcttttccccttgcatggcctctggccttgctctgccccacctgggtggcggtgaccatgtccttctcgcttggcctctcccaggacgtggatgcagctactctagctcgcattgacctggagcgcagaattgaatctctcaacgaggagatcgcgttccttaagaaagtgcatgaagaggtataccttgg

SEQ ID NO: 183478 - DNA, 601 bp, Human
gagcgcagaattgaatctctcaacgaggagatcgcgttccttaagaaagtgcatgaagaggtataccttggcccctcttcctggggtcactgggccatggggaaagcagccggaaagtggggttggggtgaggctctggctgggaataggggtgtgagggtgctgtgtgggccctgagaggggactgaagcccagtcatgccctacaggagatccgtgagttgcaggctcagcttcaggaacagcaggtccaggtggagatggacatgtctaagccagacctcactgccgccctcagggayatccgggctcagtatgagaccatcgcggctaagaacatttctgaagctgaggagtggtacaagtcgaaggtgggtggcctcgcccggggactggcatctccgtccccctgaatcccagcttggatgtgctgcctgtggtaccatccatgggaggagagcccagaggcttcatgctcccttgctcatccctacccgtgccctgcatccttctcatttttgggcccctttctctgcccttaggtgtcagacctgacccaggcagccaacaagaacaacgacgccctgcgccaggccaagcag

SEQ ID NO: 183479 - DNA, 601 bp, Human
gtacaagtcgaaggtgggtggcctcgcccggggactggcatctccgtccccctgaatcccagcttggatgtgctgcctgtggtaccatccatgggaggagagcccagaggcttcatgctcccttgctcatccctacccgtgccctgcatccttctcatttttgggcccctttctctgcccttaggtgtcagacctgacccaggcagccaacaagaacaacgacgccctgcgccaggccaagcaggagatgatggaataccgacaccagatccagtcctacacctgcgagattgacgccctsaagggcactgtgagtccctgcccacctggccaggccctgccccttcctgtctgcagttcacaccctcactttgtgaccttgggcccatcatagatcctctctgggccttcatctacttaaatctacaataggggtaaaaccagacaagtggattccagttggatgctaaggaatcaggggttcctgggcatctacctatgtggggactgtgaggctgaatgcaatgttcctttgtatctattttattctgagtgttcacatatagacttaatttgagttcagggttcaacatggcctgga

SEQ ID NO: 183480 - DNA, 601 bp, Human
ccacctaccggaagctgctggagggagaggagagccggtgaggggccaggcaggagcccgagtgggaggtgcggggtgctgggtggtccatttctgtccccaggaggctcgagattactgattacctcaacaagacctggaaacaattttttttttttttgagatggagtttcgctcttgtcgcccagtctggagtgcaatggcaccatcttggctcactgcaacctccgcctcctgggttcaagcaattctcctgcctcagcttcccgagcagctgggattacaggcgcctaccaccacrcctggctaatttttgtatttttagtagagacggggtttcactatgttgggcagctggtctcgaactcctgacctcaggtgatctgcctacctcagcctcccaaagtactgggattacaggcgtgagccaccgcgcccggcgtggaaacaattttatacaagaggccactgctctattaattgcagagaattaaccaaggccacctgggtaaaaagcaatttaattaacagcatttataaaaagagaaatataagtattcccttatccaccttcagaattaagaaccagcagcaaaaaaaa

SEQ ID NO: 183481 - DNA, 601 bp, Human
taaatttaacctcaatttaaaacagatcagttactccaaaaactggtaccccttgatactcataaaaataatatctgaaatttttaaaaaggagcagacatgtttagatacaggtacaaacataaagagaaacttcagattttgtaaaatcacgtctacatatgatggcctttgaaggtagctaaaggcatgttgcattttcccagcattaggcctaaatagtaagctctcagaactggcctggctggagggtgggcatgagcaatggatatcacccacagctgctactagtaccaacttsagtgccaggagcaagaaggaaatcctggtgctctggagggcgcggtggggttgcacatcctagtgtcgtgccagcagttcacagttgaaataatgatccttccagaagagactattcctgggacagctctagctggccttcgaccccattccttgagcagtatgggtggtgggagtgctggggtccgtgggactgggacagctgaggatggtgtttagaaaggaccagggtgagccttgatgggcggtctcagggaaagatgggagggttcttttttttttttttttgagacagggtctt

SEQ ID NO: 183482 - DNA, 601 bp, Human
gaccactgcgggtaggtgggggagtttaggtagaggtggatgaggcaacttatgacagagagagctttttatgtgattatattgtattgtatttaccatgtcccctgcaccttcttggagtattgggcctcaggaagcagcctctgttctgaatcccaaactctgaaagcaggagtgtccttggggacctggcttcaggagcatctcataccacctgccctctaagacacccacagcccattgtctgtttggcacattgccaagccccaccttggctgcttgtcgaacacctccagtttgytggagcaagatgttggatgcacgtttggaaaaaaatgccaaatcttagcaaagccaaacaatgaaaagaacgagctcttagggcactctgccattttgacattagtaatacgcagatcgggtggctttccaaccccagagagcagagaaacacacgataatgatgcattaggaaagcaagtcggagtccttggcagcttctcctttcctagatcaaaccttttctatcttcgatgtacatttccatcaggaaaaaaaacacgctgcgctccagcgagtcacaacattcatcacaggctgg

SEQ ID NO: 183483 - DNA, 601 bp, Human
actcagagcctctcttttcagttagttgtttatacagacaccaagtatgagtcttgcatttaaaacttcatagtacaaaaaactccacccacattgcacagtgcttttccaaatcaatagctttgtggccatgataaggttggtaccacttcactccgtgtcctcagtgaggaaactgaggcacagaatggcaagtgactgagcatcagcacaatgagtcagtgccttattcctgctctgtctcactttaagacatcaagttgctcatctgaattttttttttcttttgaaacggagtctygctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctcggtctcccaaactactgggattacagatgtgagccaccgcacctggccctgaaatcttaaagggagataggtactgtaagg

SEQ ID NO: 183484 - DNA, 601 bp, Human
cagtgccttattcctgctctgtctcactttaagacatcaagttgctcatctgaattttttttttcttttgaaacggagtctcgctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctyggtctcccaaactactgggattacagatgtgagccaccgcacctggccctgaaatcttaaagggagataggtactgtaaggtcctctaaagagtgtcttgagactgggctttggggttctatcttgaagaaggggagtcccaggagacaaatgtgtgcagggctctcctggggcctgggggtggagaggaactaggagggatggggaatgtcagtgctgtgcagcctgggcctcaggtgtcccctaccctcctgcaccatcctgcacatggagcaaatctgttggctcctgagaccatct

SEQ ID NO: 183485 - DNA, 601 bp, Human
agatggagatatttgggcttgagccccttcctgccacctttcctcctatctctgcctctgctcgctgctccaaaccctgtttctttactcccaggtagctgacactgagaagctatcagagatacaggcaaaagattagttgggaaacttttctggaaaactagtctatcttctcttgagttcctgtctcaacatatatgtgcccccttgttccactgactgaacggataagccctcctgtgggtgggctttcttgtcatctggtccacctttctcttagagaggacccctgcctccctcrcttcagtccgttcgcagcacagtggggagaaggatggctttgggatcaggcaaaatccaagcctggccacttagtcgttgaacgtcatttcacctctctaagcctcagtttccttatctgcaaaatggaccaattgtgactagataatgagagaagccatgtaacagtatagttccaattgccagtccatgaacgagtgctgctccaggatgattagtatagtctatgagtgtgtcagtgtgaggatgctaactacacattcttgaaaggactgccctctgttctgagttacagccctcc

SEQ ID NO: 183486 - DNA, 601 bp, Human
aacggataagccctcctgtgggtgggctttcttgtcatctggtccacctttctcttagagaggacccctgcctccctcgcttcagtccgttcgcagcacagtggggagaaggatggctttgggatcaggcaaaatccaagcctggccacttagtcgttgaacgtcatttcacctctctaagcctcagtttccttatctgcaaaatggaccaattgtgactagataatgagagaagccatgtaacagtatagttccaattgccagtccatgaacgagtgctgctccaggatgattagtatartctatgagtgtgtcagtgtgaggatgctaactacacattcttgaaaggactgccctctgttctgagttacagccctcctccttctcttccccctcttccttgttctccattttcttccctttcccacttgcctttccctccttcttctttttttttttttttggtgtaaacctgtcttttaaaaatggaattattttaaagaatttatcctacaatattcctgacatgccaaagatataaagagtaatataggccgggcgcggtggctcacgtctgtactcccagcactttgggaggcca

SEQ ID NO: 183487 - DNA, 601 bp, Human
tagtcgttgaacgtcatttcacctctctaagcctcagtttccttatctgcaaaatggaccaattgtgactagataatgagagaagccatgtaacagtatagttccaattgccagtccatgaacgagtgctgctccaggatgattagtatagtctatgagtgtgtcagtgtgaggatgctaactacacattcttgaaaggactgccctctgttctgagttacagccctcctccttctcttccccctcttccttgttctccattttcttccctttcccacttgcctttccctccttcttcttyttttttttttttggtgtaaacctgtcttttaaaaatggaattattttaaagaatttatcctacaatattcctgacatgccaaagatataaagagtaatataggccgggcgcggtggctcacgtctgtactcccagcactttgggaggccaaggcaggaggatcacaaggtcaagagatcgagactatcctggctaacatggtgaaccccgtctctactaaaaatacaaaaaattagccaggcatggtggcaccagctactcgggaagctgaggcaggagaattgcttgaacgtgggaggc

SEQ ID NO: 183488 - DNA, 601 bp, Human
atcagcctgggcaacatagcgagaccctgtctctacaaaacccacaaaagttagctaggtgtggtagcacacgcctgtggtctcagttactcaggaggctgaggtgggaggattgcttgagcccaggaggtagacgctgcagtgagccgtgatcatgccactgcactccagcctgggtgacacagtaagactctgtctcaaaaaaaaaaaaaaaaaagaatataacaaccatccatgtagacaccattcaggatactgtttcacactatctggtgagtaagcattgaagtctaatacaaaktcttagtgctggtgaagtggagagagggcctcttacacactgctgatgggcatgttaattggtaaaaccacttcagagagaagttggcaatgtcttctatttttttaagtcccttcatgatgaaattaaaaaatgggaagcctacagaagctctcccaaaactcaggagagtccccacgtcccggagggcgtggagcagagtgcagcccatcattggctcatgactggtggccacatccctcctgctgaagaggaggggtgccaggtcctgccagtcagggctgccctctcccttttctt

SEQ ID NO: 183489 - DNA, 601 bp, Human
attcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcayacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagc

SEQ ID NO: 183490 - DNA, 601 bp, Human
attccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttragataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatg

SEQ ID NO: 183491 - DNA, 601 bp, Human
ttccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttargataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgt

SEQ ID NO: 183492 - DNA, 601 bp, Human
ctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaag

SEQ ID NO: 183493 - DNA, 601 bp, Human
aagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcrgttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctg

SEQ ID NO: 183494 - DNA, 601 bp, Human
actatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcytgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattg

SEQ ID NO: 183495 - DNA, 601 bp, Human
ggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgcsacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatt

SEQ ID NO: 183496 - DNA, 601 bp, Human
tctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgrcctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttga

SEQ ID NO: 183497 - DNA, 601 bp, Human
agtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccagg

SEQ ID NO: 183498 - DNA, 601 bp, Human
gcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggyaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagcta

SEQ ID NO: 183499 - DNA, 601 bp, Human
aggatgattttctgatatatagatttagttgacgattaaaatcattggcacatgtgaccagttatgaaaaaaggtggggggtggctgatgcataatatcaagaaaagaaaatatactgttgacattgtttgaaaatagatggaaagagggtttgcaaagtgaaggggattcatcatgttacctaagagtctgattttctgtttctgtatctttttttccttctgtttcactctttctctgcctctaagcctctaagctgcttcttgcctttcctctctcgttttctttctcttccctacatttttttatttgagatagtgaaagtgggctgataagtaggtaaattttctttctgtcaagaatactcaaaaattatttttataatttgaaggaaagtcactgtttccttaaaaattaaagttcaggcttttttttttttcagcatgggatattcaaagctctttactttctacagaaaatatgatacccatgtgcttatttgaatcattattcttatagtccagtaaatccttactaggtcatgagtcaacaatgacagaaaacccagtgaaacaaactatcaatttatttacaaatgatt

SEQ ID NO: 183500 - DNA, 601 bp, Human
ctctgaccccggatgcctttccctttatcactagacatggtcttttcctgctgtgtgtatataacccagcacatggagctagtctgagatccccctgtaaggtttgctggattagcttgactctgaatcagcaggtggttcccttgcttttcctctgtgatccgagaaaaataaatcctccccaattctgaaaagctgttctcagcagaaagaggaggaaactgtccttggttcttgttctcggactaactgaagtgcctgtgacccatgaaatgctagtttgacaagttgttaacaggtgtacatggggaaaaaatcagtttcaatagtcaagttagctttgggaatagaactgggttaaactgtgtttaaaaggtctctttaatgcagtaatcctaagtctttaacatgctaatacgcactgtggctttcaaggaaaggatctagtgttttccaaactctgttttcaaaattttgattacagcattcacctccctctttttttccccaatgtcctgtagaaaacactgagagaactgacatttttaactttatatggaaagaatcgtaaatatggtgaatctggatgtcctcatcaacc

SEQ ID NO: 183501 - DNA, 601 bp, Human
gactctgaatcagcaggtggttcccttgcttttcctctgtgatccgagaaaaataaatcctccccaattctgaaaagctgttctcagcagaaagaggaggaaactgtccttggttcttgttctcggactaactgaagtgcctgtgacccatgaaatgctagtttgacaagttgttaacaggtgtacatggggaaaaaatcagtttcaatagtcaagttagctttgggaatagaactgggttaaactgtgtttaaaaggtctctttaatgcagtaatcctaagtctttaacatgctaatacrcactgtggctttcaaggaaaggatctagtgttttccaaactctgttttcaaaattttgattacagcattcacctccctctttttttccccaatgtcctgtagaaaacactgagagaactgacatttttaactttatatggaaagaatcgtaaatatggtgaatctggatgtcctcatcaaccagcttcaaagactatcacccatgcaatcttgtttcatctgcatagccactcatttcccacacacacccacttgagttttttaagttatttcatgcaccatatcatccagaaatagaaa

SEQ ID NO: 183502 - DNA, 601 bp, Human
acccatgcaatcttgtttcatctgcatagccactcatttcccacacacacccacttgagttttttaagttatttcatgcaccatatcatccagaaatagaaaaatgtcattttaaagcatcctgtctcccctaacccagagaaaacccacaagttcagctgatccaagacagaaaaattccatctcatttcaccggtgttaagaaaggaatgatgacttacaaggtatacactcttctcattcttcatggttgactttcttcatgcagaattcttaatcaagtaatataatattcttgggktttttttttttttttgagacagagtcttactctgtcgcccaggctggagtgcaatggcgtgatcttggctcactgcaacctccgtctcccaggttcaagtgattctccagtctcagcctcccaagtagctgggattacaggcgtgtgccaccatgcctggctagtttttgtatttttaatagagactgggtttcaccacgttggccaggctggtcttgaactcttgacctcaggtgatccaccagccttggcctcccaaagggctgagattacaggcgtgagccactgcgcctggcataa

SEQ ID NO: 183503 - DNA, 601 bp, Human
ttcatctgcatagccactcatttcccacacacacccacttgagttttttaagttatttcatgcaccatatcatccagaaatagaaaaatgtcattttaaagcatcctgtctcccctaacccagagaaaacccacaagttcagctgatccaagacagaaaaattccatctcatttcaccggtgttaagaaaggaatgatgacttacaaggtatacactcttctcattcttcatggttgactttcttcatgcagaattcttaatcaagtaatataatattcttgggtttttttttttttttttagacagagtcttactctgtcgcccaggctggagtgcaatggcgtgatcttggctcactgcaacctccgtctcccaggttcaagtgattctccagtctcagcctcccaagtagctgggattacaggcgtgtgccaccatgcctggctagtttttgtatttttaatagagactgggtttcaccacgttggccaggctggtcttgaactcttgacctcaggtgatccaccagccttggcctcccaaagggctgagattacaggcgtgagccactgcgcctggcataatatgatattcttgatg

SEQ ID NO: 183504 - DNA, 601 bp, Human
ccacattatggacatgaaggacctcctagctactagggaaggtggagctagaggatcacttgagcacagcagtgtgaggccacattgagctaggatcacaccattgcactccagcctggacaacagggaaaaaccctgtcgcttgggttggcttataaaaagaggtaccagaggctgggtgcagcaactcacacctgtaatcccagcactttggaaagccgaaacagaaggattgcttgaggccaggagtgcaagactccaggctggttaacatagtaagacctcatctctgcaaaaaagaaaaaaaaaaaagatggaccagataaaattccactgaaaagcaaaaatcaggtctcctgcctcagttcacaaacaaccttacatacaatctctctcccttgctgtatggctcctaatcactgtatccaaggaacagccaagctgtctggagaccacaggtttttcaaagacatttgccggaaacagcaccgtgcgctgagagttggtactgagccaggctcagttcagtttgcttacatgagcttctccccagatttatgccaatgcatttcacaaattttcagggtgcatttggccaaga

SEQ ID NO: 183505 - DNA, 601 bp, Human
atttcccagtctcaggtattctgttaaagcaacagaaaatgggctaagacagaggggaaagacaagaagatgaaagaaaggaaaaaaaaaaagcacacatagcacaccttgctgataaataaggatgatgatcaaaaaccctcatgaaatgagaagattggaaagaaatccataatgtacctggaagtactagacccaatccgagattcacctgttcatcagaacaggccttttttgcatattactatgttccaggcactgttttggggttatagcagtgcttgtgacagcaaggcttctkctttcaaggagtttctagggacagggagggagccagattttttttaattttagtaaaaacaaaaaataagaaaacatcaggaatatttatttgaaataaaacagtgagataagatagagattgagcaagaattataatgatggtcaagggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattgga

SEQ ID NO: 183506 - DNA, 601 bp, Human
agataagatagagattgagcaagaattataatgatggtcaagggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattggatgtaacagcaggagggcccatgtgggtaagctgaggacatcaaggtgagaatatcaaggtgggtagggaccagatcaggtaagatcttgtgagcccttgtaaggacytttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcgaaaccccgtctctactaaaaatacaaaaattagccaggcgtggtggcaggtgcttgta

SEQ ID NO: 183507 - DNA, 601 bp, Human
gaatatcaaggtgggtagggaccagatcaggtaagatcttgtgagcccttgtaaggacctttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcraaaccccgtctctactaaaaatacaaaaattagccaggcgtggtggcaggtgcttgtaatcccagctacttgggagggtgaggcaggaaaatcacttgaacctgggaggcagaggttgcagtgagccaagatcatgccattgcactccagcctgggcaacaagagcaggactccatctcaaaaaaaaaaaaaaaaaaactccacttttgtatatctttacattttccactggatatagcctcgactgtactcaccaggttctccacaccctaagccacatgccagatttgtttagcagat

SEQ ID NO: 183508 - DNA, 601 bp, Human
aaaaatctccacttttaggctgggcacagtggctcacgcctgtaatcccaacactttgggaggccaaggcgagtggatcacctgaggtcgggagttcgagaccagcctggccaacatggcgaaaccccgtctctactaaaaatacaaaaattagccaggcgtggtggcaggtgcttgtaatcccagctacttgggagggtgaggcaggaaaatcacttgaacctgggaggcagaggttgcagtgagccaagatcatgccattgcactccagcctgggcaacaagagcaggactccatctcaaaaaaaaaaaaaaaaaaactccacttttgtatatctttacattttccactggatatagcctcgactgtactcaccaggttctccacaccctaagccacatgccagatttgtttagcagattcagtggagcaggttcattcatgggggcaccaaaccaaaagtccttttaaaaacagttacctatgatttaaaagtgtgaagtgattgtagtatgatggggaaacagtgggccaactatcatgagaattaggagatctggacagctacatgatctctttgatcatatagttttcttacttg

SEQ ID NO: 183509 - DNA, 601 bp, Human
cagtgtggggtttgtaatttattgaaaccatgtaacaactttagttattcaaagacacatttacctgggatataaaaactctaaaatgtacttcaattgtggaaagaggcatcaatgattaaccataatcatttctgatcatgaccaagtcacccctgagactagtaactgcaggtgctcacaaaaaaatatgcagctgtccttcctgccttcaggggatcattcatgaaagtaatttctcacctgaccaaaatgatcgcttaacatttattgcatcattgcccctgtttctgtagactaytctaccgaagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgct

SEQ ID NO: 183510 - DNA, 601 bp, Human; identical to SEQ ID NO: 20728

SEQ ID NO: 183511 - DNA, 601 bp, Human; identical to SEQ ID NO: 20729

SEQ ID NO: 183512 - DNA, 601 bp, Human; identical to SEQ ID NO: 20730

SEQ ID NO: 183513 - DNA, 601 bp, Human; identical to SEQ ID NO: 20731

SEQ ID NO: 183514 - DNA, 601 bp, Human; identical to SEQ ID NO: 20732

SEQ ID NO: 183515 - DNA, 601 bp, Human; identical to SEQ ID NO: 20733

SEQ ID NO: 183516 - DNA, 601 bp, Human; identical to SEQ ID NO: 20734

SEQ ID NO: 183517 - DNA, 601 bp, Human; identical to SEQ ID NO: 20735

SEQ ID NO: 183518 - DNA, 601 bp, Human; identical to SEQ ID NO: 20736

SEQ ID NO: 183519 - DNA, 601 bp, Human; identical to SEQ ID NO: 20737

SEQ ID NO: 183520 - DNA, 601 bp, Human; identical to SEQ ID NO: 20738

SEQ ID NO: 183521 - DNA, 601 bp, Human; identical to SEQ ID NO: 20739

SEQ ID NO: 183522 - DNA, 601 bp, Human; identical to SEQ ID NO: 20740

SEQ ID NO: 183523 - DNA, 601 bp, Human; identical to SEQ ID NO: 20741

SEQ ID NO: 183524 - DNA, 601 bp, Human; identical to SEQ ID NO: 20742

SEQ ID NO: 183525 - DNA, 601 bp, Human; identical to SEQ ID NO: 20743

SEQ ID NO: 183526 - DNA, 601 bp, Human; identical to SEQ ID NO: 20744

SEQ ID NO: 183527 - DNA, 601 bp, Human; identical to SEQ ID NO: 20745

SEQ ID NO: 183528 - DNA, 601 bp, Human; identical to SEQ ID NO: 20746

SEQ ID NO: 183529 - DNA, 601 bp, Human; identical to SEQ ID NO: 20747

SEQ ID NO: 183530 - DNA, 601 bp, Human; identical to SEQ ID NO: 20748

SEQ ID NO: 183531 - DNA, 601 bp, Human; identical to SEQ ID NO: 20749

SEQ ID NO: 183532 - DNA, 601 bp, Human; identical to SEQ ID NO: 20750

SEQ ID NO: 183533 - DNA, 601 bp, Human; identical to SEQ ID NO: 20751

SEQ ID NO: 183534 - DNA, 601 bp, Human; identical to SEQ ID NO: 20752

SEQ ID NO: 183535 - DNA, 601 bp, Human; identical to SEQ ID NO: 20753

SEQ ID NO: 183536 - DNA, 601 bp, Human; identical to SEQ ID NO: 20754

SEQ ID NO: 183537 - DNA, 601 bp, Human; identical to SEQ ID NO: 20755

SEQ ID NO: 183538 - DNA, 601 bp, Human; identical to SEQ ID NO: 20756

SEQ ID NO: 183539 - DNA, 601 bp, Human; identical to SEQ ID NO: 20757

SEQ ID NO: 183540 - DNA, 601 bp, Human; identical to SEQ ID NO: 20758

SEQ ID NO: 183541 - DNA, 601 bp, Human; identical to SEQ ID NO: 20759

SEQ ID NO: 183542 - DNA, 601 bp, Human; identical to SEQ ID NO: 20760

SEQ ID NO: 183543 - DNA, 601 bp, Human; identical to SEQ ID NO: 20761

SEQ ID NO: 183544 - DNA, 601 bp, Human
atgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttaraaaaacgtatgtgtgtgtgtttaattagaataaaattcctctaggcagatttcaggagctccctttgtgtttggggtttttgttttagtataacaagatggaaaatattaatataaagtaaaatgatttgactggcttaaatgaacattttacattgaaaatatagtttggactttaccacttcagataaaggtgaagctgtggatggctctgcctcatctatttaagatggaatttgctaaggaaacaccctcaggaagtgcacaatatactagggaagtaaagagatacatactgtac

SEQ ID NO: 183545 - DNA, 601 bp, Human; identical to SEQ ID NO: 26395

SEQ ID NO: 183546 - DNA, 601 bp, Human; identical to SEQ ID NO: 26396

SEQ ID NO: 183547 - DNA, 601 bp, Human; identical to SEQ ID NO: 26397

SEQ ID NO: 183548 - DNA, 601 bp, Human; identical to SEQ ID NO: 26398

SEQ ID NO: 183549 - DNA, 601 bp, Human
aacatataaaccattggaatagaataaaagtccagaaataaagtcttgtatatatgtgtaaatgatttttgatgagtgtgtcaggatcgttcaatgaggaaaagacagtctttttaagaaatgatactgggaaaactggctatccacatgcaaaagaataaagttggacccttacctaacaccaaaaataaaaattaactcaaaatggatctatgacctaaatgtagaccaaaaactataaaactcttagaagacaacatagggcaaaaactttatgacatcagatttggcaatgatttcrtcattattacaccaaaggcatacatacgtaacaaaggaaaaaatatacaagttggactttatgaaaattaaaaataattgtatatcaaaagatactctcaacagagtaaaaagacaccacacataataggagaaaatatttgcaagtcatctatctgataagggattaatgtacagaatatatagaacactcttcaaacaacaataaaaaaaatcaaattacccaatttaaaaataggcaaaggacttgaatggacgtttctccaagatatacaaatggttagtaagcacatgaaaagag

SEQ ID NO: 183550 - DNA, 601 bp, Human
catagggcaaaaactttatgacatcagatttggcaatgatttcgtcattattacaccaaaggcatacatacgtaacaaaggaaaaaatatacaagttggactttatgaaaattaaaaataattgtatatcaaaagatactctcaacagagtaaaaagacaccacacataataggagaaaatatttgcaagtcatctatctgataagggattaatgtacagaatatatagaacactcttcaaacaacaataaaaaaaatcaaattacccaatttaaaaataggcaaaggacttgaatggacrtttctccaagatatacaaatggttagtaagcacatgaaaagagactcaactcttttttgctagggaaatgcaacccaagaatacaacacagcaccacctcacccccattagggtggcttctatgatcagaaatcggaatccgtgggcactgttgatgggaatggaaaatggtcagccactgtggaaaacagtacggcagtgcctcaaaaacttaaaaatggaattaccgtgtaatctaataatcttatttattggcgtatatgtacagaaattgaaagaagggtcttgaagagatattca

SEQ ID NO: 183551 - DNA, 601 bp, Human
gtcttgaactcctgacctcaagtgagcccagccctcatccttgaacttcaaatttccaccccaccttactcccacaggcatataccagttgttcctttttctctgttcttatgcaggaaatggcctgaggtccaggagtccccttggtcccctttttccctcactctcaacattcaattagtcttcacatctacagccgacaattgtaacttcttttctttactccattatttcttaggtgacaacaggagcttctttgtggtcttcttttttctaaaaacactaattcagaactctagcrtgtttagatcttccttacttaaaaccctttcctggtccccataacctactgaagaaatcctaagctccctggcttggcctctgtctacatttctctgatctcttccagctctttctctgtatcctagccatactgaactacttgcaattcccaaacagggtacacactgtactagttgttcctgcaagagacaggaacacacatccccccacactagcttaacaaaacaaaaaatgcatttctctctcatgcaaaagaagtccaaaagtagacattccaaacttaatatggtgttccagt

SEQ ID NO: 183552 - DNA, 601 bp, Human
cctggtccccataacctactgaagaaatcctaagctccctggcttggcctctgtctacatttctctgatctcttccagctctttctctgtatcctagccatactgaactacttgcaattcccaaacagggtacacactgtactagttgttcctgcaagagacaggaacacacatccccccacactagcttaacaaaacaaaaaatgcatttctctctcatgcaaaagaagtccaaaagtagacattccaaacttaatatggtgttccagtgtcagaatccaagttctttctactttgtggktttgccgttctcagcatatgacttccactttatggtccaaaatgactgctcaagctccagccatcacatccacatttcagccaggaggaagaaggaacaaggaaaggcataaccttgcctctaaggatagttcctggaagccacacttgcttacattccattggccagaattagtcacccagccatatttatctataagagaggctatgaaatttttttatttcagggagtctattttaggttgccatgtgcaaaagtaaaaaccagaggtgttggtggtcaaggaagaaatagcgaatg

SEQ ID NO: 183553 - DNA, 601 bp, Human
ctaacacttgctcttttttttttttttttttttcgagatggagtctcactgttgccaggctggagtgcagtggtgcaatcttggctcacggcaacctccgcctcctgggttcaagtgattctcctgcctcagcctcccgagtagctgggactacaggcacccgccaccatgcccggctaatgtttgtattttcagtagagacggggtttcaccatgttggccaggatggtctcaatctcttgaccttgtgatccacccgcctcggcctcccaaagtgctgggattacaggtgtgagccacygcacccggcccaacactcgctcactttatggccatcctcatactacctctgttgttgcaccatcacagcgtgttaaccattgttcaattgtccacctttcccactaccctgtgacctcctggagggcagggactgtgtctttcctttggctccttagcacccagtatagctgcacaatctccagccaaggtagaccgaccaccaatatttcttgtctcaaagatatattgaggaaatgagagtatattcttcaggcttccaggaacttccttacatctgtaggaaggtatgggcatgggg

SEQ ID NO: 183554 - DNA, 601 bp, Human; identical to SEQ ID NO: 26399

SEQ ID NO: 183555 - DNA, 601 bp, Human; identical to SEQ ID NO: 26400

SEQ ID NO: 183556 - DNA, 601 bp, Human; identical to SEQ ID NO: 26401

SEQ ID NO: 183557 - DNA, 601 bp, Human; identical to SEQ ID NO: 26402

SEQ ID NO: 183558 - DNA, 601 bp, Human; identical to SEQ ID NO: 26403

SEQ ID NO: 183559 - DNA, 601 bp, Human; identical to SEQ ID NO: 26404

SEQ ID NO: 183560 - DNA, 601 bp, Human; identical to SEQ ID NO: 26405

SEQ ID NO: 183561 - DNA, 601 bp, Human
tcatgttcatcccatttcttaattttgtggtcattgctttggaagtcaatatttgaaataaaatcttgtgagtaacaaactgagaaccagctttcaatgggattgctcattcatatatttatccactaagtcattgaacaacttttgagtctggactatctgcaaaatactaactgttgggtgctttgtaaaattgggagatgaaacagtttaggtgcttctatcaaaaattttagtggagggaggagatgttacatgaatacttttactattagatggaaataggaaagtaccattaggwaatacaggtaaatcactacaggattccaagaaatggaaagataatttcctattaagatattaatggaaagctttatagagaaggtccagagatggaaaattgtttcaagtttacaagcatcttctttcatagctgttattcatttctttctagaaatactttttcaaaagggcaggaaagtacaaagagtaataaaacacacccatgttgacattgctactttaagtgaccacacaagaatgagccatcatttccacatccaattttttcctggttcttccggggatatcacctttggga

SEQ ID NO: 183562 - DNA, 601 bp, Human
ttttacgaaatgaagggggaaaatcccacaagagaaaaaaatatctaaatcgagactcatgaggcctgattttaactccagttttgacaattatgacctggagcatgccacttaacctctttgggagtcactcttgtcatctgcaaaaaaaaaaaaaaaaaaaaaaaaaggacttagaacaagatgtctctctacttcacttctaactttgatggtccctggttctaatagtctaaattaatatctttgggtatatccttttgtaaattgttgactcacccagagaacttggatgcacccratcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcagcatctggccaaagatgtttcccaaaactgtagtccatgaaatgttc

SEQ ID NO: 183563 - DNA, 601 bp, Human
catgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattaagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttggggga

SEQ ID NO: 183564 - DNA, 601 bp, Human
agaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatygtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagata

SEQ ID NO: 183565 - DNA, 601 bp, Human
ttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcrtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaa

SEQ ID NO: 183566 - DNA, 601 bp, Human
ggcttagtaaaaatgccctctctgtgatgcttggttgggcagacacgttttgtttcatctgacatttcttgcagagtgactcaagagctattcagcaaattgtttctgacttgtccttaatgcctgattttcttttatttagcaccacaatttaccatctacttgtaggtcataagtagtagaagaccaagtatatactagacacataatgggtactcaataaatatttgttgatttaataagcgactgaggatttgtaacatgaaaatacacagaattcagcaaatgtctgcaaattcarttttctgattaacaaactcaacaaacgagtataagttctattatactgccatgtcttcacctaaagtatttccttttttttttttttttttttttttttttttgagacggagtctcgctctgtcgcccaggctggagtgcagtggcgcgatctcggctcactgtaagctccgcctcctgggttcacgccattctcctgcctcagcctcccgagtagctgggactacaggcgcccaccaccacgcccggctaattttttgtatttttagtagagatggggtttcaccatgttagccagggt

SEQ ID NO: 183567 - DNA, 601 bp, Human
gctagttgttgaagggctctggcatagagccaatctgcaaagactgggagagttatgttttgtttgcttggttggttggttggttgattggttgctttgtattttggccccagatactcaagaaaatctctcataaaattctagttgaacacaggctgagaaacaaagactatagtgaccacacatgagaaggaatattacagtcttcgcagaaatagttttggaaagtcactaagcaaatggcctactatacccttcaacagtcaaaacattcagcaaattctagagaaggtagataatkttcagttactacagtatgataaatatacagttttcaacaaaaatcacaatgcataaaaagtaacaagaaagtattggccaattcaaaggaacaaaataaattgatagaaattatccctgaggaagttcagacactgggcttactaaacaaggactttaaaacaactgtcttaaatatgctcaaagatctaaaggaaaacaaagacaaagaatgaaaggaaatcaggaatattatgtaggaataaaatgagaatatcaataaagaaatataaattgtaaaaaaaattctgtatctgaaagg

SEQ ID NO: 183568 - DNA, 601 bp, Human
aaaacaaaccatgattcaactatatgctatctacaagagactcactttagtttcaaagtcacaagtaggctaacagcagaagaattgaaaaagatattccatgaaatagtaaccaaaagaaagctgaggtggtatactaatgttagacaaaatagattttaagtcaaaaattgttaaaagagacaaagaatgacattatatatggagagagatctctaaagatgttctatttattattaaaaatggtatgttgaagtctccaactattactgtagaaatgtttatttctctcatcattttkgtcaatatctgctttatatattttggagctctgtttggtgcatatgtgtttagaattattatatcttaatgagttgaccattttatcaatatataatataattgttttcaggccactaaacaagcctcagtaagttttaaagtattaaaataataaaatgtatcttttcccactatagtggaatgaagctaaaatcaataacagaagaaaaactggaaaattcagaaatatttggaaataataccgtcttaataaatcaaagaagaaatcacaagggacataagaggtgaatgaaaacaa

SEQ ID NO: 183569 - DNA, 601 bp, Human
tgttttacttcttagctttgatataatgacaaactccatttgctttaaaaatatattttgttttattcaattttggctttggtgcaaaactacagaaaatattttttggaactctatcatgcttgtcaaagaagaaatcctcaggccaccgagggtagggattggcaaactttttctgtaaaaggccagacagtatacctaagactttgagagccagatagtctctgtcacaactatgtgattctgcccttttggcatgaaagcagccataaacaatagtaagcaaataattgtggtggtrcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggtt

SEQ ID NO: 183570 - DNA, 601 bp, Human
atagtctctgtcacaactatgtgattctgcccttttggcatgaaagcagccataaacaatagtaagcaaataattgtggtggtgcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccawgataattgaggccctgcctgggactccacctggtacaccagtcttaattagctcaggctgtgataacaaaggattgattggttggcttataaacaacacaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggcccc

SEQ ID NO: 183571 - DNA, 601 bp, Human
acttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggttggcttataaacaacasaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggccccgcttctaccctccaatactatcacattggaggttagaatttcaacatatgaattttgagaggacacaaacattcagtccattgcacacccaaagtgtca

SEQ ID NO: 183572 - DNA, 601 bp, Human
acaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgactttttttttttttwaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaa

SEQ ID NO: 183573 - DNA, 601 bp, Human
tctggataaagcatcaagttggctagtgtagatacaacacattcagacaaaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactratttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagt

SEQ ID NO: 183574 - DNA, 601 bp, Human
aaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagyattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttct

SEQ ID NO: 183575 - DNA, 601 bp, Human
tataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtccsctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttctgagacaacagtggaatgattcacggctggcgtacagtgagtacccagatgactccctggacttggacccatccatgctagactccatttggaaaccagatttgttctttgccaa

SEQ ID NO: 183576 - DNA, 601 bp, Human
aaaagttcctgctgacgttccattagaaagtaatttccctgcatactcaggtttacaacacaaatactcccaggagaggaaatccactggcttaaatccatactaaactctaaagagctgatataaaatttatttctgaggatgaacatactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtscacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatgggcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagacc

SEQ ID NO: 183577 - DNA, 601 bp, Human
tactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtccacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatggrcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagaccagaactccgtaagtgtcatccttatgaacacttggggtaccttgactaaaattcaaacaaatcttttaaataggaaggaaaggccttatctcagtgttaataaaccttttatccagtgatgtaggacacaatctttgttgatgaaaaa

SEQ ID NO: 183578 - DNA, 601 bp, Human
ggcagggcgcggtggctcatgcctgtaatcccagcactttgggaggccgagatgggtggatcatgaggtcaggagatcgagaccatcctggccaaaatggtgaaaccccatctgtactaaaaaaaaaaaaaaaaagtacaaaaattagccgggcatggtgtcgggtgcctgtagtcccagctactcaggaggctgagacaggagaatcactggaactcaggaggcggaggctgcagtgagcagagattgtgccactgcactccagcctgggcaacagagcgagactctatctcaaaaaaawatatatatatatatgtatagtgtatatatatacacacatatatgtgtgtgtatatatatgtgtatatatatgtgtgtatatatgtatatatatgtatatatatatgcatattttgtgcattaggttatttaagctattttttgtttgtttgtttagaggaaaaggtccttatctttattaaagaagctatgaccctccaactgttaagagcttgagctttgtttccagatttactgcatgcctccagaatgggtatgcctaaaggtgaagtgattaaggaaatattgtttgctttcagtg

SEQ ID NO: 183579 - DNA, 601 bp, Human
agttggctcttccatcttctcctgcctgctttattctagccgtgctggcagctgattagatgatgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacrtgactggactagcaatagcaaccagtaggttttcttccatttagaggtaaccttacatttcattaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtc

SEQ ID NO: 183580 - DNA, 601 bp, Human
atgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacgtgactggactagcaatagcaaccagtaggttttcttccatttagaggtaaccttacatttcrttaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtctgtaactcaaaataacgtccctctccttcccaaaccacaaaacactttcctgatgagtaaat

SEQ ID NO: 183581 - DNA, 601 bp, Human
aggtgcctgtcttaaactacttggatctttgaacccttttctcctgaattaaatatacaactcctgagaagaggaacctgattttggagtaggttagggaggtttggactacctgtaatttaagaggcagcgttaaaacattcaacatggccgggcagagtggctcacacctgcaatcttagcacttgggaggctgaggagggtgtatcactttagctcaggagttcaagacaagcctgagcaacatggcaaaaccccatccctacaaaaaatacaaaaaaactagctgggcttggtggcrtgtgtttgtagtcccagctacttagggggctgaggcaggaggatagcttgagcccaggaagtcgaggctgtagtgagccaagatcatgccactgcactccggccttgatgacaaagtgagactctgtctcaaaaaaagaaaaattcaacatatagtttacacaatgacaaatactcagtatcaagtgccctgagaaacttcccagtcgtaaactagatcatttgtaccctctgattcaatcaccaggaatatctgtgaactattattttagaatatgttcatgaaacataggtttatata

SEQ ID NO: 183582 - DNA, 601 bp, Human
aaacaacaagccatgaggattctgggtgtctgaggaaaaatgaaaggggtatccctgagcaggtacaaggcaactaaggtgtctatgaccaactctgctggcttcatagacaaaagaggataataaattggtaacagattattttcctaaggaggaaatgtgaaatgtgatagagtgggaaataataaagggaatttgatgtcggttaaagctgtattcaaatctaacttcggttgcttagtggttttatgactttgggaacaaagcttaaactctgtgagtttcaatttgcttatctcamaaatggaggtaacactgtctgccttgtgtgataatactcagtgattataaaataataagaatgcttgacccacagcaggtgttctgagaattatgattattaatactattatcaccatcactttaatttttagtttgcctaagtattttcatcctaaaggagcaccataggttccagcccccagatgtgtccatgtgccactgaaagtttgtggtgtgctgcataaagagagataaatgtggtcccaacagaggaacagcaatacccccaagactctcttgttcgtcctgaaagacacag

SEQ ID NO: 183583 - DNA, 601 bp, Human
tgtttccttttgcagcactattcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgttttttttgtttgtttgtttgtttacttttttttggttcttatattctgtccttatttcaaagagttcatggcattaatctacacaaaattgtgttttcaaaaaaacaaagtmtttatgctgggaaccaaaaactaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttac

SEQ ID NO: 183584 - DNA, 601 bp, Human
tcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgttttttttgtttgtttgtttgtttacttttttttggttcttatattctgtccttatttcaaagagttcatggcattaatctacacaaaattgtgttttcaaaaaaacaaagtctttatgctgggaaccaaaaaytaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttacctttcagttattgtttgaaga

SEQ ID NO: 183585 - DNA, 601 bp, Human
aggggcaacttgttggaatttcagcagcttaccaaatatatggcatatggaagagataccagtctcttttcttacaggggtgggtataaaccaccttctatccatctttaggagaacagggagaatgccacagcactgtcaacgtccacaaattccattacttcaattaatgttttcgaatgtctggttttctgtaataatacagggtgttgggtataagagtctctagacagcattttctgtcttctagaaagtactgtatctggcatgtatatgtgcagcgtctccctttagtgtaagrctttagtaaaaatgctgaggcaataagaatatcctgttcccatactgttacacatataaatatacactcttaattttagacttttatccctatgagggcaaggacttcattgctcttggaaatgttcgtgtacccacccctcagcacaacacctggttcacagtaggtgctcagtaaagagtaaatcagtgaataaatgaacagtgttgaaaatacttgtaatcaaggggtattcccagtataattcaattgatgattcatccatccatttatttattcaactaacacttattgaatgtt

SEQ ID NO: 183586 - DNA, 601 bp, Human
tcctcatagctttccataagaagaagcctcaattaggcaattgttatgtgcctacctctctttataaaatatctctcatggcccaggaaggagcaggatgctgatgataaacacaccaatttgagcactcactaacaattgggcaagtttccatttttgtacatatccttatactaaatatgctcatttcatgagacagaattatgtgtttgtatacatgcatgataatgtagtcatttatgtaaagggtattatgtttatgaattaaacatagatatagtatggtaatgtttatgtaaasggcattatgtttatgaattaaaataaacatatatatagcataataaggaatattagaaagctttcagctgatgcagtaattttctgttgctgtataataaactttgctacttaaaatacccatttattagcttgtaattctgtaagtcaaaagcctggcttagcatgactgggttctctgcccagggtcttataaggctgaaatcaaagtgtcagctgggatgaggttttctttggaggttctgaagaaaaatatgtttccaagttcatttttgttgctggcagaattcagctccttgca

SEQ ID NO: 183587 - DNA, 601 bp, Human
aaaaaatgtatccattagtttctcaaataatttttctgtacccttttctgtatcctctccttcaaagacttaaattacatgtacatcaggctatttgacattgttatacagcttactaagcatctgttctctttttggtcctttatttttcctcttagtccatttgtgctgctataacaaaataccacagactgggtaatttacacagaacagaaatgtattgctcacagttatgaaggctgcaaagttcaagatcatggcattggcaggtttgtcgtctggtgaaggtttggtctctgcttttttttttttttttttaataccttaagttctagggtacatgtgcacaacgtgtgggcggtctctgcttttaagatagtgctttgcacactgtgtcctctggaagggaggaacactgtgccctcacatggcagaatgcagaatggcaaaagaggatgaactccttccatcaagcccctttataagggcacctaattccattcatgagggtggagtcctcattactcaatcacttcccaatactgttgcactgggaattaagtttcaacataaattttggagaggacaaaacattcaaatc

SEQ ID NO: 183588 - DNA, 601 bp, Human
cccacatcgtaaaacaaatatccataaggtcatactgatataaataaatgattgcataaaaataattgaggtagaaaaaacaaatctcccatgcagaattccaaataactcatatagatatattctgccctcaaggaggtagagcataactccctattacttaaatgtgggctgcccataatgacttcctcccatagggtacagtatggaaagtagaaaaaagagtaactttacagtagagaaacctgacaaatacgaccttagtcaggtgatcaaggtcagtatcaacaataagtcatawtgattgtatataacctcggtatgatgtgatgagaagggcactttatctctgtggtcttccttccaaaaacatataatcccagtctaatcatgaggaacacatcagacagttcccaatggagggacatgttacaaaatacctgagtggtattcagcactgttaagttcatcaaaattaaagaaagtctgataaagtgtcacagctaaagggatcctaaggagagaatgataactaaatgtaacatggtatcctggatggaatccttgaacaacagtaagaaaaaaagttagataaaaacta

SEQ ID NO: 183589 - DNA, 601 bp, Human
ccactactttgccaagagataggcaatatacaacaggcacttttaagaaaggaaacgtgcaatgcctcaccatgtttgcttggaagatccctaacattacgtggtaaactcatcacaaaaaaacgtaatcactcagcaaatatattgcttgtaccatgagcaaaggaatatcatgcaaatgaaaagaaaataaaaaagagctaaaatgtcctgttctatcgcaagtaaaacatttgtcagacacaaagtcttcttttcctttttctcagagtaaaacatatacattaaaatgcataaaatrcccatgtacattaaaatgccataaaatgttaagggtacaattcataaatttttatatatgtatacatttcagatcaagatatggaatatttctagtgtcctaggggtaactactgttctgacttgtttaactattgttacttttgcctcttactgaacttcatataaatggaattttgcagttcgtattctttcataactggcttctttcacaaaactcaatccctgtgggatgtatctgtgttgtttgtataactgtaattttttcccttttgttgtccgttctcctgttggtgggcat

SEQ ID NO: 183590 - DNA, 601 bp, Human
ttcttacccaagcacaagtctggatttgaactctttatccaagtactctatgttgagttctacatgattttaataaaacagtctaattaagtttttcataggtaataatttttgccttttttgaaattctctgtggtgttttcaaaagcagtggttttaaaaggaccattttttcaagagcagcattctatatggcaggaattctgtcttgcatatattatcagaagtaagataaaatcccacagtttggtggttcagatgagatatttgggttcaagccatatgaagttagttttatttrcatacctctgatacctcatctataaaatgaggataataataggacctgcctcatagtgttgaggagatcatcggaatagacctacatgaagctctttgggtgatgcctagtacattgaaagccctcattaagtttggctattggtaacattcttggggtgtcatattaggccctcattgtgtccgttaaggttagaacattatccaacacactggggaaacattcacgtgttgatctggaccactcagacataaactgggtggattgggtctgaatctccaggtctagctgtgtgaaatg

SEQ ID NO: 183591 - DNA, 601 bp, Human
gaagggaatcacatcctttatcaatctatgccatcaagatattagcttcccataaatgcttatgtgaaaatgtgcaatgatttgcatctggtcatgatttttttttttttacaatacatcatgttatagctatattaatttcttactattatatatccatatagcatgtaattgtttttattttgcttagtttttttcaactttctacttcctgaattttaagaaattgacacaggaattatttggctcaagggaaaaatagactttgagtccttttgcatattcttattgatcaggtatsgtaggcagatttctaaaaatcccttttcccatcaagattacatgcccttttcccctagaaccagtgagctgataagatatcatgtccatgattgcatcatggtatatggtacagttgaccctaaaataggaagatcatctaggtgggccagatctaatcagactatcccctaaaaacagagatatttctggcagaagagaaagtcagagagatttgaagcataagagagattcagctgtggcttgaaaatagcggtaaccacaggagaaggaatgttggcagccttaagggattgaaaga

SEQ ID NO: 183592 - DNA, 601 bp, Human
actcttttgttgaatgtgaaccacaccaagacatttatcacttgcaaaagaacttgtagggcttcatgagggaagaatttttgaatacataaaattcaagcaggagctttaaataattccagaaaactgttttcccatactttgtaattccaaagctggggataggaagcagtgtagtttttttagatgtaaatatctgagttgtgagaaatttcaaagtaaaattgatattacattattatataattattataatatacagtcatgtaccacacaatgagctttttggtcaacgatgaaycacatatacaatggcagtcccataaaagcatagtactgtatttttaccatgtgttttctatgtttaggtatgtttagatatacaaatagttaccattatgttacagttgcctacagcattcagtaaagtaacatgctgtacaagtttgtagcctaagaactataagatatgccatatagcctagatgggtagtaggctatacagtctaggtttctataagtacaatctataatgcttgcacttcaaaattgtctaacaacacattttgcagaatgtatccccattgttaggtgacatgtg

SEQ ID NO: 183593 - DNA, 601 bp, Human
catttcagtttcactttgaatagtatgaaacagtaggtagctgattaacttcaagagctttaggttagaacacactaggcttgagcgcccagagtgccatgccaagaagggaaggtgtctggcaagttggctcctatcgagacatccttgatgatctgcagcctccactgtgagctcacattaaagtacagagctgacactaaatcagtccacaagccagagtctgggtcggaaagcttctcggctaccactgactctaccattcaattgaaattcatatttcacactatactctcatatrttaaatactctatggccctccactaaaggaatccctgttctcatccccaggatgtagcatcacagtgctcagagggttcaggtgcattggtggagaagttcagcaccagaaggggcctctttgtatcctggagttatcacaagattctaggtattctgaggaaatgatttctccatcactgcaacttgaactgggcttctaagactgcctctattttgtactccagaatcacccattccctacatatcttacccactgttcatctcaggagtacatcatccataattgttatgagatgat

SEQ ID NO: 183594 - DNA, 601 bp, Human
ataataaccaggcattaggtgttgatggataggattaaagtgacatctttggaatggagagagtaaagagtaaacccaggattgctttacagagagaaatgttgagtctgtgcaatagattgagtattagagatgaagacaatggagggggaaacagtggtaaaaccaggttgctagtgagaagaaagatttaaatgagatgaataagaaggaggtggcatttaatatgtttaattttgcaaatactaactagctattttagtattatcacagaatgctgctgtgaggtcagggctgaggsaataatttgagagctttggaaacacaaaaccttcatatcctcaatgaatttatccactcctatagctttcttcttattcctgtagcttgacaaaataaaaatttccttctcactcacattaaactctactatggggttggtggccctaggtcttttggggatccagccttcttccatcttacggcactgccatcttaaaccggtgacatctaaggtggctgcagaaggtatagtcttaagggcctcatggaagattttagcggtcctaacatgtgtaacttctgcctacattccatggag

SEQ ID NO: 183595 - DNA, 601 bp, Human
ataaaaataatgtaacaggggaagatgtgagctcaaaacatctaaggattagcagctgaaagaagagaatctgacatcagagctgggtaaaagcaacaaaaaggcatttcagttctgagaaaccagcaccaaggaacatcacatcatatgtgatagatgtctcacaacaccctctaaatccatgtgaataatgcatttaatgccagcacttcaatgctggaaagatgttcatgatttggaggaaactcagagagcaaccaaaatgattaagagactgaaaggactcatttgtgagcagctraaaaagaagccaaatatgagcttggtctgctgattgctagaagatggggaaaaggtgtataaattactgaatgctgtaaacaccaggaagaggaggaatgatggtcagctctactggacttagctcttggtaggcacatatctcgggcattaacacattcctctcattattgggtcttaaaacatttatgggccatgtgaataatatataactggaaatgctgtgattggtaatgttctattattacaggaaaatagtataacttaattatactttaagttctaggttaaaggtgcacaa

SEQ ID NO: 183596 - DNA, 601 bp, Human
tttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtycggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagggatgaggaatagaggcagagagaggttaaataaca

SEQ ID NO: 183597 - DNA, 601 bp, Human
ttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtcyggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagggatgaggaatagaggcagagagaggttaaataacat

SEQ ID NO: 183598 - DNA, 601 bp, Human
tgcgcttcccgggtgaggcaatgcctcaccctggtccggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagrgatgaggaatagaggcagagagaggttaaataacataactgaattatacagatagtagcagagcagcatttcctaattggggcatcttactccagaatctctgcttttatgtccactgtgctcctgcaaaccttctaattcaagagcctgttttcatatctttacttctgtaactcacctaaaagttgatccaacaaataatcagggacacagtcaagtattttgggagaagaatgttcatagcagcaaaacttacagtcataaaatattagatagaaaataacctatatgtcctacaat

SEQ ID NO: 183599 - DNA, 601 bp, Human
tctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagmaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatga

SEQ ID NO: 183600 - DNA, 601 bp, Human
gttctccagaggagctcagcagcctagaataaccagatggtgggttccacaattgatccaggcaggactgactgaaataaaaatgggcaacccctggttcaaaaacaattaagaatttcaagatggcaacagcagagcattaaactaagcctagcacccctctgtgtatggaccctgtgtgtctgcacaggttgcatgcccgtgaagccaatcttggatccaagctgagggttttgccagacaggatggatgaatggataaaaatatgaatcacgtgatggtccaagcagggtagagaaakggggatactgtaaagaagagatgagaatgaaaggagaatattttacacataagtgaaataaatgtaagcaataaaatgtggcagttagcccacttatttattctttatttgcaataaaacagttaactctagcttttaatttcaatgattctttatatttctatagttaccaaatttagttgaagttctagttttgcacagaccttcttaagggagttttgctttacagattttttgaagggagttcaatgtttaaatgagaaagaaaacttgtatcaactagtgtcctttttgtgttgt

SEQ ID NO: 183601 - DNA, 601 bp, Human
ccaccaaaaggctttataaatgatagaatgctacaatcagattggaactgtggaaacatcactctatatagaaaggatcagattggaataaggcacaagatcaggaaaatgctgcttcagcatttcaacttaaaaacacccttaattttataagtagtctacacttccctgaagcccctccctagaggcatagatcattattactattttggtttgcctttttgtaattttgctagaactagctttccaaatctgggatgtatattataaacttaccaaagcttgtcttaagtgtgaatakaaaagtggctttctggtttgaattctttgcagtaacacaggtgtcttatcattgctgtaacaaatcactacaaacttaatggcttaaaacaggaaaaacttattatctacacttctgtaggtccaaaatgggcctcactaggttaaaatcaaggtattggcaggactgcattgcttctggagggttgtcacgggggttcaagggattgggggccatatcaaagaaaaagatatgaccacgcaggcagtaatacacaacaaagtttattgggtggcacttggacagggttgcgtgaaaagg

SEQ ID NO: 183602 - DNA, 601 bp, Human
atatgaccacgcaggcagtaatacacaacaaagtttattgggtggcacttggacagggttgcgtgaaaaggtggctcctcacagcatgaaatgatccagaggcttagagacaggggccaccatacagagaggagaggacaaggggactcccagtggggaggtgaatcagagggggctcacttgtctaggtgatgttgctcagctgcacagtgggggagcctctgggtcagagagcttcaaagagcagcagtgccatgggaccttataagtgcaaggaccagcagatgctaggcatggtttygtgggctatgcaaagcagtcagggtctagatggctaaaaatctgcttgtttaggctatttttaaaataatggaatgtgtaaaatttgagtttggtgccagcaagctttggagataacaggtctcaacctatagtggggaaataaacaaccaaggggacaatactcagaggccatctttggctcatttatataacagtgttctaggggagaatctgatttcttgacttttccaacttctagagctacttacattccttggctcatagtcccctttctccaaaggggaaagttgttcaaagc

SEQ ID NO: 183603 - DNA, 601 bp, Human
gacagtccagaagtaccaggaggtgaatgctacaggagtggccctcaaccaatgagaactgggagttggtggccaaataccaagcttcctcaacccttggtaagtcaagtctcagtctctcagaggtttgagccccatttggcaaccatggtcacctgctgattattcacacatcctttattgacttttctcctttccttgtcctacacttccccactccctcaccacactcctgttgttgcctcccaagtaaacctcttgcatgcaatccctcatctcagggttgctttggagagaacaraaacaaactaaggtgcaatgcctcctaggccaaggacctcatgagaatcacaacccactgaaccccatcctcggcctccccactaaacaccagattctggaggactttttgtgcctaaagtgtggaaacagagggaatctaggagcagcaagtgtcaaacaatggtttattgtaccttacagttggcattgctaaaatatttctgtgctgctgagcttctaaaataggtttcataacacaattctattgctttatgtccctgaaatcaagcctgtgccttcagctctactagtgtttcat

SEQ ID NO: 183604 - DNA, 601 bp, Human
attgtagtaaaacaataattctaaatagtcatacaacttcattctggaaagcacaaaatgcttcaaattatggtagtttggcagtgatatctccacagggagtttataaggtttgctgaatgtcgtacagccaattcctgactgccagacctgagacgccttaattcaacacagaatcattgaatgttctttcacacttcctgtcttttagggcagattgattaaaataaaacttacaaaaatacctgtcttaaagtcagccttcttcatcccagccaagtaccctatcctgtcaatatgyttcattacagcaccatttcctggaattactgccattgaattcccgtcctcttaataacatatactttttctctccaaaacatgcaaaaaagaatatgagagagaagcatgacatagtgacacatgcttagggccaggagtccagctggctgaatctaaatcctggctggtgctttatttgctgggtgattagagtcatggcctaaccactctgggtctcagtttcttcatctgtagaaagagtctaataaagtcctttctcatgggctgctgttaggagcaagcaagattatgcacgtga

SEQ ID NO: 183605 - DNA, 601 bp, Human
accagtttcttttttttccttcctttctaccttctttccttccctccctccttctttctttcatgagaacactaaagatctacccccttagcaaatttcaagtatacaatacagtattgttaactatagtcacattgttgtacattagatctccagagcttattcatctcacagaactgaaactttgtatcccttgaccaacatcttcccctttcccctcactctatctcttggcaaccaccattctactctctgcttctgtgagtttgattattttagattccacatataagtgagaacytgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaagccctcgcttttgtttgaccagcccacactcacacgccacctgagtattatgatgcccatgacccagtgggctcatcactccg

SEQ ID NO: 183606 - DNA, 601 bp, Human
tcactctatctcttggcaaccaccattctactctctgcttctgtgagtttgattattttagattccacatataagtgagaacctgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaarccctcgcttttgtttgaccagcccacactcacacgccacctgagtattatgatgcccatgacccagtgggctcatcactccgtgacctgccttcagagttcaagctgtgtcatcctcagctggacacaacatctgcccaattatacagcacacagctgggagaaaagagagacatcaggccaggcgcggtggctcacgtctgtaatcccagcactttgggaggccgaggtgggcggatggcctggggtcaggagtttgagaccagcctgaccaacatggagaaaccccgtctctactaaa

SEQ ID NO: 183607 - DNA, 601 bp, Human
ttattgagcatacactatataccaggcatgtaaacttttaatgtacatttccctgaatcttctcaaaaaaccctctaaggaaggagatatcatctctattttactacaaaagagactgaggcacgtagtaagtgacttacccagttcccacaatggttagtggcagagccaagatttgaaaccagagttttcgctccagagcccaggcttctcacctttacagggcattgcttccctatccttggaaacttatgagattatcttacaataattttcttataataattccttaaagacagtyccatttatttaagctactatgagtgagtttctgtcctttgtaacaaatcttccgcgattaagatgccagatggttaaaagataccaactaatggccaaatggcagaggcagtgcattttgtcatgttattatagaaaaaaatgccatctagctttccttcaattgccttggcataacattaccttttccatagtatctggtggtctgttcctttgccagagcagatatcacattatattatagtcatttgtctgtatcagggtttcccaaccttagcactgttgagatttgatgctagat

SEQ ID NO: 183608 - DNA, 601 bp, Human
tcaatcaggaacacattcaatcccatatatttgtaatatttatcttactttatggcaggaattctaggtttagataactagctattgaaagtgtaatatttggcacaacgatgactcaaatagcctgttccagttactgtgctgaataaaccacttcaaacttattggcacaaaacaaccatcttactatgctcaggaatttgtaaaaggcagagtaggaatgacttgtctctactacatgatgtctgacatattagctcagacgattcaaagacacatgattatttgacagctaggagtyagtcatctgtagacttgtttgtccacatgtctggtgcctaggctaggaaaactctaagactaagactgctcatcagagtgcctacacatagtctttccatgtggcttgacttcctcacagcatggcagcctcagggtagttggattttttatatggtgtcccaagactccaggcccaagtgcaccagtgaacatggcaaggctgcattgccttttatgaactaacattggaagtcatacagtgtcatcttcactgcattctattacttacaagcaaacataagcctgcccagattcaaag

SEQ ID NO: 183609 - DNA, 601 bp, Human
tacacactccttcagacttcattctgatcattccaaaatttctctgaaatgttaccatttatctcttcctttccttcagtctcaggaagaagaaaagtttttctcctttacaagggttaatcccttcccatcacttttcatatctatacatgtcttttgcactttttcatatctatacatgtctctaactcttcttcctctccccccttgaagagtaatatacatattcctattttaaaacctgtctctacttagccttctcaaactattatcacttcccaacaccaaacttagaaaaagrtgagtttatatcaccaaattaactttatttcttcatattcttccgctctgtataactggaaatctattcaaaccattcattaaaacttctctgtcagtctacctgtccatgaactccaaatcctaaggctcttattcttcatgttctttaattgtcctgcagaaggtgcactattaaataatccctcttttttgaaacttcgttttcctaggctagtatgacattaccctgtcttcactcttattctaaaatacccacttgctcttcattcttattctaagacactcaacttactcttca
